United States Patent 7,745,391 (HUMAN THROMBOSPONDIN POLYPEPTIDE) - sequence listing, part 244

SEQ ID NO: 677973 - DNA, 1097 bp, Homo sapiens
tcccggacttcagtgagcgacccgcactaggctggaggacgtccagcgctacctggtccagtgcttcgacaggaagagacgtaaccgcagcaagccactcttccacctacttcaccatcgcgccagtctgagcaccgtacaacgttccgcttcgtgttccatggcgtgtgaaagacaccatctctgcagagagcaaccttgaatggactactcatgctgactgtgagacgaggatagccccgtgggatttggtctgtcggattgatgcagcacccctacggcgtgtccggtcagaacgtctatgggtgtcgtgttgtcgtgtggtggtcacttgtacgtgggttatctgcgggtagtccagtgctcctgggaataccggggcatcaggcaatgcatgtcagatccacgtcgcatggcacacgcgatgcttctaggtcacaacggatcactggataactcgtcacggttaggcttacttgagatcctaggggcgcgagtgaaaatctactggaaagatctcgaagtgatgcatgtatgtggatagtacggtagagcacctgaatcatcactagtctatgcgtgtatgctatttagccagatacacgttgcgctcgtttctcgtgacagcagattcgagggacccgatgtggtagtagatgctagtgtcgttgtacgacagcgctacgtgtgcgtttagatgagcgagtaaacgacaaaagagcgagctaggccgttgcaagactggcttctactagactcatcagagctcttcccatgaggactgacgtagcctgcagacgctttggcctaagcagatagcttggtagcagatccagttggacgccggatgcttgctaagtcagtggctgagcccggtcctgcagcccagccgcaggaggctgggaaggtccaacttcccgaaagggtagcacggttgccctttacacacacttccccgtgggccgattgtactctaagaagggccttattcaagagctcatcacgatgagagcctgaggggcccgggctcaagaaacctacccatctgagagaccggttgcaaagctcgcagcggtgggtacaccctaagcccttaa

SEQ ID NO: 677974 - DNA, 438 bp, Homo sapiens
acgatagccgacagctgaggtgtctgcaggctgtgttctcagtggctcccaccagatacccgatggtcctgtcgattggctgaatcatcaacttccttttctctgcctctggcccgaatcgatgtcccacgttatctggctctctgtagcacaggagtcacaaaatcaaagtcttccttggtgaaccagttcatgacggtatcgatgttctccttccgctctgtctcgttgctgcttgggtgagtgtaggaatccaccagggaccacttgacagcctcaccctcatatttagcacctcccctggaatagtggaatgatgccgctctgttcccctgtaagtacaagaagaaaattccatcagggccatttgtcatacctttctcacaatcagcaaagctcgagttgtctacatctgtgcccctgtcgggctagtcgggg

SEQ ID NO: 677975 - DNA, 1657 bp, Homo sapiens
tacctctgcagtacctcaccagggcagcattccagctatcatgcagggatccctgtgagtctagccaggagcagccattaaccctagctgacttaactactgggagacattaccactactggacggcatggcatgctctcacgtttgtcacaccaccatcagattacaccattcgcccttcttctacggacttgcactttcccaagctgctacttgcaactaacacgcttgactacgtcactttcacggtaccaaacccctctctcgcagctctcaacctgcactcacaaccacaaggcacaacagctgctctacatagcaagcacacacaccttacgggcacaacagcgccgcacacaacacggacacacacacactgggctaagctacacctcgtgacccacgcacacaaacacacacttcaacgtcctactactacctgctacctccgacctctgcgcccaaacccgaaacaccttcgctcacttccgttaaaaaggcttacggcaaaaaccgtcggtaccaaccttctcgaggcccttcacggggcaacacaccacccacacggcaaaacagcaaaatccgtggacacaactgctctcggtcaacacgttccccaactccttgctactgcgccgttcaacaaggaccctaggcgctccccgctgcttctctcggaacggagggaccattcttaacggcgtccaacgggcgtagtccagtttctgcggggaaaaacaacaattgggcgtctccacaacgaggaaacttactatactgcccccctatctgtgccatgtaattgtgaaaggaccgttatgccatctccaacgtagtgtctaacactcgggcgtgacattggctcttaacgccccgcatgtttacgaaggacgtacaagccgtgttccgttcacccgccccaggactttgtctataagagcgtctccatatcccataacgagagaaacccctggccacacacgcgggcaacatatgcccttgtctcgacctaaaccaacttcttagtcatacccaaccggcgatgactggaactcgggccccaactcaaattcgaggggccattcacgggcccctaactcactaccctgtctaaaaacagctctcacccacgtgggcgctcccacacacaacctccagcccgcgggcacacatccggcgcacactaagcaacctgcaccccaccccgtggggcaccgccactcacatccacatccaccacacgaaccccacgacagacgagccacgggcccagacagacgacaaacacgacagaacaagagaccacatccaacacacacgcacaacgaaccacaacaccacacgcgtccgcacgcacaaaccagtcatccgcacacaccccccgaacagaacacccccatccaatacacacacccacggcgaatggcggacacccggagccaccaaacaccgaaacagacaccgcaggccccaaacaccgcgcgcccaccacaagaagcacagccagcaccaccccaccagacgagcgcggcatgacacaacaagaatacagacccccgccgcgccaccgcgacgcctcgagaccaaccccaccagcgaccacgcccgccacacgcgccaccaacagggacccagcgcagcaatacaccaccgccgg

SEQ ID NO: 677976 - DNA, 665 bp, Homo sapiens
  misc_feature (503)..(503): n is a, c, g, or t
  misc_feature (511)..(511): n is a, c, g, or t
ggtcgtcggttggcgctgcaacgggttctaggctgcaggcagctcgaggaccctgcggcccgccccggctcggcctgtgcaggatagcagaggcagtaggccgtgccggtgggggcatgttgtctgtacaccagtggcccaggggatgttacggtggcacagggtcacctggagtggcgggcccccgccatgggtgtaaccatgctgcagtgagtttgtcgggtcatcgagtgtatactccttcggcggagttgacttgctctggctgaatgcactgatgagaactagcgtagctgctcgaggagtagaagtgtgacgacattttctacaatgtctacgttggtcgctttgacgttgtgacaataggcgtgtctcgcccggtgatgaagttctggctatcgcagatgggcatgaggctcctgtgcgtacccgtacagtgcgcctaatggacatctcatgctcgatctctccactcggaactgaagctagcgagttgcactcgntatatggnggctgcggcgggatagtgacgagcctgaacggtgggcgcttgcagattgtgcatcttatgcgcttttttggactgtcggagtactgctacacatggtggttctagtacctccggaggtgtccaggggcacgagtgtccttggggggcccgggga

SEQ ID NO: 677977 - DNA, 321 bp, Homo sapiens
ctttagggcgctacggggatgccaaattccaggggccagaaagagcttgggataaaaagagacttcaaggggacggctttgaccggggctgagtctgcctgtgccatccaactggagtctcaagtcctgaggcaggacgtccagatgccccagtgcagggtcctcctgatcaacacctgctcccctgtactcattagcaacctcacccaccctactctcaaagcacacttggctctcgtgtggaggagctctgcatctgtagattcagcaacagcagatggaaaatattcagaaaataaatggctggcctcgttggcctca

SEQ ID NO: 677978 - DNA, 223 bp, Homo sapiens
cgctcaccacactcttgctgtgagtcagaactctagcttgctctcccatgacacagtcgacgtcccgtggtactacttcaaagctcgtacaagagttgcatttgtcagcgactggctgagcaggtttcggggctgtagggcctggagttgtcgtccccaggctgagggtcatggtagagtgtcttcgaaggagaaacagggtcctggtatcctaagggtgcta

SEQ ID NO: 677979 - DNA, 1209 bp, Homo sapiens
gctactgactcccacacccccaatggtggcggccttgggggcatctgcattggagtatgggggtgccagatgctgtggactgtcactggcatgggactcccctgggacgcatgaacgtgccccaaggtgacttggcgatgaagctgaccgggctctctcatccggataggtcctcaccccaaagactgtgactcctgaacggatggcaggcactcctcacggtgaccggtggcacaggtgcaatcgtggaataccactggtgcctggctgtagcctccatctcctgcacttggcatggcagaccaatctgcaacatgggtgcagaacttggaggccaacactatccgtgatatacccttacaacccacaggatgaagcagtacctgagcaagaccggaccgggaaggtctacctggtagctgcaccaattcaagactactgcagctcctggggcgcacaagacagcatgcggccacagcacggcacaggaccaatggcctcaaagtgcacagatcacacacgaccaacactcaagtccaggcaccgacgcagatccgagcacaccaacgaaacgggaccggatactgcccccacgcatcataggagagagcacaagcggcatggccactaaggcccctggagcacagtgacaaggtggcaacactgaccataggacccagtggccaacacgcgacaggcaccatcaacgacaccggcggcaccagacaccacaacccgaccaccagccacaacaaacagagacaacgtcacacgaggtccaaaaacgaaacgcaagaaccccgacgacaccaccgacctaggacaacagataccaagaaacaaggacaaaagccacggcaccccgggggcaaacaaacaggtacaacccagagaaaccacaccacgtacagggcgcccgacggcacaacccaacagccagaggaaccggaacaacacaacactccaccgggaatacaaccaagaaagacacaacaccaaaccacacgagcaaaaggcacaagagcagacagcaaagcgaacacaaccggaccgcagccaacgccaaagacaaaaagcgacgaaggcaagagggacgggacacgcagaagcaaacagcggaagtcaagagaacggacaaaacaaagagcaacacagcaacaaagaaaaaaggaagaaacgggaagagaagacacgactcagccacgacac

SEQ ID NO: 677980 - DNA, 101 bp, Homo sapiens
tgagctcgtaccttcctctcctcccacctcatttctccactctgatttgtgatttatctaagttatttgtcccagctacttgggaggtgggaggagaggaa

SEQ ID NO: 677981 - DNA, 140 bp, Homo sapiens
gtcagtcggtaccaatacgcactgattttccaggaagaggcagtgtgaagtcataggaaggggcagtgtgaagtctcaggtagaggctgtgatcaggcttcggaaaggaggaagttaggaaagtggagtgggtatggggt

SEQ ID NO: 677982 - DNA, 286 bp, Homo sapiens
cttagaagaggcagtcctgaggctagcaccctttcaacaactcctgttgactccaacagtcctgtggtcacttctactgaaatcagttcatctgctacatccgctgaaggtaccagcatgcctacctcaacttatagtgaaggaagcactccattaagaagtatgcctgtcagcaccaagccgttggccagttctgaggctagcactctttcaacaactcctgttgacaccagcatacctgtcaccacttctactgaaaccagttcatctcctacaactgcaaaag

SEQ ID NO: 677983 - DNA, 184 bp, Homo sapiens
ccggccccttagtcttccttaacttcagaaacaaccaccttttctaaagagatggggctccctctcctcagtgtatccgctaaaccgataccttaggcaataactgcagctgtgttcttcccaatgaagcttttatttcacatttcatatcatttccatttattttttgactagatataaacat

SEQ ID NO: 677984 - DNA, 182 bp, Homo sapiens
ccgagttgactacgcggcttgatatgactacgcggctcatcgttcataatcatccctttgagcgtaatcagagagtgtcatgagggatgatacttctcgatagatgtcatcgtaagcttctcccccaacagggcctctcagctgacggtgagaagcctataggtagccgcgtagtcagatcg

SEQ ID NO: 677985 - DNA, 246 bp, Homo sapiens
  misc_feature (123)..(123): n is a, c, g, or t
  misc_feature (131)..(131): n is a, c, g, or t
tactagtagtacgagcggtgggctttgcgtcgcccagccgagccacatcgctcagacaccatggggaaggtgaaggtcggagtcaacggatttggtcggtattgggcgcctggtcaccagggnctgggctnttctaaggcgtcctggggtaacacgggtgggacttacttgcgtctacgcccaatccaaactgggaaaccccccctttccacttgtgacgccctccaaaccttacccgttgggtac

SEQ ID NO: 677986 - DNA, 385 bp, Homo sapiens
  misc_feature (1)..(1): n is a, c, g, or t
  misc_feature (76)..(76): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (140)..(140): n is a, c, g, or t
nagactcctcttgctcgtcatgtctggccgcggaaaggcgggaagggtcttggcaaaggcggcgctaacacgcgtnaaagtactgcgcgacaatatccagggcatcaccaagncngncatcccgcactttgctcgccgcngcgctggaaagcgattctccggcctcatctacgaggagactcgcggggtgctgaaggtgttcctggagaacgtgatccgggacgccgtgacctatacagagcacgccaagcgcaagacggtcaccgccatggatgtggtctacgcgctcaagccaggggccgcaccctcttacggttttcggtggttgagcgtccttttcttaccaattaaaaggccctttttcagggcaaccccttaaaaaaaa

SEQ ID NO: 677987 - DNA, 306 bp, Homo sapiens
cacaacaactccattctttaaaaaaaagaaaagaaaacagtcgttaaaggtcaggggcacatccctcccactagcatcggttcctaccccacaaagggaaatagagatatccagttaggaacaatttgatgaaaggaatcaggagaccagagctggaataaccatctgcataactacaatctggtatcagagtggagacagaagtaaggatagtgtagagggcacaatagcaagatgagtcttaccatgagacaatgtggggataatactacccaccagatatagatagatcaatgtgccaaagtt

SEQ ID NO: 677988 - DNA, 398 bp, Homo sapiens
caatacagtagaccagtataaagagaatcagaaacactattagggtacatgctagctaaaagcccgtcagactcgtcatccttagtatttgtcaacctggtatccagtaagtaccaagtcctcattttagtccggaaagacttttgaatactatacaagtgcatatatttattatcacctagctcgtaccttaatgtaagtaataagattccaacaataactagcataatatactgcaacagtttaccaattaaaccgtaaaagtctcatttgttatttactaacaagactgtggttaaacacttatcaacaaatctcctggattactggagtgccgaggttaggcctcaaataagcctccaggtatcattttggctgatatgccattcttgcagaga

SEQ ID NO: 677989 - DNA, 131 bp, Homo sapiens
gggtgacttagaggatcccgtgtaaatcgggcttttgccggtccccgaaatgggcaactgtacacattttgtcacacgtcacacggacggaggagaagtcgtcacacgtgccgtcgagccaccggggaaag

SEQ ID NO: 677990 - DNA, 360 bp, Homo sapiens
  misc_feature (17)..(17): n is a, c, g, or t
  misc_feature (22)..(22): n is a, c, g, or t
  misc_feature (34)..(34): n is a, c, g, or t
  misc_feature (53)..(53): n is a, c, g, or t
  misc_feature (67)..(67): n is a, c, g, or t
  misc_feature (80)..(80): n is a, c, g, or t
  misc_feature (97)..(97): n is a, c, g, or t
  misc_feature (103)..(103): n is a, c, g, or t
  misc_feature (150)..(150): n is a, c, g, or t
  misc_feature (161)..(162): n is a, c, g, or t
  misc_feature (171)..(171): n is a, c, g, or t
  misc_feature (206)..(206): n is a, c, g, or t
  misc_feature (222)..(222): n is a, c, g, or t
  misc_feature (226)..(226): n is a, c, g, or t
  misc_feature (239)..(239): n is a, c, g, or t
  misc_feature (270)..(270): n is a, c, g, or t
  misc_feature (284)..(284): n is a, c, g, or t
  misc_feature (287)..(287): n is a, c, g, or t
  misc_feature (310)..(310): n is a, c, g, or t
  misc_feature (335)..(335): n is a, c, g, or t
cgaaactcccgttagancgagnattctactacgnagagtgaaaggaaaacccnaacagatctgtccnagtgattttaccnttgttctagaaggcgcncgttcngggttgtggtattcttaggttagcggagctttttcctcttttccccncccatctcccnnatattgccngttattaattaaccgctttctttggttggaacccnggcagttctgctcccntccnaggatctgcccgngcattgtagctgcttacggagcacttctccnttttccgaaggtcnacnttctagggtgtgggctgagttcntctgtaaagagatgaacgcaatgcngataaaattgaacgagaacgatgat

SEQ ID NO: 677991 - DNA, 118 bp, Homo sapiens
tcaccgcaacctctgcctccctggttcaagtgattctcctgcctcagccttccaagtagctgggatcacaggggcacagagcgagactccagcctggacaatagagggagactgtctc

SEQ ID NO: 677992 - DNA, 783 bp, Homo sapiens
cgtggtggtgtcagttgtggccggttgctggctcagtaacagccaagatgctgcggaatctgctggctcttcgtcaggatgtgggcagaggacgataagcacttgcttcccgcaggccattttaaaaataacgtcccggagaagcaacaaactgtcccagcgaggctgatgcacatcccactgtatctaaaggcgtgggtagctgatgcccctcccttgtataagagccaccatgattcttacagttgcgtgaacagcattatgccatatatgacgctgctgtcgcttcatttccccaagaagccaggatgtgacctttcaagtccatccccagcaatcgcttgtgtccagttcccatcagctctctatggaccagtaatctgataaatacccgagactctttctcgggcgaactcctattctatgcgccttgtaacgtaacctgccaccaataaagccagttctttacccacaaacaacaaacacacacacacaaacaacacattgttttagccgccacctgcacccacccgaaaaaagttcctctctaacaccaccactcgcttggggcagccgagcccaaagtgtcacgccccacacgtgcacacgcgggcgcccagagcgacctgcccaacaacagcgcgggagcccccacaacacaaccccccgggacccgagcgttctgaccacccccagagcccctcgcgcacacgggctcaccacgcccggcgcgataatgccccgaccgctcggccccagcaccaccaccacacacaccccccc

SEQ ID NO: 677993 - DNA, 134 bp, Homo sapiens
cccaggacagggttgacgtaggatagagttgattgagcgactgttgagaatctctgaacagaatacaattcgtcgtctcagcagagcagtgaaatttatctggatataatactgctatgccagatcagaggaat

SEQ ID NO: 677994 - DNA, 816 bp, Homo sapiens
gagcggagttccctggagccgccgtttgcccgtcggtcgcttagctcggctcggtgcgcgtctgtcccgctccagtggcgcgcttcgtgcggctgctggcatctcgccctgtgctctgggcctgtggccccgccgcgagcctgtgcgggtcccgccaagtcgcgcctattcagctggtgctgcaagcaagcagacaggctccggggccgctagctacggccccaacgtgtgtgctgtgcagtaaggttattggcactaataggaagtacgttcatccaatctgcaagcagtggtaccgaaaggacaaagtctgtggcaagatcaagcagtcagtcaggctagcgagtgctgtcctggatatgacagaggtccctggggagagagggctgtacagcaggcctaacactctcgaagctttactgagagcctgcggagtcgttaggatccgaccgacacagctcagtctgtacatcggagcgacgacggagaagctgagggctgagatggacggtggcggcagcgacagccatcttgcgcccctagcaacgaggcctgggcctccttgccagctgtgagatgacctccgtgtgaccggagggactcttatggggaactggcttagtaccgcgaggggtgggcatgatgaatgggaagtcgtgcaatcatttgcctacagagttgcaggaagctcttcatccttaggccacttagaaaaaggctgtggaactcgagctataaatatgtcttaccaggtggcgtctaatagcccagaaaagtagtgggggagaaagacttgggtggactgaggaaggatcg

SEQ ID NO: 677995 - DNA, 1432 bp, Homo sapiens
gggcgtgagcagctgcagcggccagaggcagcatccagacggctggcgccagcaagattccagatccagttgctttacttatattagctatcaccagacatagtcatcatgccgaagtagaaacgtctccagagaatacagagggcaaagatggatccaaagtacctaaacaggagcccacaagacggtctgccagattgtcagcgaaacctgctccacgcaaaacctgaacccaacaccaagaacaacatctgctaatgcaaagcaacctggcagcaaaagcattagccagcaggtgctaacgggcaagaaggcaggcaccaagcaggaagctggcaaaggacaggtactggaaccatctcgaacatggcagacaactacaaggctgacagaggtacattcacagtaacaataccatcccaactgacttgcaatcagctagtcttacaaacgacacatcttctcaatcccttcagagcgaggaagataagcaacgtacctaaacatagctcacataaaaaataggccttcggtcacatagagatatgcagaatccaaacaatctactacagctcaaacttgtaaactggtcatcaaagcttcccaagaaggcaaacccaaacccagggaaaccagtgtccagtacaaagtgggagcacgaattcgaaaaaccacgagagacgacgtcaaaaacagagttaccagaatccgacgaaacttagttcgcacgtgatatctgaaagctgcacccacaaactacataaattcagtaccacaagttcgacatgaataaataaagaagacagcagcgctgtctacaacacacatcgggcacaacactatgccacagataacaggacatacctggaacgatactggagcgtcagagcacaatagaaaatagataacagcacagaatcaaagtgattaccaccaagcacgtgggtgtcgcgaagagacacacataataccgccctgcgccgcagtaggaaactcacacacaccctacccgacaagcgacgacaccaacagccatagatgcgaagcgaccaaccgctacacaaagcataacgagcgacaacacacactagtaatcacaaaacgtggtgataacataaacagacaggccagataaatcaaagctaccactgaaacagcagcggaaagacaagaaggaatatacgacgcacacatacaacgcgacgcagcagaaacaaatgacatcagaccccggagagccacaggatgtatcgcaacaattaggcggaagagcgagcagcggagcagagaaactaccaaacctgcgagcaagtaggtaagagaaccgatacaggccgacaacagaagtgcgaaaaaacgacagctgcaaccaacatcgagagcgagagagccgacagggcaggagcagtccacacacgccccgtacaccggc

SEQ ID NO: 677996 - DNA, 433 bp, Homo sapiens
  misc_feature (346)..(346): n is a, c, g, or t
ggaattaatgtgttttccaaatcatgttgtggccattgctgtggactggcagtatctattcaccatacataatgactggaaggcggctgtggacaccctgttcctcttggcagcacaggaatggaagtgggtcccagtcctgatgattaacactgaaaagggagactgctggtagcttctggaaaaaatttcctcaagcctaagaaagaagcagagcaagagatgctccttttgcttctggacatcgccttgtctgaaaaagaagcttgcagctggggagctctgattgccagctgagggtgaagctgcactgcgatgcagtcagccgcctccgcattgttgtttngttgaatgcagaatttcctttcccacccagccttctaaggtggacgtttggtgaatgcgagccccagaacattgcaaaccgacgcat

SEQ ID NO: 677997 - DNA, 427 bp, Homo sapiens
  misc_feature (17)..(17): n is a, c, g, or t
cagggtcctttcagcanaatcttgctagtgtatgcaatggtgtcagcgtttggaggctaattataggatggatttctggatatggcagtctctagatggtccatccttttgtctcagctccaaactttgtctctgtaactccttccatgggtgattgtttccaattctaagaagggggcaaagtgtcaacactttggtctttgttcttcttcagtttcatgtgttttgcaaattgtatcttatatatcgggtatactaagttcctgggctaatatccacttatcagtgagtgcattccatgtgtattcttttgtgattgggttatcttattgaggatgatttatcacttaccaaaattaaatcaagatcagataagcagtctaaactgacctattatccctagtggaatagaagcagtggtcgacgc

SEQ ID NO: 677998 - DNA, 203 bp, Homo sapiens
cacgtataaattctaggagccaattgatatcatagctcagaccatacctatgtatccaacctggttcttttatttccgtgagtagtacgttacaactatagggagattattccgtaaggcctggtaggatacacgaatataaaacttcagggttgacctgaataatcagtaatacggtgttggtataagtaatgtgggtctcc

SEQ ID NO: 677999 - DNA, 211 bp, Homo sapiens
gtgctctatttttttgttgttgttgtgactgacagagtgagattccgtctcccaggctggggtgcggtggcgccttctcggctcactgcaacctgcggcctcctagattcaggcgattctcctgcttcagccttccgagtggctgggatgacaggcactcaccaatatgcctgggtaatttttgtatttttaagtacatacaggatttcac

SEQ ID NO: 678000 - DNA, 189 bp, Homo sapiens
  misc_feature (8)..(8): n is a, c, g, or t
  misc_feature (17)..(17): n is a, c, g, or t
  misc_feature (45)..(45): n is a, c, g, or t
  misc_feature (53)..(53): n is a, c, g, or t
ttgagatnagcctgggnaacatagtaagaccctgtctgatccagnaccagccncccgcccccagcccccccaaaattagccaggtgtgtggtgcccacctgtagtcccagctactcgtgaggctgaggcaggtgggtcccctgagcccaggaagttaaggctgcagtgagttgtgatcatgcttgggtg

SEQ ID NO: 678001 - DNA, 1022 bp, Homo sapiens
  misc_feature (342)..(342): n is a, c, g, or t
tgggggggaaaacccctttttttgggttgggggggggggggggggggggggggggggggggtctttccccacaaaaaaaaggtgcgcccccgcgcggggttgtcgtccctgctatcccaagagagaggagggggttttcatcaagcagccgcgggcgacacacgagtgggtccccatcagacagggtgggcgccccgcgggcacgaccgcgcagcaccgcggtgctggtgataacgaagaggtaaccgcccgcgcgcgcgaggaaagtaacacggaagaacacgaaggaggggcgcactgtgagaagagaggtcacacgacagacagagccgcacactgagngcggctcctctgagacgaacaaagtgagagggtggtggattgtgagtgcagcgaggagtggcgacacagacagtcataggcccgcacatacgtgcgccagccaatgagaaaacaggcgtcaccatgatccggtgaacagccactcaccgcaagcatcacgtgcgccgcactatcttatcagcaccgacggcacgcaacaccaaagccggtgccaccgccaagccgcgcggggagcacgggagagagagagagggcggaaagtgagtgagacacacacacaagaaaatcacgcccgcctgaaagacagcacctacttggaagtgaccccagaacagcagaagagggatgagtagatgagaacgagggtcccccgcgtggtaagatacaacatgggtgagacctcaccaagaccccaaacactgggagaaaataaaggcgcccgatgttgctacacacatagtagccagacagatgaaagaatcacgaccaaacaaacaaatagaagaggggggtgtcccccagacagataaaaaacgacagcggtgtgggcgcacccaccacaaccgagcacaggagtcaaacaaagcacaacgagaggactcctcgcgaagaagaagaagtcgtgccacttcacaaccgggggtgtaatcgctctcccggagtaaaccacccaggtacat

SEQ ID NO: 678002 - DNA, 996 bp, Homo sapiens
ctgttgttttgtcgcgcgtttgctttgtcgctctgtctcggtttcctcttcgtcccatcttttgcttggttggtcttgtcgtgttgcatcgtgttcttcttgtttttttctgtctgtgtcttgcttctcttcgcctgttttctgccttctgctctgtttttctatcttggcctgctcttttgcctctcgttttctctttttctcctgtattctccattgttcctcttgtttctcttccttttgtcgtgtgtctcgttctgcttcgttttgcttcctcattcttttgctcctactggtttattgtctgtccattgttgtgcgatctcattttccttttctcagttccccttgttttgttcccggcgaggtccttggtctttcttcctgcttcgtgtcctcaccctctgtgtcgtcgtcttacatctggttcctcatgtgtcacttgtgtatgttgtgtaatacgatattgccagtcttggtatggtcctactcgtcattggctcttccttgctagtcacacttcaagtcttgtgatgatgatgcatttctgtccccatgttcatgctggtcatgatgcatgcgtctggctacttgtgccgcgggcacccttgtgttcccgtgctattggtccacactgctcacgctgtccacctgtccacggtggagtgtatgtcggctgtggccctccctcgtggaggtgtccgtgctttaaagaggccttattgtcccgggatgcgcacagtgttctgaagggagcgtgggagctcttgctctcctgcgtcactgcagaatgacagagataggtgatagctccatgcatgtgtgcgcagggtgtatcgtgcgtctcagggtctcatgtttaagtatcagctaaatgatgtgcttcctccgtgatctgtcatacactgagaccatcaggctacaatgtcctgattcttggataagcctggagaagctggggatatgcagttcacaataactccgggagaggagctt

SEQ ID NO: 678003 - DNA, 394 bp, Homo sapiens
ctactggagtgaggaaaaatgaattacaataagtttctgtagacagtaaaaaatgcctcgccgggtgcagtggttcacgcctgtaatcccagcactttgggaggccgaggcgaacggatcacctgaggtcgggagttcaagaccagcctgaccaacatggagaaaccccatctttactaaaaatacaaaattagccaggtttggtggcacatacctgtaatcccagcttctcgggaggccgagtcaggggaattgcttgaaactgggaggcggaggttgcagtgagccaagatggcaccactgcactccaacctgggcaacagagcgagactctgtctcaaaataaataataaataaataaatattaggaaaataaaaatggtactgatagttc

SEQ ID NO: 678004 - DNA, 833 bp, Homo sapiens
gtggccaatcatcctgttggagacagcgctatgccactgaggaggccatgtctggcgggtatcagcgccatcaccaccggcatcgatgctggtcgccaatgaacggccattatgctgcaagcatagtcgacttactgtggccttactgtgacacttcgtgcaatgtacgggctcggatactagcataaggccaccgtatacatgagcgtatatggagacataggcgatcatgcagagttccccagtccgtacctagttgaaacctttgcttgaatgaatggtgtactagtagaccagactcagagtcctgagacgtacatcctcccaaaaatgagggacaggtcaaaggggccagatgatgagacagtcggaaggtcctcgtaccagaatccttgttgttcgacgtttgactatacagcaaggggtgggaacgaacatcctaagtgattactacaacaatgagcatcaaagtccagaaaggcgggacccctacactccccactaaacacgttattagctagggatccatttcgcataccggacagttttcctattagtaagacggtggacgatgccttcgattcagtgacgaacccctctacgagggaagttcgagatcacgggctgcctttggattagggcataagaatggggacgaatcgctgcagcgctttgacagttgtaacaccccagataggcccacccgagggaggagttccccatagccgagttagggagcggtatcgaagtacgagtaccacaagaaatcacttggtcgacgggatagtatggagacttgtgagcatataaatcaccggaagactcaaaggggg

SEQ ID NO: 678005 - DNA, 109 bp, Homo sapiens
  misc_feature (28)..(28): n is a, c, g, or t
  misc_feature (53)..(53): n is a, c, g, or t
agtcccgccgtggccacccatcaccctnacaccgacgtgttggccacccctgnccttgacaccgacgtgtcctgtacatagattaggacattcctaataaagtatagct

SEQ ID NO: 678006 - DNA, 340 bp, Homo sapiens
  misc_feature (280)..(280): n is a, c, g, or t
ttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaactttccaaaatcaaatgtaaaattctaacttaaatgnttttccgacctcaaagctaactttttgggcattaaagcccttggaagtccaataggggcc

SEQ ID NO: 678007 - DNA, 459 bp, Homo sapiens
  misc_feature (3)..(4): n is a, c, g, or t
  misc_feature (53)..(53): n is a, c, g, or t
  misc_feature (386)..(386): n is a, c, g, or t
  misc_feature (403)..(403): n is a, c, g, or t
  misc_feature (419)..(419): n is a, c, g, or t
ttnngggtgggggttgggtaagggaatggtcaagactgagaaaggaatgaaanccattcaggaaatatcgacagggctacacgtgatgtccccaaactgctgctattgaagaacttcccaaaacttctttacaaagccctaaaggaaagtttgcatctatgaaaagccaataggtgagacatccaattgctgcatggaaattgatgtacattcaggggacggcaaaaatagctgtaaaatagtgaaaaagagcagtggttgtgctcttttctggccaatgatttacaaaaggaatctacttggacttctgtcccgggggtggaaatccttaggggttgggaacttgtgggggaacatttcccaacttggctaaggcaggggttccnctgggggaggggaaggntctattctgggggaanttcacccccccggcggcaccacacttttccccccggggtt

SEQ ID NO: 678008 - DNA, 972 bp, Homo sapiens
ttgcgcggaactcccaggggttgcgcgcccccccgtgtccggtttggtcgtgcccatggggcgcctctatttccttggggtggtatcctcccccccatgtggtattctgccggtcctgatttcatccccgtgcctgttaccagagacaggttccggcccacaggctggtttgtccaggagtgcctgcctgccaggtactgtaatagttcgcgctccgtctttcaaatccccagggtccatgtccaccgctcgcggtgtgctccccacgcaacatggtgtctcacctgtgcgtatttgggggggtccacacgggggaacacactccgctaccggccgcactcctgttggtcccacgccacggctctccgaaggagtgagcggcgacttcactttacggggagccccttgtcttgggccaccgtcgatcttggatttcctcgttactgtccagaacactttgttcccccacgcactatcttcggggcactactcctcgattaattgccgccccccaactttgggcaactaccgcgtggagccccccactccgtgtggctgcgaggtatccttctctgctagcaacacaccctcggcgataagtcacgctcaccctccatgagaccgcactcacctccacgtagtgtccccccacgccgttctggcggaggtttgtcctataatcggcgcctctcctaccacacgacctcgggcaaccgcgagcgagtactacatgttccaaagcgaggactcacgatgtcacttcccggatgtagcattttcctatccacgcgcgtgtgcttattataattcctctatcgcgcattctgccacaggcgggtctcttatcgcacacaagtcacgtctttatgccaaccctctcacgacacacaagcccacgcgctaacacaagacaaggcttttccctcagatggggggggaccactaaaaatccccctggcgaaccacataaca

SEQ ID NO: 678009 - DNA, 424 bp, Homo sapiens
  misc_feature (3)..(3): n is a, c, g, or t
  misc_feature (6)..(6): n is a, c, g, or t
  misc_feature (13)..(13): n is a, c, g, or t
  misc_feature (65)..(65): n is a, c, g, or t
  misc_feature (108)..(109): n is a, c, g, or t
  misc_feature (115)..(115): n is a, c, g, or t
  misc_feature (265)..(265): n is a, c, g, or t
  misc_feature (274)..(274): n is a, c, g, or t
  misc_feature (287)..(287): n is a, c, g, or t
  misc_feature (418)..(418): n is a, c, g, or t
ctntgncttagtnatgaagacaagacagattagagggttgacttcactcctctccagcctctggnaggggtggggctgaaggttaagttgatcaccagtggacagtgnnttaatnaattatacctactaatgaagcctccattaaaaacccaggaggacagggtttggagagcttctggatggccaaggcgggtggatcacctgaggtcaggagttcgagaccagagaccagcctggccagcatgttgaaaccccgtctctactnaaaaatacnaaaattagctggncgtggtggtgcatgcctgtaatcccagctactcaggaggctgaggtgggagaaacatttgaacctgggaggtggaggttgcagtgagccgaaattgtgccagtgcactgcagcctgtatgatacagtgagnctcctc

SEQ ID NO: 678010 - DNA, 408 bp, Homo sapiens
gaggccaggtcaggggagggggatacgccccccaatgggtactcccggggagggtgtccgagcggggccgcgagggcaggccctagcctcccccagcccccttttgtggagcaaagcaggttcggagaaaccccaagttttcgcctggggagtcccccccagggggctggggttgcccgtcccaaaaagtttccaccggggggggggttaaagggaaaagggcccccccctggtcctcgggttcaggctggcccccccccctccttggggctttggccctttttccccggggggcccccccctattgggggcccccgggtcatttttccccccccccccccccccccccctggggttttattttggtaaggggggggggggatgaataaataaaggggttttttgcca

SEQ ID NO: 678011 - DNA, 339 bp, Homo sapiens
  misc_feature (62)..(62): n is a, c, g, or t
  misc_feature (70)..(70): n is a, c, g, or t
  misc_feature (104)..(104): n is a, c, g, or t
  misc_feature (108)..(108): n is a, c, g, or t
  misc_feature (124)..(124): n is a, c, g, or t
  misc_feature (149)..(149): n is a, c, g, or t
  misc_feature (153)..(153): n is a, c, g, or t
  misc_feature (167)..(167): n is a, c, g, or t
  misc_feature (176)..(176): n is a, c, g, or t
  misc_feature (191)..(191): n is a, c, g, or t
  misc_feature (200)..(200): n is a, c, g, or t
  misc_feature (204)..(204): n is a, c, g, or t
  misc_feature (212)..(212): n is a, c, g, or t
  misc_feature (217)..(218): n is a, c, g, or t
  misc_feature (257)..(257): n is a, c, g, or t
  misc_feature (265)..(265): n is a, c, g, or t
  misc_feature (269)..(270): n is a, c, g, or t
  misc_feature (278)..(278): n is a, c, g, or t
  misc_feature (326)..(326): n is a, c, g, or t
tctgtccatcacctagaaatccataatgacatctgaagaggattgattttttctttgccacntttaagtngtgtgattaaacaatttaaaatcccatgtatccntggncctttcctccacgttnccccttagaattcctgcagctgcantagntaggaggcagcagnagaacccgngctgtggaatgctcntctgcctcnctgntaaaccgnctttnnaagccataggtcatagtgtattggaggccttcctttcanccacttgnccannccaaaatnaaacatctgtctcaattcttacccaggcaccttgctgttgtggtgagnggtgagaaagaag

SEQ ID NO: 678012 - DNA, 156 bp, Homo sapiens
gggattacaggtgctcaccaccacacccagcttatttatttatttacttatttattttttgagatggagtctcgctctgtcgcccaggctggagtgcaatggcatggtcttggctcactatgctctggccagggcgacaaagcaagactgtctcca

SEQ ID NO: 678013 - DNA, 279 bp, Homo sapiens
  misc_feature (112)..(112): n is a, c, g, or t
ggggggggggggggttgtttttttttaaaaatacccccccccccttctttttgtgggaggggcgccccctggtgttttacccccccccccctttttggggggtttttttttntattaaccccccccccggtctccccccacatttttttttttttttttttgggcccccccccccccccccccccccccccttttttggtgtgggggggtttggggggggcccccccccttttttctgggggaaagggggggggggggaaaatttttttttttggggga

SEQ ID NO: 678014 - DNA, 441 bp, Homo sapiens
cggattagcacaatggatctagaggcttggacgagagagacatgtacatatgtggatggcgccgctatggagtaagctgacgcatgattggtgagtacctgacatcggttaagagcagagggatatgcctgtggtcccgaatttttggatgcatgaggagtgcagactcgtgcccaagactcatacgctactgtgaggagagatagcgcgactgaattctggcttgcagagtagaatgagatgccatgtctgaataccatgatgagatactactagctgatgtgggacattacgactagcttgaggagagacattatgagaagtggccagagcatgacaacagcatctgcaggatatgggcagagagagaggatatcatcatgtcccgagagttcgttacggatggaatagtgagataatgcactaggacttagttgctgt

SEQ ID NO: 678015 - DNA, 200 bp, Homo sapiens
  misc_feature (5)..(5): n is a, c, g, or t
atccnccaatatataaatatattgatatataaaatattgtatagagataactctaactatacctgtagaataattaaataatagatataatatataaatcaagagagaaataataataagagtattaaaataataataataagttaaataaatagaggtaatgagataagtagagtataattggcaaagtatgggcaaag

SEQ ID NO: 678016 - DNA, 811 bp, Homo sapiens
ttggagaatcgtggaaaaagctagttatatttcagagaaatgattttcattatggaaactgttctccctagcaggccattttccctttttcctgggagttagcaagtttaggagagaatagtcatgacaagaaagggacgaaaggggagacgggaagaggttaaaaagtaagtgctcagacctatgaagtaatcccttggctagaaatatttaagagcagctcagctgggtggaaactgagttggtcatcttccatatttgcaggaaggtatttctgactgtgcaatgcggctagatgtaaaattttattttatacatcctagaaagcctttgactagaacactgaataacatatggagggtttcctgtccatatctggcctggatggtgccagaaagcagagaatagacaatgtaatctccaacatccaagcatcgaaacccaaggggtaggcaattctatgtaggtttgacatgaagtgtggggcatcttgttaatgctggctcaatgttattaaaactctctggttatagtctctacattctattagacaagcagtatcgaacactgtgcttcgcacacaaggtctttagttaccaatttagcagctactgtttgtgttaaacacacttttccaccaaataggttctggaggcaaacggagagcaatgactattaaagaaggtttcccagatcattaaattccaaaattaaaagatcatcttcaatgagaaagatccggttgaatggaattaagggaaggcaggccggacacagggacaccattgggttttccacccgggaaaccttc

SEQ ID NO: 678017 - DNA, 118 bp, Homo sapiens
tagagtatccccgcacactgtcttcccgtagagccccgtcctcctctgcggggctctccggacccccttccccctcacctccatggcagggacatgaataatattttgtattgatttt

SEQ ID NO: 678018 - DNA, 773 bp, Homo sapiens
tactgggctgcttggagtaatatttcccgatttggtgccaggtgcacagtcccaggtgtcaggaaagctagcgagtgctgggcgccgggcggtaaaaagcggtggcctctcacgggttattgggtgtctgctgtgtggatgcagaaggtctgcttgctgcagccgcctagttatacagggtgtgggggtggagatgtgtggggatggggggcgacgtggatgcggagtggtggaagacgtggctggttgatgtgggctctggtggcctagcgcctccgaagggcctgaggcgcttggtggttaccccgcctcaagtgtcagggactggtggcgcccaagctgcttggcttgtgctgggactgacccgcctggtgctgctctcctcagaggggcgtcccagagccaaggccaacaggcgagtcaatgcatgctggacggcctggggagtgtccccgaagtagctcgtagcgagactcacatacacctgtgggccatgaacgaggagggtaggactccccgaaaaaagacgctggcccaccaatagacccgggatcacgccttgagggaacacctgcgggggatggggaagtgtgcttcccctggggcacctcggtaccttgctgcacggacctgtttgctggtaattgtaaccccttgcggcgccggtagatatccgtgggttggccccgaagcaaccggtgagggggattgccgcatgctttactgcctgcctgtgcgctcgggcgggaccctcgcggccgtgcccacccggg

SEQ ID NO: 678019 - DNA, 320 bp, Homo sapiens
gggaaaatggggaattttttttttttggggccccagtttccctttttccggaaaaaaaggcctcttggaaaggaggtggtatggtttcccccccaggaaaatttttttccccgggcccggcccttttaaaatgggttaaaccggcccggccttgtggccccccccctttttccccccccctttgggggcccaggtgggtggttccccccaggtcccgggttccaaccccccccggccccccttttttaacccccccttttcttaaaaaaccaaaatttcccccgtttgggggccgcccccccccccccccccccttttta

SEQ ID NO: 678020 - DNA, 561 bp, Homo sapiens
acgggataccagtacccaaatttttctatgtaagctaaaatttttttctgttaattagcccaaataaacctaaattcccagccctgtcctgtagcttttgttgtctcccccttaaagatcatctaggttaacctttggaaaggtgttaagtgacataacagtcccttgctttttaccttggtatgagcagccctcctcctgtttcagaccctgaaattaaaagtgaaaccttcattccccatcttttgttctatatgaaatggagatagaaattatatctggctgggtgcggtggctcacccctgtaatctcacccctttgggaggcccaggcaggtggatcccaaggtcaggagttcaaaaccagcctggccaaaatggttaaaccccctctctattaaaaatccaaaaattagctgggggtggtggcaaacccctgtaatcccagcaacccaggaggctgaggcaggaaaatccctttaacccaggcaccaggggttccagttaacttaaaccgcgcccctgcactccagcctgggcgataaagtaaaattctgtcccc

SEQ ID NO: 678021 - DNA, 174 bp, Homo sapiens
  misc_feature (19)..(19): n is a, c, g, or t
  misc_feature (22)..(22): n is a, c, g, or t
  misc_feature (127)..(127): n is a, c, g, or t
  misc_feature (152)..(152): n is a, c, g, or t
ggcacgagcgcactagcgngcngtcgagccgtggacggaggtggatgaggagggcaagtttgtccggctgcgaacaagtccaatgaggaccagtccatgggcaattggcagatcaagcgccagaatngagatgatcccttgctgacttaccngttcccaccaaagttcaccctg

SEQ ID NO: 678022 - DNA, 790 bp, Homo sapiens
ttgctgccgcatggagcggctggagtcatggctcgggtgcctgtggcagctccgagactccccgaggccccagcgctgcctgttctgccctgccccccggccatgtcgctgcccctggagccctggttgggccccgtgacctgctgtgcctgtgccatgtgcctccccctgcctcctgggccctgagtgccctggggctgcaaggctgtccttctggtgcctcatgcctttgctcccaccttctgcagatgtgcttctgcccttgtgatggagtgctgtcccgtgctgtgcttgctggccaatggaacattgcacatgtgctcgtggacatgtggccttggcctgctcatgccttagatgccttgcctgcccgtccctgtgtgcccccctccttcggcccagaccctgatgaacctgtgtggactgttgcccatgtgtgacatgccaccactgccttgtgcctaggtgcctgatgtgtcataggatgcaacctgtggtcatggccaagtgccacacaccaacttgggtgatgctgtgtaccatgaagatagacagggcttgcttgaggttcccttgaccccacatacccgtctaccacaaccacatcgccacccgtcctagctggcagcggacttgtgcccccatgatgtcagggcaggagtgtgagccaaaggtattctcagtgccaggtgcgggtggaccttcctcccctcctgggggcctcagatctctgttgttatgggcgtgggggctccgaggtcgagggctggaggtgtggtgcaggaccgta

SEQ ID NO: 678023 - DNA, 563 bp, Homo sapiens
  misc_feature (207)..(207): n is a, c, g, or t
gggtgacttgctgtgtagtgagctcagttatacttgggtaagcggggcaccgcatgtggggtgaacccctgcatgtatttggttgaaaagtcctgggcaagctgtagaagtgaagaacttccccgtggcgccttcctggccccaatttgggggccccggaacctgaaaaaaaaagcttcgagagaaggcacacacggggcgagctcnccaagagcacgtggacgaaggacaaaaccaaaaagtgcaaattccgcatttaatctacaaacattttttgtgccaaaaagggggtttgaggcgtgggggggggacccaatgggtggcaaatctggggggttttcctattatggatatgggggggcttggggcccaacaagggggtgtctttctacaaacgaaagcacacatttcttcatcaaccacggggaagaggggggcgcgaattttaacagaaaccaccacaaagcggtttattacaaggatttataacaagaaacatttataaacaaatttgggagaaacacaagaggccccccttttaaaaattttcatgagggtttcag

SEQ ID NO: 678024 - DNA, 314 bp, Homo sapiens
tgcaccgaatgaagagaagaaggaaggcacaaacaaaaggctacttactgccaaagagaagtttcaaaattcatttatatagtgaacatttattgagcacttataatgtgctaaacacactgagatacaaagattggttaagtctttcttttctttctttctttcttcctttcttctttcttttccttccttccttctttccttccttctttctctttctttcttccttccttctttctctttctttcgaaagaaagagaaagaaggaaggaaggaaagaaagaaagggcgagaaagaaagagaaagaaggaag

SEQ ID NO: 678025 - DNA, 246 bp, Homo sapiens
gctgtcctcgctgcttccttttgctcgactctgaggatcccctgcacggcttctgcgacacctggagctgagctacgaccccgatgagccgccctcgctgaagctgctggacatcgacacgcgcctgggcacgcagctcgctggcggaattgcgcgcccacccgagcgcctggcgggaagtgccgctcaatgtgaggcggccgacctgctggccgaggagctcacccaggttcgcagacaatctga

SEQ ID NO: 678026 - DNA, 618 bp, Homo sapiens
cggcaaaataaaaactttttgaaaaagaaagtagaaacaaaaaaaaccaaaaaaaaaaaaacaacacaagaaaaaaaaaaaaaccaaaacaacaaccagattgtctgggccccttgcccccaaggttttagccctgttccatgctttgtttggggcccatattatgggccccttgggaaaacggcctttttgggggggttgttcccattcaccggggggccttttccgcacgtgtcgtgtggaaaaacccgtgggttcccccaattactgccgtgggagataagccccttttgcccgggggggatctacgggaggggcccccccccggggcctttttcaaaaaggtcgcccccctctttggggctgggcaaatgtgcgggccaattttttggtaaaaacccgcgcaaaattttttttaacaggcctgttttttccacccaagggccggttccggggacccttctttttataaaaagttttcccccctatgggggtgggtgttttcactgttgccacggggcgccctttttaagccggggttttccgctttagggcgagcccttttttggggggggggcccccttgggcgcccccccctctagtttttggggggggggc

SEQ ID NO: 678027 - DNA, 850 bp, Homo sapiens
  misc_feature (27)..(27): n is a, c, g, or t
tatgcgaacttttccggaggcggcggnctcggctgccgctgggtcccggggtcgcgggccctgattgcgccgtttccccgcgcagagctcgccggcgccccgacgggccccggagcagcggccccggccggaccctagtgcctctaactggagggggcagcccagccaggagggaagagaacgaagagaaaggccgccaggctcaagtttgacttccaggcgcagtcccccaaggagctgactctgcagaagggtgacattgtctacatccacaaggaggtggacaagaactggctggagggagagcaccacgagacggcttgggcattctttccgtggctaattattggtcgaaggttgcttgaccgcaagattgaaatcccgtaggcacaatcaaaggccccccagactaccaggtgctggagtatggaagaggctgtggcccagatacaaccgttcaaggtgggacctggacggtggagctggtccttccgcaagggaagagcacatctggcctgatccgcaaggtgaacgagaactggtacgagggacgcatcactgggcacaggggcggccaaggcgcattattcccctgcctagctacgttgcaagggtgtactccgtgaagccccggctccggcatctgtgaccaacggcaccacagatcccccaaaagaatgctcccaccagacttaaccagagagccacgcgccgggccacaaacacaggaaaaccacacacagcaaaacccaaatccacacgagcgagacgggaaggaccagagcggtaaaacagacaccagaaactagagagcgaggccaaacagaagcgcccgacagaagagaaagac

SEQ ID NO: 678028 - DNA, 493 bp, Homo sapiens
  misc_feature (52)..(52): n is a, c, g, or t
  misc_feature (92)..(92): n is a, c, g, or t
  misc_feature (217)..(217): n is a, c, g, or t
  misc_feature (347)..(347): n is a, c, g, or t
  misc_feature (392)..(392): n is a, c, g, or t
  misc_feature (437)..(437): n is a, c, g, or t
acagcgagcggaagttccggacggggtcgggagccggggagaagccgtacgnagttcgccgactgcgccaaaggcttcgggctgttctcgcnacctcgtggagcaccggcgcgtgcacaccggcgagaagccctacgcgtgccccgagtgcggcaaggccttcaaccagcgctcgaacctgagccggcaccagcagcactcacagcagcgccaagcnctacgcgtgcccactgtgcgaaaaggccttcaaggccgctcgggcctggtgcaacaccagcgcgcgcacaccggcgagcggccctatggctgctccgagtgcggaaagaccttccgcggctgctcctgantgcgccagcacgagcgcctgcactcgggcgagaagccctacaatnctcgcgactgcggcaaggccttcgtgcgcaactgcagccctgatngccaacctgcgcacgcacacgggcgagcggccctacgcgtgcggagattcggtcgc

SEQ ID NO: 678029 - DNA, 412 bp, Homo sapiens
ctcggcctatcggaaccaatgagcctagtccaggcctggggagaatgtgacctaaacacagccctgaagaccagaactggaagtctgaatgcgagccctgctacaatggcggatgccagaagtactgtcaccatctccgagccctgttggcaaactgaccaagcccaaacctcaagcagaatctaagaagaagaaaaaggaaggcaagaaacaggagaagatgctggattaaaagatgtcacctgtggaacataaaaagggcatcagcaaacgggatcagttaactatggcatttatatgtaccgtaggctttgtattcaaaaattatctatagcttagtacacaataagcaaaaacaaaaagaaaagaaaatttttgtagtagcgttttttaaatgtatactatagtacca

SEQ ID NO: 678030 - DNA, 113 bp, Homo sapiens
tccgccatcattccgagcactttagtgggagacctcgagaagatcgggtgccccactcttggaattccattacccttagcaacctcactctaggcacagagtatgtgggcagg

SEQ ID NO: 678031 - DNA, 946 bp, Homo sapiens
tgactcaggttattctcacatatcctgacttcatccgatcctctcaagtatttacatcctataatatcgcaaagcactcattctttatgctgttcgtaccctcgttcgatctagatcattgggcatctggttaggatggtagtgtagcttgattctgtgtatgtctcccatcgtgataagattgagagacgtgaaggttatcgtctctgtgcggagtggccattaatgacacgctcttcgatgctgtgtgccgtctctctctccatctgtctctaaaaatctctaaggatgtccttagccaacatttacttggagtccaagggctcctccgtgtgtcaagtgactgccatcggtgtcaccgtgatactgctttacacctctcgggcctgcgtacaaacctgttcatcctgtcattttctcagaacaagagcgtccattacctttgattatgactggtacaatgtatcagaccaggcagatttgaagactcagccttggggagatgctggatacgtataattttggagtggtgtatatgtagcgaactcttacctaccacttaagtcgtttatttcttctagttagaaatcctacaaaggaacttacaaccctggaatggtccccagcatggtttcagtcccagatcttatttcctttgacaacctccggggatatgacagtgattgatgacccttgcctgggaacatttgccccttcagggacttcagggacggttgctccagaataactatgattggggcacacaactacacgttctgggcagcacgaccttggagaatcacttgaatcttgaaaacacgctgggtaccacagtacacggtatgtaagcccaataaagtcagaagtacgccggcattggcatctaaaaagtgattggtcagccgataaagcggactttaagcgccggaaaaaagacatcgcgacc

SEQ ID NO: 678032 - DNA, 320 bp, Homo sapiens
atgatgtgaatatagttaacatgcctgaaatatacacttttttttttggaaacaggtctcaatctgtcacccaagcttgcacgcaatggcacaattatggctcactgcagcctcacaatcccaggctcaactattcctgcccctcagtctctcaagtagctgggaccacaggtgtacaccaccatggctggctatttcttagaaaaaaaatgtttgtagagagggtgtctccatatttggcccaggcttgtaacaaacttttgggctcaagcaatcctcctgtcctggcctctcaaaatcctggttttaaagatatgagc

SEQ ID NO: 678033 - DNA, 907 bp, Homo sapiens
attaatccccttggccaacccgtcatctactctaccatcttgtgcggcacactcgtcacagcgctaagctcgaatgatttttacctgagtaggcctagaaatacacatgctagctttattccagttctaaccaaaaaaataaacctcgttcacagaagctgccatcaagtatttcctcacgcaagcaaaccgatccataatccttctaatagctatcctcttcaacaatatactctccggaccaatgaaccataaccaatactaccaatcaatactcatcattatacatcatacatggtctatagcaataacacttaggactagcccctttcacttctgagtcccagaggtaaccaaggacacccctctgacatcggcctgctttcttctcacatgacaaaaaactagccccccatctcaatcatataccaaatctctccctcactaaaaggtaagccttctcctcactctctcaatcttatccatacatagcaggcagtgaggtggattaaaccaaaccagtacgcaaaatcttagcatatcctcaattacccacctaggatgatcatagccgtctaaccggacaaccctaacataccattcttcatttaatattatattatcttaataataccgatctactaatcagttaatccagcacagacctataatatttgacctgaacagtacatggtaaacccttattccatcaccctctttccttagggctgcccgtaccggtttgccatggcatatgagattccaaaaaatgcttattccacatttaggcatgacctttactatttctaggtagtcacactcgaaaagccatacaggaaaggggataaacctttccactgccgcgctattcttattaaaaaaaggcggctatctgcgagagagttcg

SEQ ID NO: 678034 - DNA, 614 bp, Homo sapiens
  misc_feature (18)..(18): n is a, c, g, or t
aacttctgaccctcaggntgatccatctgcctcggcctcccaaaatgctgggattacaggcctatgccgctgcacctggccccccactgtctaattctttgttgcagctgccaagtcactctcagagccggttttcctaatatgcagttagcattctaagagttaacagattgtgttttattttcccaagatcttttttaaaaattttcttaattataggtctaagaaaagcttattttagaaaaattctaaaagatgagaagaaaatcagcatctcctgttatctttgtaacccaaatagctttgcattttacatagctggagtgatagtgatcagaatggtttttttagaaactttctgtattgtgaaattttattacagaaatgataagtgtaacacttcagtgatctacttatggaaaaggtcatctctcccatacttttgatgcctaccttcagagaaaccttcattagcaatctggcatatgtcctgcctcagactcatgaaaatatgaacaaagagagaggggtttctctgtttttttgttttgttttgttttttgttttcttaaaatgcgatcattttatacacattacccttctgtcgtcttctc

SEQ ID NO: 678035 - DNA, 543 bp, Homo sapiens
tgacctttgatacctcttactcgggccgtcgattaccatacagtgtgcataccaatgtattactttattatgtacttgattggacatgatctaggatatgaactcctaaaacttgcaagtgatacatgatctctaagaacatgtgtgaaatattttctatcacttagtttggctcttttggtaaaggtgttatcggtttcttcctaactcatctggtgttctcttaaattactagcattttcattatattataacatttttaattgtattatatgtagtcatatcatctctcagaacacaatctcaaagtatcatgctgagttaggtttgggaagagagcagtaagaatggtttatttatagtagccatcgtaatgctaaccattcatctgaaattagacaaggctcccaacaggcagacgaggtagacacatgtatgcttgaggagttaagctgcgatacatagggttaccatccaatcgaatgtcctctagtgccttacgaatatccgtcaaatttttaacattgcagaacgtatcttcgt

SEQ ID NO: 678036 - DNA, 155 bp, Homo sapiens
acgtcgttgttcggcggttcaccgatgtcgtgcgttgctggacgcctcgtcgactggttaacccgtctacgatcctgttatgatcgctgaccaccgcgtcctctgtcgatgtagttaacctgtgtagatatcgccatgctcatccgttgttcgtt

SEQ ID NO: 678037 - DNA, 453 bp, Homo sapiens
gccatgcagctacatctacctgcctttggactctggaggacagggcattgtcctcagtcagatacaacagtatttgggtccatggtacctgcacacctaaaacacttggccacgcatctgatctgtagtcactgtactatgcctagtggaaggagcaagattcatagacattattgtatggatgtttaattctagcttgttgagaggggaagtggtgggtgagacttagccccaccttgaggacatacaactgggaaatactgatacttgttgcctatttggtatgttgtagtgccccactagatcttacagaagtagtgtgccctccatagacatgtgtagcatctaaacacaaaggcccacacttcctgtctgttgcctgcttggtcactgttttctattgaccccaacccttgatgatatgtatttatcattttgttattttaccagttt

SEQ ID NO: 678038 - DNA, 121 bp, Homo sapiens
ctggccgtcgttttacacgggccgtcgtgtaacacgggccgtcgttaacacgggccgtcgtattacactggccgacgttttaacgggacgtcgtataaactggacgtcgtaaacactggcc

SEQ ID NO: 678039 - DNA, 147 bp, Homo sapiens
  misc_feature (38)..(38): n is a, c, g, or t
  misc_feature (130)..(130): n is a, c, g, or t
tgcagattaaagtcacacttcatagaaagatgcgctgngtatatggacaatcacttcacatgtaaggcggcctctcctctggctccatgtttgtgacagctgactggtacaggaggatgcatgaggaggntggctggcaggcctggg

SEQ ID NO: 678040 - DNA, 333 bp, Homo sapiens
  misc_feature (186)..(186): n is a, c, g, or t
  misc_feature (253)..(253): n is a, c, g, or t
  misc_feature (285)..(285): n is a, c, g, or t
  misc_feature (316)..(316): n is a, c, g, or t
  misc_feature (330)..(330): n is a, c, g, or t
ctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagnctctgagagggtttttacagggccgtgttagagccttcacccatgggaacagtacaaggacatgatngtaattccgaggaataccgacagctccagggnacagcagttccctaattacccaggccttttncccccaaaccattnggg

SEQ ID NO: 678041 - DNA, 232 bp, Homo sapiens
  misc_feature (12)..(12): n is a, c, g, or t
  misc_feature (16)..(16): n is a, c, g, or t
  misc_feature (20)..(20): n is a, c, g, or t
  misc_feature (29)..(29): n is a, c, g, or t
  misc_feature (32)..(32): n is a, c, g, or t
  misc_feature (43)..(43): n is a, c, g, or t
  misc_feature (48)..(48): n is a, c, g, or t
  misc_feature (63)..(64): n is a, c, g, or t
  misc_feature (75)..(75): n is a, c, g, or t
  misc_feature (86)..(86): n is a, c, g, or t
  misc_feature (106)..(106): n is a, c, g, or t
  misc_feature (110)..(110): n is a, c, g, or t
  misc_feature (112)..(112): n is a, c, g, or t
  misc_feature (118)..(118): n is a, c, g, or t
  misc_feature (126)..(126): n is a, c, g, or t
  misc_feature (131)..(131): n is a, c, g, or t
  misc_feature (153)..(153): n is a, c, g, or t
  misc_feature (156)..(156): n is a, c, g, or t
  misc_feature (162)..(162): n is a, c, g, or t
  misc_feature (167)..(167): n is a, c, g, or t
  misc_feature (176)..(176): n is a, c, g, or t
  misc_feature (185)..(185): n is a, c, g, or t
  misc_feature (200)..(200): n is a, c, g, or t
  misc_feature (211)..(211): n is a, c, g, or t
tttcggtacttntttngtcncgtctttantgntgtttgagttngtttnccggctttccctatnngatgggtttcntcttgtttgcnccgcgctgcctcgtatcatngggncnttctgntacctttnttccntgcccgctacggaacgcccggncgnttaggncccanaggcccggnagcaccccnaagttgattttgtcngggttctgcancgggccgggggtctgctccgc

SEQ ID NO: 678042 - DNA, 414 bp, Homo sapiens
gctttggagctgccacccgcttcagatgcttcttgggaggaggagttatggctgcgttaggcaaggaacaagcctggaggagtgaggatgggtgctgtgaaggaggttgtgcagctgggcccgcagtcggacctggtgagatcagaggagggggtgccaccagtctgtggacgaagatgagaagctggaatagagcagaaaacaggaggctgccactctccatctttcccaaagtcactccaggagcaagggtgtcatttactgaaatgacagactctccatttcacatttttcccccaagtgcagagtgcagggaagcagatgggctaaatttttagagtcagggttattaatgtatactttacatagtaaactttccccttttaactgttcccctggctttaacaccatgga

SEQ ID NO: 678043 - DNA, 248 bp, Homo sapiens
gggacaaacctggggaattcaatttctcgcccgagcctgtggtgtctgaggggcattcagcgagcgatctccagggggcaggtctggaatgaaagaaggagctgaggccgggcatggtggcgcacacctgtaatcccagcactttgggaggccgaggctggcggatcacatgaagtcaggagttcgagaccaacctggccaacatggtgaaacccccgtctctactaaaaatacaacaattagccggg

SEQ ID NO: 678044 - DNA, 88 bp, Homo sapiens
gggggggcccccccggggggaattttggaaaaaggtccccaattttggggggggttttctttttattggggttttttccgggggggga

SEQ ID NO: 678045 - DNA, 1416 bp, Homo sapiens
  misc_feature (712)..(712): n is a, c, g, or t
agcgggtgcttgtggtgctgggcagctagaccgtcgcagaccgacacgcgtgtgtgatcctcgtcggtgtccggcacagagactaccagtgacagatgctatgactgatggctgatgtgaagtcgcattatggcctatcgcccttgccgatgcgcaactcgtccccaacgtagaggcatactggacctcgatccatgcagttcatgtagacatagtaatgcagtcgttcggaaaggagccgacactgaggtccagctcacaatatccttcacatctagggggtcgatctcctgcatgtttcaatcaggtggactgtgcatgtcaagaagctgactcgtaggaccgatctttgggagattcagtttgctttgctaactcttggctcggcctgtcttgtggtttgaaaagtatcgaaagaatactgattgaccccttaacgatgattttagttgccgactgcccaaagccaagtgacgcacctcgcgtggggatgcacgccacgtagattgagagagctacatacactaggagtcgcgtggtgcgaattcggcccttggatttgcttcgttgctaaccccgatctaagagaagtaaacggagccttcgggccaaagcctcgtagagaacaaggcctacgcaatcccagcattccccagtttcccatgccaagtttcgaaatgtcgaaaagggcctcctgatgtatcgtcttcanagagcccgttgttggcggccgtcccttgctcgacctgggttgcccttccgcctctaggcgccgagggcgctcttcccgcgcgctctcttgaaagtgcttttggtggttatcttccacctcatttttaatatctcttgggtaggtttgattttgccaactttgtcaccggtatatttctcctcctatcggcgcttaacttgtctgtctctaattctgtggtgttatttcaaacacggacctttcttcagtcataaactatatagaatgtacattcccttcggtaagggaaagaaacacacggcctacatggaacagcatagagaacaagattgctgttcctctttctcaaaaagggcctgttcttgtgtgtagaatattcccgtggggcggccaacactaatgacgtgtggggcgccgttggaccctcccctgtgttcgggagggggtgggggggttgcgcccctgttgtatcgacctcacccgcctgtatgttttgtttgtcacccaattcctataggcccgtgggggggggcatatacacatttggcgtcgagaaggcactcggcgggggggttctattacatttacgttgggggctccacttaacgtccgagtggatacttccccggtgtggcctggtggcacgccatgtgttggggtataacttccgcgcgggctcggcaaatgtttcccgcacgccctct

SEQ ID NO: 678046 - DNA, 230 bp, Homo sapiens
cagtaattctgtactcaccctcctccagctccaacttctgagtctcagtgtcgtattccacactgtgcccacatgtacacattattttgcttcacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtg

SEQ ID NO: 678047 - DNA, 264 bp, Homo sapiens
cttcctgctctctgcccaagatcttggtgacttcgcctctcgtaactcagcttcacgctcggggacagtgagtgaccgcctgcacggtcttctagcttctcggtctatctcatgcttcctgcttctgccagggttgattcgggaggatcctattggtgcgcgcggctttgtctgattatgggcgttgattagtagtagtccctgtttgaacattgtttgttgggtgctatatcttgtacctttagattgctcgggggtaccgag

SEQ ID NO: 678048 - DNA, 391 bp, Homo sapiens
gatttggtcgtgcacgtggtgtgtgtggtgtgtgctctgtgacatgtgtgttgtgtatgtggcatgtgtggtgtgtcgtgtgttgtgtggcatgtgtggtctctggcatgtgtgttgtgcatgtgtgtggtgtgtgtggcatgtgtgtggcatgtgtagtgtgtgtgcatttggcatgtgtgtcatgtgtgttgtgtgatgtgttggctgtgtgtctggcatgtgtgttgtgtgtagtgtgtgtgtatgtgtgtgacgtgtgctgtgtggcatgtgtgttgtgtgttgtgcactgtgtggcatatgtatttgtgtggtgtgtgcggcatgtgtgtgttgtgtgcgatgtgtggtcgacgcggccgcgaatttagtagtagtaggcggccgc

SEQ ID NO: 678049 - DNA, 355 bp, Homo sapiens
gggggtaaattaactttttcccccaacactttttgggggcctatccggaatgcccccacgttatcgggctaccccaatggaatcccacaatgaaaatcctatttttcgggagggtcattcatttttctaacagcaggaatattaataattttcatgatttgagaagccttcgcttcgaagcgaaaagtcctaatagtagaaaaaccccccataaacctggaggggctaaatggatgcccccccccctcccccccatttgaaaaacccgtatacataaaatttaggcaaaaaaggaaggaatcgaaccccccaaagctggtttcaagccaaccccatggcccccatggctttttca

SEQ ID NO: 678050 - DNA, 302 bp, Homo sapiens
ggaaaaataagtaataaaggacatgattgggataataaaattagaatattgacttgtataaaaagtattctattgatgtcaaatttcctggccgggtgcggtggctcgcgcccgtaatcccaacactttgggaggccgaggcgagtggatcatgaggtcaggagattgagaccatcctcgctaacatggtgaaaccccatctctactgaaaatacaaaaaaaattagctgggcatggtggcaggcgcctgtagtcccacctactcgggaggctgaggcagaagaatggcgtgaacccgggag

SEQ ID NO: 678051 - DNA, 239 bp, Homo sapiens
tttccagcccaggggttgggctgcccttccccctgaggctcttccctatataatcagaccttttggcctcccgaccccctcctcttctgtcttccccctttccttctctctatacacatgctttctctctttctttttcccctcccatctgtgtccgttcccatggtgactatcccgccttttcccatggggccatgaactcaaccaccagggagccccttcccaataaacgtcgacgc

SEQ ID NO: 678052 - DNA, 197 bp, Homo sapiens
atcacatatccagcacactgacactaaatgccatccatatgtatatcgcatgtaatccttccagcaacactaaggtatggacgatttttatccccgtattacagcatagaaaactgaggcacaggaagtcgttagaaatataccaggatcatgtaattaataagcaatagaagcagaatttaaacctaaggcagtct

SEQ ID NO: 678053 - DNA, 261 bp, Homo sapiens
  misc_feature (40)..(40): n is a, c, g, or t
  misc_feature (50)..(50): n is a, c, g, or t
catccctattatgatatgtgataggtacagcttttcgggngcttggatcngaatttactttgaaaacaattgtaatggtattatttatatttacattggggatttcccctcgcttctgatctatttttaataaatatattttcaaataatgttggctgttaaaaaatgtataataactcagtttttcttggtttatggaaatatctattttaatgtgaaaataatttattttgaattgtgattaaagtgagcaatttgtct

SEQ ID NO: 678054 - DNA, 227 bp, Homo sapiens
cagcaacctccctcctgttatctaccaggagtgctctaataaagggacagagtgacatactgatgcctactgtcggcatctgagatgcactgtgtaggaggttagcctcaatgccagcctctggttgtctagagtagagtagacatcaccatcaaaatcacattgtggtaccattgctggactcaggatcacaaaggcagaggcaaccaactcttatttttcgttta

SEQ ID NO: 678055 - DNA, 340 bp, Homo sapiens
tttgcgagctcggtaccccctcctcagctcccaaagtgctgggattacaggggtgagccaccgtctccggctatattaagtaactttctaatgttactgcttgtcatcctagggaagagtacacttagataagtttttctggaatgaatgacaccttactaggtttgaaagtttacagttgctttatttatacgtttttgttaatttgtttgctttttttcaaagcaagttttattccaagttttacatgctcattacttgaaagatagcagactatatatagaagttaaaaaggcatccatatttacatcagataacctccttcaacattaattatacc

SEQ ID NO: 678056 - DNA, 233 bp, Homo sapiens
  misc_feature (227)..(227): n is a, c, g, or t
  misc_feature (230)..(230): n is a, c, g, or t
  misc_feature (233)..(233): n is a, c, g, or t
gaattctactagactttcaaagaagattaataccaatctgttggactctattccacaagataatgaaagaaggaaccctctctaactcattctatgaagccagcatcaccctaataccaaaatcaggaaaggacacaaccaaaaaagaaaactacacaccaatatccttgatgaacatagatgctaaaatccttaagagaatactagttaactgaatccagcaaaanaantcn

SEQ ID NO: 678057 - DNA, 1722 bp, Homo sapiens
  misc_feature (84)..(84): n is a, c, g, or t
  misc_feature (1049)..(1049): n is a, c, g, or t
  misc_feature (1397)..(1397): n is a, c, g, or t
gtctctcctggggaccactgttggtaggtgtggtgagttgagtcccactcacgatgacgccatagggatctgcctcccatcttntcagagtcgccaacggaccttagggggcaagtgaggaggaaacatgatctagcataggagatctacagagttgctagataatcttggttgctattatgcgttgatcttatgctgactaagcgtacttagggtcattactccgactatgcagtgagtcacgtgagccacagttcctaatactcaggtcatttaccaaagtactcgcaacatagtgtgtgagtctggtgatgtggatggactattcgtgtaatggatgctatgcattggtagcgtgcagtgtggacggtggttgtaagaggtttggagttgctgtatccgacgcaatgtatgaacgtctagagtaatccttgtaattcccatgcgtataatgcgcgggagattcgttctaactctatggcgtaagctttagtagtgatgcgagtactagcgcttctgtggtaaggtttgtctccaattccttagtccaacgagtgtcgatcatatttcaacatatctaacagggatcgctacgacgaagcattgtgcccaggtggccttccatggtgagccatcgatttgctctctttgtacactttcctagatctttgggcccatttgtatcccatatcgagcggtaccttcacaagctacgcagtggttgcgttgttggttgttcctcttccaacgcgtctatgacgattcttctccttgtcttgacctttcgtggaatgtcgccgtccttacccttggacctggtcccctttgtagacccccgtgccgattgatgtggcgcttaatggccccttcgcgttgacaccgaaaccgcatggtggttcctcctcggcgctttgagaggcatcccagggggacggttggggggtatggcgcccgtcccgggtctcccccgtggggggggatttttctcccttagttggggcccgccaggccttttaatttgggttggctttggggcctaggtcctattnaggaggcttgttggcttttatgagatttcctccttcttcctgttggggttcgcaaggcgaggtgcttgagctcttggccatgtaagcccgggtgcggtacctggcccaacggggggttcgttgggggcactcataggggttgtgtgtgccccctgggttcgcgccttgtggtgccggtataggcgcgcccatatccacgttgtgccgcgcggagtgtccatcaggggcacacccacggggttggtgtggcccgggccccccgggaggaattgtggtgcgccaaaaggtggttctttggaggaccccccttgtgcggcccccacagggggtgtgatgtgtcccccgctnttcgcccccccctgctgttcgccctgagagagttggcccccgtgggggtttcaccggccccatgtgaagaggacctatgcgtggggagacggggggtgcatacccccctcgcgggtcgtttacaccccgcggtgtgaggttgcctgtgtgagtaacacgccttcgttcgttgctcgcccgcgtgttgtagcccccctcgtgtgctcagcatgatgctggtgtcccacccgcagtggaggtgagcggtgtgtggtccggtctggctgcagcttggcagactccaggccgtgtgcgaggtcctcgtcgtgtgctgtagaccactcgg

SEQ ID NO: 678058 - DNA, 694 bp, Homo sapiens
  misc_feature (16)..(16): n is a, c, g, or t
  misc_feature (36)..(36): n is a, c, g, or t
  misc_feature (391)..(391): n is a, c, g, or t
  misc_feature (444)..(444): n is a, c, g, or t
  misc_feature (578)..(578): n is a, c, g, or t
  misc_feature (582)..(582): n is a, c, g, or t
cctagaggattcccgngcagaatcacactcaaaacnaaaacagacaaggacacaacaaaaaaaattacagaccaatacccctgatgaacatagatggaaaaatcttcaacaaaatactagcaaacacgatgtaatagtacatcagaagataatataccatgatcaagtgggtattataccatggatacaagaatggttcaacatatgcaaattaataaatatgatacatcatacattacatattacataaacagaattaaagataaaaaccatatgatcatttcaatagatgcagaaaaagcatttgttaaaattcagcatcttttcatggtaaaaaaaaaaaccctcaataaagtaggaacataacttaaaataatagaaggaatacaanttaaaataataaaggtcatatatgataagcccgcagccagtatcatactgagnggggaaaaatgggaagcattactttggagaactgaaccaagataagggtgcctgccttcaccatgcctattcaccatagtactggaagtcctagccaggacactcaggcaagaggaagaaataaaaggtatccnaatnggaagagaggaagtcacatgtcgtgttgtcgatgatgtgatctatatctagaaaaccaaaaggttccacaaaaactgttgattgagtgtatctgccggtacgagctcactcg

SEQ ID NO: 678059 - DNA, 500 bp, Homo sapiens
  misc_feature (485)..(485): n is a, c, g, or t
tagcgagagaggggattgtgaatcacgttgttatgctgcatgaagacatgctccgtgaactcgttcaggttttgcgtggaggagggccaggatttgcactcataaccaccttggagttttttggactggctttcccccatagatttcacctctatcacttcgttttctttggaagagttttcaagttctgctgcccaactgtccttggccacgtcaggctgtggtgtgccgattcctttctctttggccctgtctacttcctcgggcacatcttgttctactacttgtgatgtccgaaccatgcatggagttgtagattttcgtttgctagccatgctgcctgtctgtgtgcaatggcttatttttggagggggataaggagggggcggtgagattcttggaacgaataaggtgaaaggcttttggctttattccccctcaaatggctttggctttccttgtgtgctgaagtctactgtttgagntttcagaatgatttc

SEQ ID NO: 678060 - DNA, 963 bp, Homo sapiens
tttgatgttagttgtggtgtgcgctgtcactctatgtgattatcctagatgacatatactagggttccgtcgccgaatttggggcctatgtactcattattcgccgccaatgcgtgtatcccatcggggatttgaaaagccatgtcgggatcagacgtgttgcttgcgcttgaacatgttgcaccggggataaaccggaatgtggggagcactggtgtaaccacgacgccagtctttgagaacccttctatctttccttggggctgctgggctcctccatccgctcctttttggtttgctcctgcgtttcgaggagctttgctggtgcgtgctgttgtttcgagcttcacttggagagtatttcttgtgtatcacatgtaagccccctcgcttccccagccagagatatggggggaaaataatcaactgtccgctcgtttaaaccgacaaacccatcggaccaaacaacttgaaaagttaggttctcaaagtcttttcgtctattcagctcgctcccccaaacaggcatcgttacactaactaaatacattgctccccaatcttcccccaattagtcaaaaataatgctttctgtaacaacctctaaagaagactaaatatagtgtccactccaaatgaaaatctcacagcgattcttttcaaccacaagcgcctcacatgatgattgacccatttccacctcccacctgttcggagagacccaagccaccccattttccagaaaaggaatagtctattatgagcgaataaatttcctacacaaggacattgccgaacagacccaacacaacatccccatcattcaactgacggaactaattattatcacgccgctcttcccacttttcttccataaaaacacacacactccgcttttttttaaaaagtaaaaaaggtttttttttttggggaaatttaaaacttaaatcccccccaaaaaaa

SEQ ID NO: 678061 - DNA, 424 bp, Homo sapiens
gcactagctatcaaactgagcgctttcttgataactacttatagattccccgattttgaaatggcatagcgcacggttcaccctatcatgtcaggtgtgctggctgttctctcccagtactggccggcgtttcacaaaagactcacacccgaataagaagcctttttggtgttgtgtccaggtgggcagaagtcacttgatccaactacagagatattgttgttatgaaggtagacaacctggatgtacttatgctctgccagcccaccaggtactctggtaagcttgttgttgtcccagtaaagctccctcagatgaggcgtgtaggccagagagccattgtcaacagcagagatgctgttgaaactcaatcccaacttagccaaaattattcagtcctttcaggctagctgcatcaactctg

SEQ ID NO: 678062 - DNA, 459 bp, Homo sapiens
  misc_feature (24)..(24): n is a, c, g, or t
  misc_feature (27)..(27): n is a, c, g, or t
  misc_feature (30)..(30): n is a, c, g, or t
  misc_feature (33)..(33): n is a, c, g, or t
  misc_feature (35)..(35): n is a, c, g, or t
  misc_feature (37)..(38): n is a, c, g, or t
  misc_feature (55)..(55): n is a, c, g, or t
  misc_feature (58)..(60): n is a, c, g, or t
  misc_feature (80)..(80): n is a, c, g, or t
  misc_feature (100)..(100): n is a, c, g, or t
  misc_feature (105)..(105): n is a, c, g, or t
  misc_feature (116)..(116): n is a, c, g, or t
  misc_feature (119)..(119): n is a, c, g, or t
  misc_feature (136)..(136): n is a, c, g, or t
  misc_feature (154)..(154): n is a, c, g, or t
  misc_feature (157)..(157): n is a, c, g, or t
  misc_feature (160)..(160): n is a, c, g, or t
  misc_feature (163)..(163): n is a, c, g, or t
  misc_feature (187)..(187): n is a, c, g, or t
  misc_feature (195)..(195): n is a, c, g, or t
  misc_feature (203)..(204): n is a, c, g, or t
  misc_feature (208)..(208): n is a, c, g, or t
  misc_feature (229)..(229): n is a, c, g, or t
  misc_feature (243)..(243): n is a, c, g, or t
  misc_feature (249)..(249): n is a, c, g, or t
  misc_feature (266)..(266): n is a, c, g, or t
  misc_feature (292)..(293): n is a, c, g, or t
  misc_feature (305)..(305): n is a, c, g, or t
  misc_feature (310)..(310): n is a, c, g, or t
  misc_feature (314)..(314): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (341)..(341): n is a, c, g, or t
  misc_feature (377)..(377): n is a, c, g, or t
  misc_feature (380)..(380): n is a, c, g, or t
  misc_feature (453)..(453): n is a, c, g, or t
tctccatggaggccgtagaggaancgntgntgntngnngaactcaatcctggtcnccnnnactagtttgattggaagtcnagctgtgaaacttggagcgntgccntcttcctagangtntccttgtttgcttggtntcaaggacactgtatcgncanacngancctctggtccgttggtggagtagntcattccnataaggtnntgantcttaaagtcgaagtagcaanaatgagacgaaagngctggncagcccaaaagagaagncgctggactgttgtcagattgtttgnnggctggcctttngcccntggncttccccancnagcngnangctctggncacgctaccactcctcaagtgcccgatgtttcttgnctngttcttgctacgggactcaacgatgggcagatcaagatctgggaggtgcagacagggctcctgcttttgaatntttccg

SEQ ID NO: 678063 - DNA, 223 bp, Homo sapiens
actccgttcgcaccggctaccgagtcttgtagcacaactccacggccgtctgcacggaccttgtcaagcgcgtcacagagcgccttggtgctgtatcgctgaagctttgagtatatgataccactggtgaatcacgagttgaactatagaagtctgtacttggtcaagatgttctcattatacagacactacccagtagatgtgtacagctgtgatgcatatc

SEQ ID NO: 678064 - DNA, 823 bp, Homo sapiens
  misc_feature (8)..(9): n is a, c, g, or t
  misc_feature (15)..(15): n is a, c, g, or t
  misc_feature (41)..(41): n is a, c, g, or t
  misc_feature (43)..(43): n is a, c, g, or t
  misc_feature (55)..(55): n is a, c, g, or t
  misc_feature (60)..(60): n is a, c, g, or t
  misc_feature (63)..(64): n is a, c, g, or t
  misc_feature (66)..(66): n is a, c, g, or t
  misc_feature (77)..(77): n is a, c, g, or t
  misc_feature (97)..(97): n is a, c, g, or t
  misc_feature (109)..(109): n is a, c, g, or t
  misc_feature (134)..(134): n is a, c, g, or t
  misc_feature (190)..(190): n is a, c, g, or t
  misc_feature (192)..(192): n is a, c, g, or t
  misc_feature (224)..(224): n is a, c, g, or t
  misc_feature (232)..(232): n is a, c, g, or t
  misc_feature (244)..(244): n is a, c, g, or t
  misc_feature (261)..(261): n is a, c, g, or t
  misc_feature (265)..(265): n is a, c, g, or t
  misc_feature (301)..(301): n is a, c, g, or t
  misc_feature (317)..(317): n is a, c, g, or t
  misc_feature (331)..(331): n is a, c, g, or t
  misc_feature (338)..(338): n is a, c, g, or t
  misc_feature (365)..(365): n is a, c, g, or t
  misc_feature (370)..(370): n is a, c, g, or t
  misc_feature (378)..(379): n is a, c, g, or t
  misc_feature (385)..(385): n is a, c, g, or t
  misc_feature (399)..(399): n is a, c, g, or t
  misc_feature (404)..(404): n is a, c, g, or t
  misc_feature (409)..(409): n is a, c, g, or t
  misc_feature (456)..(456): n is a, c, g, or t
  misc_feature (460)..(460): n is a, c, g, or t
  misc_feature (472)..(472): n is a, c, g, or t
  misc_feature (507)..(507): n is a, c, g, or t
  misc_feature (563)..(563): n is a, c, g, or t
  misc_feature (572)..(572): n is a, c, g, or t
  misc_feature (600)..(600): n is a, c, g, or t
  misc_feature (626)..(626): n is a, c, g, or t
  misc_feature (636)..(636): n is a, c, g, or t
  misc_feature (641)..(641): n is a, c, g, or t
  misc_feature (657)..(657): n is a, c, g, or t
  misc_feature (706)..(706): n is a, c, g, or t
  misc_feature (713)..(713): n is a, c, g, or t
  misc_feature (720)..(720): n is a, c, g, or t
  misc_feature (731)..(731): n is a, c, g, or t
  misc_feature (815)..(815): n is a, c, g, or t
taccagtnnagaaanttatttgaattcaaaaaaaaatggcnanatttaaaaaaanaaaanaannanccaaagcaaanatcaccattggccccgaaangcgtctaaagangtcattcttaagtcaaaaaaaacgnagtaagaatgtacaagaaagaaaaaaaaaaaaaaacaagtctgccgagtggcgggngngggggagggaaatcccaccaaattgggacggngtccaaanagaaaacatgcngcaacagtccccccgcnttancagccccccggaaaaaaaaccagtaaccccgggagngcagtaaccatttggntaacaggacaaacntcccganggacacagaaagtaattcaccgcattnccccnccccaacnncccccnccacaccaattccntttcnttccnttaagagggggttcaccccgttgacaaaagatttgggtttatttgtnaagnaaagcagaaaanatcccgattgaagtattcaatgatttagttgaggntgcttggggatcaaactttgtaaaaaggtcaattaagctagttagcagagactatnagtggcttncagaaaaaaaattcggataatatgtttnttaaaaagacaaaaagaataagcggngaaaaatccnagggnttactgtgacctaganaatcaaaagcagaaaggtgaccttttgattaaatccatttacttgtggngtgagcnaaaaggnggctccaaganagagtttggttcccaacagtgtccgtggccaaagggcacactcagaaggtctcctcctctcgtaggaactggaacacggatganaagtcttt

SEQ ID NO: 678065 - DNA, 418 bp, Homo sapiens
agcaatctctacctttacttctggcgtcggatgacactgagccgtctcggaagcacggctctcccttggctacttactgcgcagggcccaggacaccgccgtcggggctgaagatgctagccggtgcacacttctcacccttgtgttcccggtgagcctcgtatgcccttagagaccaggtttgccttgggtcctgcatggtccgggaaagactgcgaaacccggcctggcctcaggtcccggcacgctcaggacggatccgtcctgctccaacttctccctttgaccccggcagcccaggcacgccatgattccccttaagtcccggcaggccgggagggtccctgtggcccatcagcgcttcgggctgttgaccagaagtgccccccggagccttccatgtcatcaaatccagcgg

SEQ ID NO: 678066 - DNA, 371 bp, Homo sapiens
actctgaaccatgcggtataggctagtgggatatggaatcccgacgggcaaccaagcatggggtaattcaaccagctggggagcaaacactgatccaacaaaggatatatactcatggctcgcaataagcacaacgcctgtgacatagccaacctggacagcttccccaagatgtgactccagacagccacatccatccagcacttccattactatccaagatggtgcagtgtaacgatgcactttggaagggagtaggagtgctataaaagaagcagatgtggtgatactgagcttgtctgctcagtttccccattagtttgtgcttcacatgatccttcctcctttgcttctctccacccatgaccttt

SEQ ID NO: 678067 - DNA, 407 bp, Homo sapiens
agacgtatacaatcagctcgtaccgaacattcagtgtcacagctattcagtagcactggaggagacgctcagatcacattggtcaaaggcctttcccaaacttaggatctgatgtatctgttccttaaacgcctggcttaataagagagccaggaacaccgtgatagcaggcttatcaaaccgctcacttcctccctgttttccttcgcaggtcccctctccattgttttctcgcccaatccttccctcttgttccctttgtgaaaaagccatgtggaactcactgtgcccctctcccagctgaaaggacatgaacctcctctgacctctttcctccagacacccagctggacagctggtggcagcacgggactgaacctgtttgagtttgtcccctataaaagtcc

SEQ ID NO: 678068 - DNA, 476 bp, Homo sapiens
cccacccaagcttggaggcggggttgtgtttttgggggtccctttttttccagggagttcccttcccgggcctaccagcggccgttggggtgagccccttccccacaccggggtgtttttccggggccttccttggaaacctgccctggcttaggggccctttggccaggttggggccaggtggggtttgccccccttcctgtttagtgttccggggccgtttgggtttgggccgtttagggctttgggttttgttggaaggggttggggggggccaaaccccccttgttgggggctgcagggtggtgttggggtttagcccgttcccgggggatgttttggcctggaggtggggttgggatttgggggctggttccaccctttttttggaggtggcctttgttgtttttcccttgggggggttgggggccccgttgtcttgggaattcggttgttgggcttcgggcttcccttta

SEQ ID NO: 678069 - DNA, 105 bp, Homo sapiens
ttctcaaaagctacaaggaagttcagttaaagattaacagctaaaaatcaaggctgaataatactaggacaagggccaaacaggataccgatggtacccacctgg

SEQ ID NO: 678070 - DNA, 1386 bp, Homo sapiens
  misc_feature (434)..(434): n is a, c, g, or t
  misc_feature (441)..(441): n is a, c, g, or t
  misc_feature (471)..(471): n is a, c, g, or t
  misc_feature (1386)..(1386): n is a, c, g, or t
atgttggcgtggttgttgtatgcattgattggcttgttaagaggtttgttctcgatgcatactactgcactctggagcctggcccactaggtgagatgtcatttatccttcatcgatcaaatcaatcgaccacaccaaatgtctcccgcaagcaggatccgagctctctacaggtggactacgtagtagtctgcgaacacatcgctactctatcgcgctagatttgagacaacctggagaatagtcataagagagtcgaggacaattaggagattccctagtagcacttgggtgcccacactactctctcatccgtgcagcaatatgtatgcgcttgcactactgtgatggctcacctttcgtggattacctcagttgcgtcacaagtgtgtgcgcacccctacgtggggctaggtcgcgcgtgggttccttantgcacantggacagagtatgagtgagctcgttatggnctggggtgaacacgtcgacttccagggctttggccctggacagtggcgtaggtggcccttgctggccagggcagcctgaacgtaaaaaactttggaatgcggatggcctacccgaccaacgccaaagcaccgaattgggccacaaagcacggcgttttcgtacgcaaaggctagcgcttgggcgggctccaattgccacttccgaagggccacggccgtgggttcgccgagggcccccgcctatggtttggggtccggtgggcagtgctttcccccagtgcgctccatctcgattttggggcttaccagggtgcgccctggtccgcgggggggcgttcccgaagattcgggcatctcgagccgatcgttcgcattggccgagtggttggggcgtcgtagtttcccgcattgtgggctccttcgttgcgagttaacacacaccgccccatggactagccaattgcgcacccttgggggaggtactcggcttgcagggtcttttcctcccaaggggaagcacctagtgttgccggcccttgcgcccgcttcgtggcctagggtctcattcgatcgcccggtggggctccccgtgccccccattgtggccctcttttcgcatgcataggggcccacggacaggggccgtttgtggccttcggccgttgtgtgtgtttttgcccccttggttgtgagcctttggcgcccccctatttagggtggtggtggccacggggcacctagggtgagccggagaactcaaacgcgccggcgttggagctatgtgtcccatggggtgtttaccccattgcgacccccgaaggttttggtatggccttcctttcggagtcccccgcgggtctccacgatccccccttgagaggcagaagacccttgttttcccgcgcacactgcgcn

SEQ ID NO: 678071 - DNA, 382 bp, Homo sapiens
gtaaaacaccccgagttgatcctacactcactaggccacatatagtatcgctgtgtttaccaaacagaatagaatttatcacataaagcaaagaatacaagaatatgataaagtaatgaatcgggatgtacaaggttattcttaacgcttattagaaaccactttatttatttattttattttattattatgagatgaagtctcgctctagttacccaggctaggaatgcagtggcacaatctcggatcaatgcaacctccaacctcccgggttacaagcaattctcctgttcaagcaattagcctccccagtagctgggattacaggcgtgcgctgccacaccccgataattatagtattattagtaaagacgaggttcac

SEQ ID NO: 678072 - DNA, 319 bp, Homo sapiens
cacgcgcacagccacgctgcccttggtctcgtggtcaacacttgatcttggtggcgttgtacttctgtgcgatggcatcggccacggcatatcggccccatgaatagtgtgttccagttgtgagagctggcactgttggctttgtcctgggcctccttcttcttcttgtaggacgacgatcccagggcactggcatcctcgctggcttccttcttgatggtagatggtaacacgtggagcatcctgccctggaatacctgcccgtccacctccgagtaggccttcacagcgtgctcagggaacatgaaggtgatgaata

SEQ ID NO: 678073 - DNA, 220 bp, Homo sapiens
  misc_feature (31)..(32): n is a, c, g, or t
  misc_feature (78)..(78): n is a, c, g, or t
tcatgtgctgtggcagcgcaactctccaggnnccacttgttcctcaaagccccttctttggcctaaatcctagaggtngctcatcatcctgcctgagatcagagaccccagctaggtgagcacatgtggtctgtgagctggggtgggacacagagcctcacccagttcagcatgctgtcccccatcgttccatgtgtcatctgaccccgctggcctacca

SEQ ID NO: 678074 - DNA, 199 bp, Homo sapiens
tcatgaccctacagtgggattcatagaggccaccagaaaccaggccttttcttgtccagaagttccaacgcttcagcagcgatagccaccacttacagctcgtccccacacagtgctgccacagcaggctgacgcaggtcctccgcccgagcacctccagcgctgcacgtgcgcacttgcgtctggactgcacgatccg

SEQ ID NO: 678075 - DNA, 121 bp, Homo sapiens
actcatgagatccccaaccccctctcacccacaaaccccctctcacccacaaaccccctctctagtctggcacggtgaagagacatgagagtgttttgtgggtgagagggggtttgtggtc

SEQ ID NO: 678076 - DNA, 240 bp, Homo sapiens
  misc_feature (202)..(202): n is a, c, g, or t
ttctgaatcgacggtttctccatcgtggtcaggctgtttcccaaagtcctgggattacaggcgtgagcaaccgcaagtggtcttgtagtactataaatgggcagtatgtagcgtaacctattcacatcctcccatatactttacttacttattatttattcatttattggcagacagagtctcattctttagcccaggctgnaagtgcaggtgggggcaatcagcggctcacgtgcagcc

SEQ ID NO: 678077 - DNA, 113 bp, Homo sapiens
cttccaaagttaaccactgtcccagctgagaagaggaagccatccgagtgctgtctctctttgatggaatcgctacagggctcctggtgctgaaggacttgggcattcatggt

SEQ ID NO: 678078 - DNA, 245 bp, Homo sapiens
tctagacgactccctgggtgacgtggtgacttactggccctctggacgaagtgtcagccctgcctgaaacagacctgcatagaagttctacgcacgctgtctgcagaagtggctcaggcctggttggccgccagtttgaggagttcctgaaccagagctcgcgcttctacttctggatgaatggtgcaccgcatcgactccctgctgtagaacgaccggcagcaagacgcacatcctggatgtca

SEQ ID NO: 678079 - DNA, 1069 bp, Homo sapiens
  misc_feature (156)..(156): n is a, c, g, or t
  misc_feature (250)..(250): n is a, c, g, or t
ggtagcagaccactaaatctacgagtactatgggaatgaggagaggggaacccccagtgatatgttggtcctagagacctgtctagggcacacagagatgccagaggtctgctctctttgttgcgcccgacaactcactcattgccaggagagccntacatgaatgtcaaccggctgcagtcatcgctcctactcttctgacagggtgagagtggagatgaggtggtgtgcacatatacggacatgaccnctcagtcacagtgtggtagtgagcgcatgggaagaaagagactgtgtgtgagacacacagtgtctgactcagaatagttcaaacaccgaagtaagttggtctatgctatatgtcgctacttcgaagaggtagacaccactgagtcttagagtctcacaccgagagacagagagaatgtctctgtatgcccatacgggaagggacatgtacaattggtatgcgggtgcagtctgtacagccaccttatataaatgctacttcatacaacacgaagagcccgggatgtgatgcatgctctcttcgcgtgtgcaaccatcaagctcgttcgtacatgccgcacaaatattcgcatgcgcaacgccacgacgtgccgcgcaaagaagagatttcccccaaagggggtcgtacatatcggcgctatctctatcggagcgctctcttgggtctccccactactagtggcagccctattgtcctttgcgccgtgcactacccccaaaatgatggggcacgggcacccaacttttcaactgctgaacagagacaccgcatccgtcgcgtgtgtgaggcgaaagcttcattgcgaactttgtggggccgctacgggcggcaccccattatttgaacctccactattatccttcgaaacaataaccgatctagaggggctctctataccgcaacgacggatccgatgagaaagcagccgattgagtagacccccccaaacattatgcggcgggagacgacggttcggtgctgcgagtaatattaaaccacaaaaacaagaatctgagcccccttatcatcacttatatg

SEQ ID NO: 678080 - DNA, 767 bp, Homo sapiens
atctcagcactttgggaggccgaggcaggtggatcacctgaggtcaggagttcaagactagcctggcaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctggggcgacagagcaagattctatcaaaaaaaaaagggcggcgggcaagtaagttatagaagagaaatgctgctagaaggacattaagcgtggtagtaaaccgcgtgctcatcctctaagcttgaagaagggagacgaaaattccattggtttaaatttcacactctcagggagggagaacccgggctgtgtgggtgttgccaatttcctagaacggacatgtgcgggggctatagaaaccgcgactgaataacgcgtgggttttccaaaagtacggggtccctgtgtaaggtcatgcgatgcacgagggacaaaacgattggaccttggggagggcgcttacaccacttgcttgtggcgacaacacccattggcttttggaagggccccaagtggaccacggggcaaagattaccaacctttaataaacacatactctcgctatatcacacacaacacactcttttctgcggcagcccttgcgcccccgcgaaaaaaatttgtttagacacacatctcgttgcgggacgccgggccca

SEQ ID NO: 678081 - DNA, 124 bp, Homo sapiens
tgagatcccccgtcttggcacttgttgacctgcgagtgtactgggctgctggctgaggcttcgggttgggtgtgctgttggcaatctccgtgtcattgtggggccacgatgttatttcctgttg

SEQ ID NO: 678082 - DNA, 1100 bp, Homo sapiens
  misc_feature (541)..(541): n is a, c, g, or t
  misc_feature (671)..(671): n is a, c, g, or t
  misc_feature (778)..(778): n is a, c, g, or t
  misc_feature (799)..(799): n is a, c, g, or t
  misc_feature (806)..(807): n is a, c, g, or t
  misc_feature (831)..(831): n is a, c, g, or t
  misc_feature (855)..(855): n is a, c, g, or t
  misc_feature (858)..(858): n is a, c, g, or t
  misc_feature (880)..(880): n is a, c, g, or t
  misc_feature (882)..(882): n is a, c, g, or t
  misc_feature (959)..(959): n is a, c, g, or t
  misc_feature (966)..(966): n is a, c, g, or t
  misc_feature (969)..(969): n is a, c, g, or t
  misc_feature (976)..(976): n is a, c, g, or t
  misc_feature (984)..(984): n is a, c, g, or t
aaaggtggaagaaggaagatgaagaagagtgtggaggctgacgtgtgagggaggacagtgcgggaggaggtgtgaggaggaggctcccgaggggaaggggcggtgcccacaccggggacaggccgcagtctccattttcttattgcgctgctaccgttgacttccaggcacggtttggaaatattcacatctgcttctgtgtatctcgtttcacattgttgtgctgctattgggggatcagttttttgtttacacaatgtcatatactgccagtgtactagttttagtatttctcttagaacattgtattacagatgccttttttgtagctttgttgtatctttatttatgtgatcaattttggacttaatgtgattactggctctatttccaaaaaggttgctgtttcacaatacctcagtgcttcacttagccagtggtggacccagcgggcaggttctgcctgcttgtggcgggcagacacgcgggcgcgatcccacacaggctggcgggggccggccccgaggccgcgttgcgtganaaccgcgccggtgtccccagagaccaggctgtgtccctcttctctttcccgtggcgcctgtgatgctgggcacttcatctgatcgggggcgtagcatcatagtagttttatacagctggtgttatccttngcgtgtagctttggaagttgcataattattattattacttattataacaaggtgtgtcttacgtgccaccacggcgttgtacctgtaggactctcattcgggatgantgggaatagcttctggaattngtccacnnttggggtatgtcactctgtatgtnctagtgtcctgtcggtcatggttngtnaattacaccataatgctaattnanaagagactccaaatctcaatgaagccagcctcacagtgctgtgtgccccggtacacctagcaagctgccgaaccaanagaattngcncccgtgngggccccntggtggggcctgcctggcaggtgcaaccggtgccggaggccattccgggacagggccacccggccaccttccaaaacggtacgctaactaacacacagttgcgggtttataaaccg

SEQ ID NO: 678083 - DNA, 398 bp, Homo sapiens
  misc_feature (266)..(266): n is a, c, g, or t
  misc_feature (361)..(361): n is a, c, g, or t
ggatcacgaggtcaggagatcgagaccatcctggctaacacggtgaaacccatctctactaaaaatacaaaaaaattagccaggcgtggtggcaagcgcctgtagtcctagctattcaggaggctgaggcaggagaatggcgtgaacccgggaggcagagcttgcagtgagccgagatcgcgccactgcactccagcctgggcgacagagcaagactccgtctcaaaaaacaaaaacaaaaattagccaggcatggtggtgtgcanctgtaatctcagcactttggggaaactgaggcaggaggaggacttgagcccaggaattgaagaccagtttggcagcatagcgagacctttctttncaaaaaattacaaattagccagccacagcgtgcatac

SEQ ID NO: 678084 - DNA, 432 bp, Homo sapiens
ggatctcttccgggatttgtgctccagcagaggttgattcatgaggtttaaggaaagaagccgtctccataacataaaagtacaaggtgaaacaatggcaagggctgatgcagaaggtgcagcaagttacccagaagatctacctaacttcagtgatgaaggtgactacactaacaacaggttttaaatgtagatgaaacagccttttattgaaagatgacatctatgactttcatagccaaaagaagttaatgtctggtttcagaggacagcctgacctgttaggggctaaggcagcttgtaaccttaagttgaagccaatgctcattcatcattccaaaaaaccctagagtccttaagaattatgctaaatctaccctgcctgggcttataataagcctagataagaccacatcggatcacaaccttgtc

SEQ ID NO: 678085 - DNA, 115 bp, Homo sapiens
aaccaatgttaacacattaattgaatgtatatattgctagtcagagcagctgtcaaaatgccagatgcatcatagacctggcaagcacaaatagtattccaatgtgcaatactcc

SEQ ID NO: 678086 - DNA, 838 bp, Homo sapiens
tacatcagcttgagtggaagtcaaagcaagctagttttagaagctatccagaactggtaaaggtaaacctgaatctttttaaaaattgtgataaagtacacgtaacgataaaattcaccattttaaccatttttaagtatacagttcagtgacatttaagtccatccacactgctgtgaaactgaaagctggatcttaatttctagtctctaacactgaactgaaatcaattgactttcatctggaaaaagccccacttcactgtggtctgtcactttgatggtgtcagagggtccaggacctcagtgccagggtgcgaggagagcagtgctgtgcagaggggaggaacctcaccatcacccagtctcctcaccgtcacaccagtctcctcgccagagggtccaggaactcagtaccggggtgcgaggagagcagcgctgtccagcggggacggagtctcaccatcaaccagtctccatcaaccgtcacccagtcagcctcgccagaagggtccaggacctcacagtaccggggaaccgaggagagcagcgcaagcacaaccggcgagacgagtcaacaacagtcacccagagcatacgtcacggacacacaaggctccatcgaccacgagggatccaggacacacaatgccagcagtgcgacgcgaaccaacagactggcaccagagaacagaaccgcaacagcagacaatcacatccagacatcactacaccaggagcacggtacggccagaagacaccagcaagcaagacacaccacatggacacacgaactcactaaagaaggaagcgcaacacacgacggggaaaagaggaca

SEQ ID NO: 678087 - DNA, 689 bp, Homo sapiens
agatcagctgccttctggctgacctgtcctacagacgtcccacagacctggccagaccacctctgcataagccattccttgccatgagactctaatgtggatctccacctgcttctgcttctctgcatgaagcctgtccactacaggttatgacagagagtttctcctgtggagactattccagctactaggctggcatttctgctcagctggcattagcacctgaggcatgagcactcttcccttaaacagctccagagcttgcttcacggcttccaatgggccaacagaagtgtcttactacttaatggccacttatttaacattatcccaagagtaattagagtccaggcgcggcgcctcatgcctgtaatcccagcactttgagaggccgaggtggccggatcacttgaggtcagcagtttgagaccagcctggccaacatgatgagggcacatctttactaagaaacagaatcagcacatgaacgcagaatcagccaggagtgctgtgcgccactatagtccagctactgcgaggctgacgcaggagactgttttggatccagaaggtcgaggttgaagcgagccgagattgcacaactgcactccagcctggctgacagagcaagactctgtccaagactccctataggagttcaattacctgctggccattcgcacgtcgtt

SEQ ID NO: 678088 - DNA, 244 bp, Homo sapiens
agatgacctaagaaaagagataagtaaaacgatgtttgcagaaatggaaatcattggtcagtttactggattgcaccaaactgaatgaggatatcttcatagtggaccagcatgccacggacgagaagtataacttcgagatgctgcagcagcacaccgtgtcccagtgccagaggctcatagcacctcagactctcaacttaactgctgttaatgaagctgttcttataaaaaatctggaaat

SEQ ID NO: 678089 - DNA, 185 bp, Homo sapiens
tcccaggtaggctccaggagaagactagcggggaagctggtagagtgagagtgtgggtgctcatggcatgccctgccctgcccaggccgagcaggagctccgcgtggacccagacagagtttgaccgagcaagcagaagtgacccgtctcttgctaggagggaatcagtagcactcacgtgaacc

SEQ ID NO: 678090 - DNA, 121 bp, Homo sapiens
taaaacgacggccagttgtaaaacgactggccagtgtaacacgacggccagtgtaaaactgacgtgccatgtgtaaacacgacggccatgtgtaaaacggacggcctagtgtacacacgac

SEQ ID NO: 678091 - DNA, 479 bp, Homo sapiens
tcgagagtgataagagaaaaatacagggagatggaatggaaactaccaggaaggccgggcgcggtggctcatgcctgtaatcccaaagtgcaggtgtgagccactgtgcctggcctgttttgctttgttatcatttgtgtgttcactggagtagcacttttaatttccttccagaacttttccttgcattcatagcttggctgtttggtgcaagaggcctagctttgtgtctgtctcagctttccacatgcctttctcactaagcttaatcatttttagtagaggcggggtttcaccgtgttggccaggatggtctcgatcttttgacctcttgatccacccacctgggcctcccaaagtgctgggattacaggcatgagccacccggcctggccttcattttgatatttaaaaaaatgcgtatgcttacttgaatccagaagtgcaagaccagcctggggaacttagaccctgtctct

SEQ ID NO: 678092 - DNA, 849 bp, Homo sapiens
  misc_feature (683)..(683): n is a, c, g, or t
  misc_feature (708)..(708): n is a, c, g, or t
tcgatgccgcgcagctgcaggatggtgtgcgcacggcggcctcgacgagcacggcgaggttgcggcccgcgtcgaccgcgatgacgacctgcgcaccggcatgccgagcacgtcctcatagagcggctcgtagggcaggcgctcgaagtcgcgctccatcgtctccttgcgcacgaggtggacgatgagcttgaggcgcatcttgcggcgcaccgccgtctcgccaaagatggccttgatgtcgagcaggccgatgccgcgcacttcgagcaggttgagcagcagctcggggcagcggccctcgatggcggtctgcgcgatgcggaagaagtccaccgcgtcgtcggcgacgaggccgtggccgcgcgagatcagctccaggccgagctcgctcttgcccaggcccgattcgccggtcagcagcacgcccaggcccaggatgtccatgaacacgccgggcgggtcgtgcggtggcgaacagctgggccaggtagccgcgcaccacgtcgatgacatggccggcggattcggtcgtgcggaacagcgggatctcggcgcggtcgcacatggccaccaggcgcggcggcggcacggtgtcgtcggcgcagatcagcaccggaggctccagcgtgacgatgcgcgagatgcggcggcctggatctcgagctctcctggtgaggtangcgacctcggggggcgagatctgcncccggtaggggtggtgttagtccgggtagccgaacaggtgggcgggcctggcttgcgccggcgggccgtaaagggccggagggggggcgggaccccccgagggcccggggtcaaacctggcgcagggggcaaaggcggaaa

SEQ ID NO: 678093 - DNA, 140 bp, Homo sapiens
gtcattcgtgccgctgagtctttccccagagtgcatgtcattcatgctgttcccattgcctggattcctgctcctctccaccccattcaactgataaactcgtggtttatattttttatttataatattttttttttttt

SEQ ID NO: 678094 - DNA, 1001 bp, Homo sapiens
  misc_feature (439)..(439): n is a, c, g, or t
tgttaaacggtacaaatccagttatatccatctgtttatgacccagtacacaggaggcaaagggtttcacatcataaacttcacttccaacccctgtggaatgtccatttcttgggcttacaggagaagaactagaacgaggaaggccaggcaatgcttaggcaactaaaatgaggtggggggtaatgctaacgtcaccctcacgagggatggccacggggaacggtatatccgcaagcgggtttcctagaaccgtgttaagcgtggaagcctgtgggtgagcaccattttcgtggacgcctcaggccggtgctcgggcttcagtcatctccaccacacaggttacagacagcgcttccgtggatagtcgcccttaggtgtctggcgtggaatataatgagtccgagggaactgtcccgaaacatatatctctttgaanatctcagaacctaaatttctcaacgtgtgttcccactttcaacgtggcgggaagacaccgagtgaatctcgtgaatcgaggcaccttaatctgcggcgttcccctttgccctttcagtgggagtcatcacgagcgcgaatcgacgcaaaatcacgaggggcgtaggtccgtgaaagtgcccgtgaacaccgaggttcgagggaaagagcctatttcccgagggtactcctttaaaccgtcttccccgtgaatgcttttccaacaagtgttccatagaggggcgtgtaacactctgtgatccctaattcaaatacctctctcggggaggtaggggcaacgcatccgcatcgggcacatgatgctagactccccaacgtgggggaaccactcaagttcccatttcccctctttacactccaaggggttcataagaagaatcccagaagcaatttggggcacactccagctacaataaatcaagggcacaagaagccaatcccgtgacatctattaataaccccttttgccaggggaaaccattccagattggggaaaaagtccc

SEQ ID NO: 678095 - DNA, 377 bp, Homo sapiens
  misc_feature (32)..(32): n is a, c, g, or t
  misc_feature (68)..(68): n is a, c, g, or t
  misc_feature (70)..(70): n is a, c, g, or t
  misc_feature (79)..(79): n is a, c, g, or t
  misc_feature (83)..(83): n is a, c, g, or t
  misc_feature (103)..(103): n is a, c, g, or t
  misc_feature (117)..(117): n is a, c, g, or t
  misc_feature (124)..(125): n is a, c, g, or t
  misc_feature (129)..(129): n is a, c, g, or t
  misc_feature (136)..(136): n is a, c, g, or t
  misc_feature (139)..(139): n is a, c, g, or t
  misc_feature (142)..(143): n is a, c, g, or t
  misc_feature (147)..(148): n is a, c, g, or t
  misc_feature (239)..(239): n is a, c, g, or t
  misc_feature (247)..(247): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (262)..(263): n is a, c, g, or t
  misc_feature (266)..(266): n is a, c, g, or t
  misc_feature (268)..(269): n is a, c, g, or t
  misc_feature (294)..(294): n is a, c, g, or t
  misc_feature (305)..(305): n is a, c, g, or t
  misc_feature (307)..(307): n is a, c, g, or t
  misc_feature (309)..(309): n is a, c, g, or t
  misc_feature (350)..(350): n is a, c, g, or t
attttagatcccgtttaccatgaagtgcaganacagcagatacccagataatacagtcagtgcaaaantnaaatgagtnagtnagctctttgatgaggctggntacactgcaaaatntaaatgnnactngaaaatnganggnnaggnntatttacaaaagtttgtttagtaaagtgacttgaaaaaagttgttaaccacttcccaggaatccctcccctctcccaccaaaacaaacaancaaaaaanaacngcaacntnaannttntnnttttttttgttggttaagttaaaantatgtggtganananagagtgcttgttcctggtttgggttttttggtttttttatnggttgatttttttttttttgttttagt

SEQ ID NO: 678096 - DNA, 263 bp, Homo sapiens
  misc_feature (29)..(29): n is a, c, g, or t
  misc_feature (45)..(45): n is a, c, g, or t
  misc_feature (58)..(58): n is a, c, g, or t
  misc_feature (63)..(63): n is a, c, g, or t
  misc_feature (156)..(156): n is a, c, g, or t
gtgcctatcacagggacccaccgccgtgngctgatgggggccccncacacaggggganctgcnggccggtctggacagatcattcctcactcagttccctggtagcacagactgacagctgctcttgggctatagcttggggccaagatgtctcanaccctagaagcctagggctggtgggagacagccctgttctgggagggggcgttgggtggcctctggtatttatttggcatttataaatatataaactcctttttact

SEQ ID NO: 678097 - DNA, 1426 bp, Homo sapiens
gacagcagatcaggctcggagctccagacgctgggacaggccgccgcagaccacccccggcgcgcgcgggacacgacgtccccccgcatggacccgcccatcaggccggaaacccctgagctgcttctcccggaggccgatgcccaaccgggagcccccaaagactcgcggctcccgggggtcacctgcatactcatccgcctgggacctgggaccccggtgagcctgaccgggagggggttcccagggcgggacctctaggtcaaagagatttagacccgtccagtttgaggtgagctccgggtttcccgatgatgcccgattataactcgcagagccacgattcctgttgtgagtgtgcagaggactggccgccccgagggcctcagaagccagacggcgccacccgggcgcatccgatgtgccagccgccagatcgtggaccaccacaatggaaaaagacgcaaggaaagataggtcgatgtgtagggcatgagatagtcgtcatcgccaagggcacatccatgtggagcgccaaaggaagccgtattggggaggaacgatgcgcgtgaatgggagcgataaggggcatagtggaacaaaaaccgaggtggacgcgagggtactggagcagtataaaggttaaccccacggaacaagttattgcaaggccgacgatgaaggcacggggaggacaacgggaatgtgccacgagcattacatggctacacgccaagggatggtatgccccaccgggtagacccaagtacacaggggcaggggaggctaaacatactgaagaacggcataccgaatgaggaacagacaccgaaacaggaggacaagatagaacacaaagagacaaaaacagcgatccagaagacgacacgcccggtgagcaacgaggcatctcgtctgcacatgtgtaaagcaattcaaccaggtagaacgccacgggcaagaggcgccatcacacagaaggtccgagcgatagacagcagaacaggggacccagacacaaaggttatagagcgaactagccacgcggggggagactatgggcagagcggagcgtgttggctacagtgtcgaaagaggaaacatggcagtcacatgggacactccggcgggtaaggacagcacgggcgctggcgtacaagcgcacacactgcaaagggctagaacatgaaggccaattataaaggacgatcaggagagcgggaaaaataaagatacgacaggaaaacacaagagatgacaacaggaaagaaacatacgagtgacctgattaacaggtgacagagaggatatgacatggggagtacgaaaccagggcaaccggacaataccgaaaatataggaaagaccaaaagagggaaaaagaacggagagaacagcacaaaagaggaaagaatggaggatacag

SEQ ID NO: 678098 - DNA, 187 bp, Homo sapiens
cagtgttgagcctagcatatattcatggacagataagctaccagtcgactcccgaattcttgccaaaacctcgcgatgaagtagtccttctggccagggcgatctgcaaatcatattactatccggtacgtgccatgcctaggactagtggcatcagtataatgattcgtgtgactgaccaaaggaa

SEQ ID NO: 678099 - DNA, 492 bp, Homo sapiens
  misc_feature (2)..(2): n is a, c, g, or t
tnatcgttacccatcaactccttggatatacaattatagatcaccttatttgttgatctcatgtttctatatcagccgtatttcctgtggtatgcgatagttagtcattatgtgtaggcaatgggttgagtgatgtctggatacattctgaaaggggaggggccgagttcgtgactttcacccttcttctgcagaccaagttttgcaaagctagagtggggctgtttgttttcttctcttctcgggaaattgccattggatcagtttgtcttggttaagatctcttgtgggtagctgagcagttgggcttttaaagatgaaagccacatgaaagaagactgttctttcctagtcatacaaatgattatctccatggtcgtataatctccataagaagtatgagcattcgagaccacacacttaaaaacttaacatataacagagtcagaaggaaagatgtacaacatagtggcagaggtcagtacctttaca

SEQ ID NO: 678100 - DNA, 116 bp, Homo sapiens
atatagtggtaccattttatctgaaggctgtgtgccaagagtctccagctgcagctgcaggccccagtgggaacacagttccagctcggggtggccttcctatcacccagccttca

SEQ ID NO: 678101 - DNA, 139 bp, Homo sapiens
cagtgagcaagtatgaccccgaacagacgagctacgtagacgctaaagagccaccgtctatgtagcaaatagtgggagattataggtagaggcgacaactaccgagcctggtgatagctggttgtccagatagaatctt

SEQ ID NO: 678102 - DNA, 516 bp, Homo sapiens
  misc_feature (59)..(59): n is a, c, g, or t
  misc_feature (74)..(74): n is a, c, g, or t
  misc_feature (138)..(138): n is a, c, g, or t
  misc_feature (148)..(148): n is a, c, g, or t
  misc_feature (165)..(165): n is a, c, g, or t
  misc_feature (167)..(167): n is a, c, g, or t
  misc_feature (225)..(225): n is a, c, g, or t
  misc_feature (351)..(351): n is a, c, g, or t
  misc_feature (394)..(394): n is a, c, g, or t
  misc_feature (396)..(396): n is a, c, g, or t
  misc_feature (398)..(401): n is a, c, g, or t
  misc_feature (425)..(429): n is a, c, g, or t
  misc_feature (431)..(431): n is a, c, g, or t
  misc_feature (439)..(441): n is a, c, g, or t
  misc_feature (443)..(444): n is a, c, g, or t
  misc_feature (446)..(446): n is a, c, g, or t
ccgatgggaccgtgcaatccctaacgtgtccgagttaatggtcccagtacttccatgtnggggatgtaataacntaggtgtaggttgggaattaccctatatagggcctttagatatgcagtgttaattctatacgcnttgagtgtangtaacttagcttatgtnangcagtcatgaagttggtttgctccgcatcggtagtctttaaacttcttttagtgaaantgtcttgttttatcagtgctatgtgtgcaagcagtttttttattttgcttttctcctggcatcagaaagtggtggcgttttctgtactggattgcaccaaggaagcttttggggaggaaggaaggncattaaattctttccctggtaatgaaaagagccctttatcaananannnntgcaatttctggatatcagctacnnnnngnttttaagnnngnntntgacatgtttatttggcaaattttataatgaagttttaagttgaaaataaaatgtagcaacattttgatc

SEQ ID NO: 678103 - DNA, 273 bp, Homo sapiens
tgttgcattatttttttctagagatgagctcttgctgtgttgcccagtctggccttaaactcctggcctcaggagagcctcctgcctcagcttcccaaagtactgggattacaggtttcagccactgtgcccatccaatttgttcacatcttggagtttttaacctgatggaagggaagtgacttgtcgttgcttttcctgctgggttttaaaaccaccttcctccctccccagtccaatggatgggaccccaatgaaatgttcaagttcaat

SEQ ID NO: 678104 - DNA, 200 bp, Homo sapiens
actacccataaaatatatttcagagctcacagagcttcataagagcaagatgattgcaccggactaaacctatttctgcttttcctatttctttctcagactgcttagcctagcctcaccccctcggtaaagagcagttatttatctctagcactctacgaaagtttaactaagctatactaaccccagggttgtgtcat

SEQ ID NO: 678105 - DNA, 207 bp, Homo sapiens
gcgttgatagtaaagatactcttaacggactcgagttatgactcccgaaagcccatgtcgaagtcccccgatcgctgggtcaatagtacgggccgtcgtactcaaaaaaactaggcgggtagggtataataggcctcacactcattctctaaccccctgacaaaacacatagccgagcccgtccttgtacatggtgtaaagtgagtg

SEQ ID NO: 678106 - DNA, 449 bp, Homo sapiens
  misc_feature (344)..(344): n is a, c, g, or t
ccattccattccactcgggttgattccactccatcccattgcattacattccatttcattccactcgggttgattccattccgttccattccattccactcgtgttcattccattccgttcctttccatttcattccattccattccattacattacattccgttccgttccattccgttccattccattccattccattccattcgtgtggattaacttccattccattccattccatcccattcctttccattccgttccattccatttatcatccatctacccactcacccatccatccaaccttccaaccatttatccacccatccaactattccatcgntcattttccacccatttacccatctactaattcactcatccatccacctacctatccatttatcacccatcaacctatccatccatccatccatccatccaccca

SEQ ID NO: 678107 - DNA, 908 bp, Homo sapiens
attttggtccccggggtcctttctgttatagttggctctttctctacactgtgtgcccccgtgtcttttgtacaatcatccgggggccgtctatttctcccccctggtttgtcgaagttgtgctttctcaattcctccctccgtgtcgccctcaggcagttcgggtgttcattgtgggcccccccgccccttgtttcgctcagtgtgcgcctaatgtggggtgcctcgcccttccgtctttggtcggtgtgagtcacctcacccatctggtcctggtcgctaaccgttccgttgggccgctgcaggctcctccctttgggggggggcaatggaattttgctgcttctcttccctccaccttctccctcctgtttttatattgaaattcgtcctccttggggtcctcgctcccactatatccgttgtgacacctcccgtcatgacatcatacattctttcgtaacattctggtgctaccacattttctagtcatcactcccacctgcgcagcagatccctcaccacaattcatctctcactcacatagtacagacaagagatatcacttctatttctcacacgcccccccacagttgtgaaatcaaaacctcctctcccctcgtttcttctcgtgaagtaatcctctcccgcatctgtacaagagcctcgttcctgtggacaataacatcagtttcgtaggatcatttaccatctcttgacgctgccgcggggcgactctgtcagcgatgtatcttttcatcgtcgctggaaccattcttctcacatccaatgaggcgagtcacaagtaggaccacccccatgtgggtcgggcggcctttgaacttgtgaattaggaacatgctccattgtttttttaacccaaaaaaggcccccccgggccacataac

SEQ ID NO: 678108 - DNA, 233 bp, Homo sapiens
  misc_feature (14)..(14): n is a, c, g, or t
gctcggtaccgacntggccgagtcgtggttgccgcatttcgggcaggtgaagcctttgctggtgcaggagaattcaccggtgaagccgcactcgtagcactcgtcgatcggcgtgttggtgccgtagtaaggcacccgggtgtagctgtagtcccacacgtcttccagcgccttcaggttgtgctgcaggttcgggtattcgccgtagcagatgaagccgccgctggccaacg

SEQ ID NO: 678109 - DNA, 110 bp, Homo sapiens
gggtcgcttagttccaggcagcgatgacagacgtatattgggaactcatcgggtcatgagattaaaggtctccattaacccgtaggtctcttgccgatcagtagcgtaga

SEQ ID NO: 678110 - DNA, 435 bp, Homo sapiens
ttctgggtgactctagaggttcccggctatacattatctatcacattatcccagtatgttccatctgttcacaggctatttccccgttcctaaaacaatgtatggcacatagtagcatacagtagatattgctgaataatgatttgtagggaattccgtgtcactgtcggtcttttagaatgacattgtacacattagagaattatttttcatgctccttctcaaagttgatatgaatgattttcacttaatttccttttaagtttctttatgttcgagttacttcggaaatactaaaaacactttatattaacatgaattatagaagaagtacaaagttcccagtgtagataatgtgatagccggctatcacattatgacctaagaagaaagtagagatgtaagtggatgtatatacgtgtatatgtcaactaa

SEQ ID NO: 678111 - DNA, 404 bp, Homo sapiens
acgtctctacggaaggtatggagctgatgaactaactgctgacgccctgtcgtcccccagatcagtgcccgaaataccaacaaggagaggctagaagaacatggacactctccattgccgaacggtctagggctcaaggaataagcgcaaatcaatttgtggactccaggttctatcttcttttggacttaatcaccattaatatgacgagtatcagcagtatcatattaatagagcttttgatatcattgagcgcttaaagctagtgcccctaaaatcaggaaagtatggaaaaaagagtggctgccttcagaacatttcagtaattaaatcaggcacaacctctcagaagtgcttcttgccaccataaacatcttgttcacacaagtttacagaggctcaag

SEQ ID NO: 678112 - DNA, 174 bp, Homo sapiens
tttcaagatcctcagcacacacacagtcagcctgtgtgtagattggtgggggtctgtgaggtagcgggacaggctgactgtgtgtgtgcttgagcaaacgctggtatgacagtgattgaaagtacatgttgatgtggctatgtttgtgttggcataataaatttagggttgatg

SEQ ID NO: 678113 - DNA, 917 bp, Homo sapiens
cctgcctggacggcagtcattcaccttttctgtgtgctgggatgtgttggtgcctgtgaggtccatgttgcttgcactaaactcctcctgccctgcatgtgccacctgaggtcctgtatcttgccctgtgtgaattcaaccccaacttctgttggctgcgtatgatacctaaatgtggagtggtctggacgttcctggatggctggcctgataacttgctgtctgatccaggtgcctgaaatgggccggttgagggatatcgaggagaatgaggagtttcatgaggaccatgcaccacctgctgctggaggtggcagtgatagcagggcaccctgacagtgcccggaatcttggacgtatgtaccccatcagccgcgggatccccaacatgcttgctgacgtgaacgaggacacactgagagtcgactatgtgccaggcgccagctaaccttgtcaatgactgtagtataacgctgacaccactaccctgaacccgaagtctgcccgagtgctatcccacaaaccactgcacccactcgacacccaaaacacacagtgctcacaccagagacacggcacacacatacatgaaaagactacagcgacacgagagaaagaacccagcagacaggacaacgaagaaacaagacgaacgcgcacaacagtctcaccgccgctcgaacacagcagacgagacagccacgaagcagaacaccacacgagagaggggagaggcgaggacacaccagagacagcaaagagacgaacgagcagagaaggcacgggagcagcaggaacaaaagaccggcgagaacaagaaaacgagagaaaagtccccacagaaacaaacgcgagcgagaagcacgactgcatagaaaagccgacaggcgggcacagcggcacaacgggaacaagac

SEQ ID NO: 678114 - DNA, 1028 bp, Homo sapiens
  misc_feature (411)..(411): n is a, c, g, or t
gatcgaccgagtctgggacacggtcatggcgggatgctgctggaaagagagaagcactggcccatgctagagtattggaactgtgtacgatactcctcacgagaggctacagaatcattgtacaccaagattttgtaatgtttgttgaagggcaagggtctccgtaaaataagtgcctggcattatacgaagagtactcatctagcacaccaagattcaacaaactagtcgtagacgctcgcgacatagtggtcttaaacgccggaatcccagaagtgtctgaggagaactttcagaagcacccaactacactggcggtcacattaggaagacggtgattctttcaggctgtacactatatagaactatatcctggcacctgaaaaagtgagtggaatggcataactatgngaagccattacgtggaagtaggcttcgtgccgcatcagtgggaaatggccaatataattatgtgagagtgactttggtgttgttcatgggaaactgatgtaatgatattattctcgtgtatatgtaagagcgtgttcttattactgacattctagtaatcaacgaaaatgtgatgtagaacatattgtacggagaagtgttaggatttggtgatcctggttagtatggtctgtggattccattgacgattgcatgaagtatcacagcgggtggttttaagcgacggatatttggtgtgtaccgtatagggccatggtaagagttggatgacttattaatgtaacaattcctggaattgcagtgggagactataattagaagaactagatatagtatggtcaatcttcaagagattaaaaggatcggaagaagaagggctaaatatttgagtcaaaacttaggttgtgaagatatagaggagtattgaatgacaaagataacaagagtgaaattgaaagagaaacatgttatagaggcaaaatatatagtgaaaaaggatcttagagtataaattaaagaaatatatatagaaaaaaaaagaataataataaaaaata

SEQ ID NO: 678115 - DNA, 289 bp, Homo sapiens
ctgaaagaccctagcggcagaacgggtcccattcactccctcaatgtttcagctcactggcaggacagctggacatagtcgctttggagcattgtattttcctgcttctacgccactacataccagaagctgtatataccactgcctgctgattcttcgcttggggcccctgccatttaaaatataggcaaggtcagagtataggatagcttcccatgccttcggttggaggatgttttaggatacagaaaaaacttgtaaaaagtcatcttgaggtaatccgtgaggg

SEQ ID NO: 678116 - DNA, 727 bp, Homo sapiens
tactttaatatcagcttgtttgtgaattctctgaatactgtcaacactcttatctaagttgcctttatgatgcagtggcagcatttgaattacttttcaaagaatactgttcatatgcatgttttgtgtttcaaactaaatacaggcagtttgtgccagctgtgatattgggccttccactaatagtggccacattatagagaatcatttaaaatatcaagaatagattcaacaattacattacttgctttcacattttaaaggcactttaaaaaaatctacttctcttgtaggtttgcggctagttggctattcaagaaacctcgcccctctgaatgtcatactgtaatctttaaggaagaacagctacatgaattaattgtactctatgggaaaatttctttggacagatatttgtaaaaacttttttttccaagtaacaactttatgaacctggtctcgcaaagaaacacgaagcaacacaaaaaacaaacaaaaccaatggtcagcggcgcagagcccgtcgagaaagacttcaaacacaatgccttggggcccggggcccaataatcggataagagaacccggggcacaagcagggacccaagagaccctggacacgaaccaagtccgactctcacccataaaaaaccgctgcggcaccgacctctagaaacacaaggcggtcgaagacaaagaccctccaaggccaagaagacaatatacc

SEQ ID NO: 678117 - DNA, 295 bp, Homo sapiens
  misc_feature (32)..(32): n is a, c, g, or t
  misc_feature (155)..(155): n is a, c, g, or t
  misc_feature (285)..(285): n is a, c, g, or t
  misc_feature (287)..(287): n is a, c, g, or t
ttttttgagatggcgtgtagctttgtcacctnggttggagtgcaatggcgcgatctcggctcactgcaacctccacctccacctccagggttcaagcgatttacaggcgcccaccaccacgcccagctaatttttttatttttagtagagacagntttcaccatgttggccaggctgatctcgaactcctaacctcaggtgatccacccgcctcggcctcccaaagtgctgggattacaggcttgagccaccacacctggcccagaacccatttctttataagcncngcctatgg

SEQ ID NO: 678118 - DNA, 136 bp, Homo sapiens
  misc_feature (16)..(16): n is a, c, g, or t
ggcaccgggaatgtantcgattggcccagtcgtaagtgctcctgcctagaaggcgggttttttaaagagagaagatgactttttaaaataattgatgtttttttaaaatgtacagaaaagtaaacaacatatatca

SEQ ID NO: 678119 - DNA, 113 bp, Homo sapiens
  misc_feature (98)..(98): n is a, c, g, or t
aacggctctgaactctgagcagaaaagtcaatgagcttcggaagcagcactttgccaccttcatcgctcttcaggaaatccagcaaactgcccttgancttgccatagtgcaa

SEQ ID NO: 678120 - DNA, 191 bp, Homo sapiens
taaggaaatgacatgaagcacaaccctcgctccgccgacttcgaattcattgacgccaccttgctcaaatacggcgaagaccactcggtgctgaacatggccgaactcgacggttatttcaccgccctggtttccagcccggccaaggtgatgtgccgagtgttcccgcaatctggggtgggcaaaaccct

SEQ ID NO: 678121 - DNA, 135 bp, Homo sapiens
ctctggccccccagtctgcaagagcagtgaggtgctgtatgagcgcccccaaccaacccctgccttctcctcccgcacatcctacagttggaaatccatccagatgccatgttccaataaacaggaggtcgtgta

SEQ ID NO: 678122 - DNA, 289 bp, Homo sapiens
cataagtttctggatagaatacaattctgctacccctcgtgttacctaatgtttcagcctctgctccgctcacgtaatatatgacaacatagtatctcccttgcacgggtcattgtgaagacttcgtttatttccacggaagggcctacagatgtcttttctcgcatcattttttggctagtgtgtgtgtgtttgtgtgtgtgtgtgtgtgtgtgaatcagcgcctaatagcactatatgcacagaattatactgttcctcctgtagccatgaatgaagatcagaatgc

SEQ ID NO: 678123 - DNA, 1000 bp, Homo sapiens
gcacaatcggggacgactctggctgcggtgaggtatctgtacaaagtgctcacggactaagaacagtgaatccctctatgggtgaggttcagaaaggcaagaagatgctattatgtgtgaagtgtgacccagctgcccctaccgtatgacccggccggccacgcgatccaagattgggagcacaattctgcatgtatcttctgttggccctgactcaacattccaggcgcccatggtctactcgtttaacagcagtccgccattaagaacaaagggacatccatcgtgggcgagagcactactacgtgaataggaaggtactcgcatgaatcccagagaagtatcagtcggcgtgtgacactagagaaagtgatcttgaggcggtcagttaagcatggaaggaatgatacttggcatgactctcatagcgttgatcgtcatgcaagctactaatgagtaataattggcctattgtctaatatattaggccttaagaaatgtctgatgaaatttggatgtgtagcgattgcgtaaatagatctgatgacaggagaattcagatcttgagatgattgtgcgaatatttggttggtcgtggccctgattctaagaatgtcagcggagtggctttgctgggtcaaagagagatagtgttccaggttgtgggagtttccagtaaggtacctaccgatttcgggtaccgtggaatcatgggttgaccccgtttaaagattgtgctacaccgttcgtgcgaaccggtcgcggttggtccacaagaaggtgacggccatcttaaagttaccggggacgggtaaaacggcgcccaacaacctgggccgacaaaattttcccagcagggcacagggcacgcgtgagcccaaaggcccggcgtcggcggacagcacttggcacagggggaggcaacagcacagcacaaggcagagcagcaataccggagaggacccgacattgcggaacagagcccaaacagaatcgcagg

SEQ ID NO: 678124 - DNA, 883 bp, Homo sapiens
gggaccgtgaccgaggaaacccctggagggacttggacattccttgggctccgtgcctgttcttcgtgctcctttacgggcaaggatctcacaattatcagtctttgaacgacacagaatgcctggcatatgataagagtgttctgtagaacgttgaagagacatatggacaagtgaatctgcaatagatactggggagagactaccaatatcatcacgcgcagaccaagagaagttccttcgatttggtcccactgggagttccggctggtgtgagagatctcatgaggaccacgccctgtgcaacagactcgtcaagacaaatgacgcaggagcccccccgattatgcgggacatctcctaagagccatgtatgtgctcaccatccatacgattcagttgattcagcaacaaaccgagggtattccgcgaaccttatggcctgaagctcaggcctaggaatcgagcgagcagacaaagaacggtgtaaacaccctgagagaggagtgaagctcttccctcgtgccgcagggttgagtctccctgtgccctgattgagctcctggccttgtagcatggtgaccagtccctattgcgcgcattccgcgagcccggcgactgtgtccctaggagagttgacctgtgagatctgtggccactggggtgatccttgtgacttgaactcagctggcactccgtgttcgggggcctccttcgtgccaggtagggggcaggaatcgtggcccacggcgggccttgtggcttgggctcaattgacacagtgtcctgggaacccgtaactgagtgtgggcagtgagtatggccgtacagtttaccaagttagtccgtttggtgtgagcaggggtcccgcgtgagaagtcct

SEQ ID NO: 678125 - DNA, 143 bp, Homo sapiens
cgtaacagtagatgcggagctggagaattcgcggccgcaggactgccggctgaaattctccggaacactagattgtataggactctgccttgatcaggtgataatctagaattttcaaccgtacaggcacatctagcgtgtat

SEQ ID NO: 678126 - DNA, 962 bp, Homo sapiens
ctcgcgcctgtaatcccggcactttgggaggccgaggtgggcggatcacctgaggccaggagtttgagaccagcctgagcaacacggtgaaaccccgtctctactaaaaatacaaaaattagtcaggtgtgggggcgggcacctgtaatacccagctactcggaggtggagttgcagtgagctgagattgtaccactgcactccagcctgggcaacagagtgagactctgtctcaaaaaaaagttacagcaagacttttcttatttgagacagggtctggctctgttgcccagtctggagtgtggtggcatgatcatagctccttgcacctttaacctcctgggctcaagagatcctcccacctcagcctccccagtagctgggactaatttttttagttggtaggggatggggtctcactattatctggcccagccgggtctcgaacttcgtgagctaaacgtcatcctccgtgccttggcctcccaaactgggggattacaggtatgagcagctcgcccggtcctcaaattacttggataatggaccaaagagacagatgtgccatgtactcaaagttaaaaccccctacagttccaaattctgggcctgtattctatcatatcttgccccttctggtccgagcccgtgtacgggaggcccaagggaaaatgaaggggttggaaaaagtcaaccccacggcagacctcaagaccaagaattggggagggcaacacgcagctcaggggacagaggggcccaagggggcgggccaacatgaaagagggcaagtgtaccacagacatcatgcccacatccgggcacaatcccagcaaaggagaaaaccaactggggacccttaacggcgagagtaccaccgatcgagggggaaaagagcaaagaaggcacaaataaggtaagagggacactaaagaggaaaacacaggcaaaagacaggagaa

SEQ ID NO: 678127 - DNA, 948 bp, Homo sapiens
  misc_feature (809)..(811): n is a, c, g, or t
aacccggctgggtgggtgggaagtgtggctggtaacctggcagccgcggagagagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcagcattgggtttttatacctcaggttccttccagactcggatgggagatgccattggaatcagtcaggcgtctatgagtcgttgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccaaatgctgaagacctctcctatgtgaaccgaaaaggcctgcattctttaaactgcctgatggtgtgtgaccattagagggacactaattgaccgtggaagacaaactggcccggcagctacaggactgtgctgtgctgnnngcagtcttccctcagtagtcagtttgaagcggggtttgcacacaagatatactgggcttcttgggttacacaatcccttcttttcttcggaaccctggttcatgaaacccactttccaatttcttgaaaattccagg

SEQ ID NO: 678128 - DNA, 328 bp, Homo sapiens
tccactagtgtaggcccgcgcttggacagtgacgagggcagggagcacacatgaatttctgcggttgaaccttctagaggaagaccagacagagggtcaacagagttgacaggtgaatatccttgtggatgaggtccaagttgttagtttcagagactaggcatatggataatatttacgtaggacattctggaacaggagcttgtggggcaagaagggaaggaacgccatctagcggcactctgacatctttaacacggcttgtcaaggcttactatattcatcgaggcattgtaccaactgtgcccgaatctagattaaaaatttt

SEQ ID NO: 678129 - DNA, 380 bp, Homo sapiens
attcggtcctagaattccaaaagaagctacacatcagacttcctgagacctctgctgtggattacaattggactattctctctaataagtgggagtttctattggtaaagactgaacctctcagagaaaagatcccaaagaactttggttctcaaagtgcgatcccgggaccagcaccatcaccatttggcaatttgttagacatgcaaattcctgggttgtgcttcaaatacactaaagcagagactctggggtgcagcatccggcgttatatataacaaggctgccaggggtttctgactacattgacgtttgaggaccattgccctacaaatagcagcttgtcccactttctatttaggtagtttcaacccacatgg

SEQ ID NO: 678130 - DNA, 267 bp, Homo sapiens
agcctcgattacaccataaactggatcttctccgacaatgacggccgcgtacagcaattgtttcatccacaacgagcacataaccttgttttaactctaaatcggtagcaattgtatcttgattgggatacccatttgccattggttaaggccttgttgcttcaaatactctcgtccattatcgatgattgctttgatgtcgtggcaagtcatctgcgtgcgcttgggtggttaatactgctggcatatttccaaggtaattcaggg

SEQ ID NO: 678131 - DNA, 389 bp, Homo sapiens
  misc_feature (4)..(4): n is a, c, g, or t
  misc_feature (18)..(18): n is a, c, g, or t
  misc_feature (29)..(29): n is a, c, g, or t
  misc_feature (46)..(46): n is a, c, g, or t
  misc_feature (272)..(272): n is a, c, g, or t
  misc_feature (280)..(280): n is a, c, g, or t
  misc_feature (283)..(285): n is a, c, g, or t
  misc_feature (294)..(294): n is a, c, g, or t
  misc_feature (388)..(388): n is a, c, g, or t
caanttacagtggcaaancagatgaatgntgagaagacagcagctngattacaaagattttaaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggatncagtattncgnnncagaggccnttgctggctactgggtgttagtttgcagtcctgtgtgcttccctctcttatgactgtgtccctggttgtcaataaaatatttcctggcctcctng

SEQ ID NO: 678132 - DNA, 190 bp, Homo sapiens
ctaagggtggcggggatcctaaataaaggctgctttaattggcctgagagggagtggcaggaaggcagatcagtgaatgctcccagctggacaggaagaactggtttagtactagcaagcccagccaaacgagagcgagcaggacagcctgggatactgagcctggcgttcccttccaaacatatggggc

SEQ ID NO: 678133 - DNA, 142 bp, Homo sapiens
gaatatgactcaaggacggggtcatcactgagggccatgatggactgccgggtgtagccagatgctgtccagcagtacctgacagacgatgcgctggcttgaaggcggagtggtgcctgagtgcgcgggggtcagagcaccc

SEQ ID NO: 678134 - DNA, 1241 bp, Homo sapiens
  misc_feature (1136)..(1136): n is a, c, g, or t
ggctggagctggtgcctgggccctgagctggatctgctggtgctcgtggctgcgtgggctccgtgctgctgggctgctgtgtgcctgctgatggctgctgtgagctttgtggatgctgtgatgcccatgtgcctgtgcctgctgctgtgtgccatgaatgtgtgcaatggatgtgatgaatggattgtgctgtgctgacactgtgctttgtgtgctgcttgtgctgtgctgtgaatgcccctgatgaatgatgccctgagctgctgcagtgatgctcaatggatgcatgtggcaatctgtcttgttctgttgtgtgcctgaaatgtaccctggatgtgctggctggccttgctactggcctgctgctgatcaccctggaagccctgcttggtggccgtgtattacacctaacctggtgccattggtgcttaccctgagagatgcaagcatgcactgagcaaggccctgtgcctgacatgcctgtggctgctgccctgggagcttgtggactgtgggcagtcttgtgaagggcgcacttcttcctggtgtgcagtgccatgctggacgactggacgagctatgatgatggccatcgccaatctgcagctgagcttacatgcctgggccaatggatgcagctggctgaacttcggggacgacatccccagctgctcttcgaatctggcgaagacagaatgctgcttggacacatgcatttgacggagcggcgcatccaaccaggagagcgagctgcaactcctacctctccaggctcattgccgctggaagcgtgagaggggagctgggaagagttgccagggaagaccacgaggggtgcttgaggaccgacaggcaacgttcgggccccaagcaggccctgcattgagggccaagcacggacgatggtacattggcgggacatttgacggagctttatttctcacggtggcattgtggaagcagggaagacagcgggaacatatccccggagtataacctttgttttggccaaggaatcaaccgtttgtaagacgtagattgtgggagaacgaggtgttatatgaccccgatgggatcatccttctgaacgcctggaacaattagtgagagaaacctgcgcgcagcgtggtgatgcnacatgaagccgccagtaacctgagaacccactatatgagaaagatgctactctcagcggattgtagatgtgagaggaatgaaacatcaaagatagagttgagcac

SEQ ID NO: 678135 - DNA, 564 bp, Homo sapiens
  misc_feature (110)..(110): n is a, c, g, or t
  misc_feature (114)..(116): n is a, c, g, or t
  misc_feature (118)..(118): n is a, c, g, or t
  misc_feature (122)..(122): n is a, c, g, or t
  misc_feature (130)..(130): n is a, c, g, or t
  misc_feature (135)..(137): n is a, c, g, or t
  misc_feature (141)..(142): n is a, c, g, or t
  misc_feature (145)..(145): n is a, c, g, or t
  misc_feature (147)..(147): n is a, c, g, or t
  misc_feature (150)..(150): n is a, c, g, or t
ctgttccttgtgtgtcccccggttggctactagtcacggttggctctagtccacggttgtctactattccacggttggctactagtccacggttggctactagttccacngttnnntnctgncacggttngctcnnntccnnggntngcnactagtccacggttgtcgactagtccacggttggctactagtccacggttggctactagtccacggttggctactagtccacggttggctactagtccacggttggctactagtccacggttggctactagtctccacggttggctactagtccacggttggctactagtccacggttggctactagtccacggttggctactagtccacggttggctactagtccacggttggctactagtccacggttggctactagtccacggttggctactagtccacggttggctactagtccacggttggctagtcaagtcgcaagcagtgggagtggagaaggaacaaagcaatctgtacctggttcgcgatcattagttgtaacaccactgcactcggaccagccacccgtggact

SEQ ID NO: 678136 - DNA, 332 bp, Homo sapiens
cggtacccgggatgagatgattttctgtctaatttatttagctgtctcttttccaataacttttcctccactcaaccctagagttgaacagagacaggccttgatggaacggttcaatgcagccaaccgtggactagtccacggttggctactagtccacggttggctactagtccacggttggctactagtccacggttggctactagtccacggttggctactagtccacggttggctactagtccacggttggctactagtccacggttggctgtctaccctcccctagcagggaactactcccacactggagccaaccgtggactagt

SEQ ID NO: 678137 - DNA, 147 bp, Homo sapiens
gtaacctcagtgcgcttactgcgctgcactgtggagtggcgccctaatgctgtcacccaatgcacactcacttaaagaaaaaacgagttctttcgttctgtgcgcagtttaaaattgggcgcccttacattctccgttgccacttcc

SEQ ID NO: 678138 - DNA, 316 bp, Homo sapiens
  misc_feature (197)..(197): n is a, c, g, or t
  misc_feature (199)..(199): n is a, c, g, or t
  misc_feature (205)..(206): n is a, c, g, or t
  misc_feature (213)..(214): n is a, c, g, or t
  misc_feature (216)..(216): n is a, c, g, or t
  misc_feature (220)..(220): n is a, c, g, or t
agatcgagctgttacgtccacggttggctactagtccacggttgcacactagtccacggttggccactagtccacggttggctactagtccacggttggctactagtccacggttggctactagtccacggttggctactagtccacggttggctactagtcccacggttggctactagtccacggttggctgtgcntnccgctnncagtggnngnccanttgatggcttcagaaagctttgagtggacagaggcctggtcgctttctacgcacatcctgcatattttggagaagcctaccaaccgtgatggtgtg

SEQ ID NO: 678139 - DNA, 564 bp, Homo sapiens
ttgacgatcggtctactcctcacaactactgagaaagtcacaccccacttctactggtgaggaaacagaggcttgcaggcttagtagtcatgtagctagtaagtggtggttctttccaccagaccacactgtcttccccaagaggcatttgttaaccctgtgcggagccagccaaaccacaggctccatgactaccgggaaggtaagggccaggttctagttgaccagaactggtgaagaaactaatctttgcttacagggagaaaccacaggacatctgcttcctttgagcaagtgaaggagacacaggaaaagaggtcctggtgaaaacacgactttcagaagttatatctgagccttccaggaagaagtggcaatcagagccataagcttgaagtgtggcgaggaatcggaagggctggactggaagctggcttccttatccggccacggcctcaggaacaaggcagctgtaggctgtcttgaccccagtcagcaacgtggccttggcagactgcacattgaaggtgatttggggagggcctgaatctcccagcatgcctc

SEQ ID NO: 678140 - DNA, 260 bp, Homo sapiens
  misc_feature (171)..(171): n is a, c, g, or t
  misc_feature (254)..(255): n is a, c, g, or t
  misc_feature (258)..(258): n is a, c, g, or t
cggtacccactagtccacggttggctagtagagagccgtcttatccctatgtcttcacagtgtcctccccctgaacgtgtctgtgcctaatttcttcttcttatgaaggcaccaatccagactgcagcccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 678141 - DNA, 271 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (182)..(182): n is a, c, g, or t
  misc_feature (265)..(266): n is a, c, g, or t
  misc_feature (269)..(269): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 678142 - DNA, 512 bp, Homo sapiens
  misc_feature (69)..(69): n is a, c, g, or t
tctagaggactccccgctctccacccaccccgcgtctcacagacaaaaacaaaaaaaacaaaacaaacnaaaaaactctgacagagatgtctgcctccttttcctctgcccttcctttctcttagggacacaggtatcactaaaaacttgttgaaaactaggctgggcatggtggctcatgcctgtaatcccagcactttgggaggccgaggcagggggatcacaaggtcaggagatcgagaccatcctggccaacatggtgaaaccccgtctctgctaaaaatacaaaactagctgggcgtgtcggtgcgtgcctgtggtcccagctacttgggaggctgaggcgggaggatcgcctgaacccaggaggcagaggctgcagtgagcccagatcgtgccactgcactccagcctgggagacagagcgagactccatcacaaaaataataatgataattctcaggatgggactgtgaataactttccgggtcacactggaaacaagcgacgct

SEQ ID NO: 678143 - DNA, 606 bp, Homo sapiens
aaggctcgtaaaaggggcattggcgaaacgaaaggggcaatgtctgacccgagatgatgttctacgtgtaatgcatctcatttcccccaaaacctgctcacctgcagcacagaggctctggacaacgtagctcagcatgtactcattttccccaggaaactgcacggccgacaaggcacagcaaaacgctgcacatgacgtgctccatttctcaacgggatgaacaaaacaggctgctttcttggcatgctgcacgttcacacaatgtactacattgcccccaacaaaagcaaagagctagattttcctgcgctagcatgcactcacttggccattgactacaccactggaaagcaagagtctgtctatgtgggctggattcctgaactacagcttacaagggaagggcgtagaatatcatcattaactggctcacaaggaatagtcatcttgggcgaacacatgctaatacgtttcacagaatgaggggtgacagtctagaatccacaatgtgatgtttggaacatttctcgccaaaccttactatcaaagccctggagtgcacagaagagacatgtcgggtaatgaattggtgttccctcagac

SEQ ID NO: 678144 - DNA, 213 bp, Homo sapiens
cgcatctaggtcttgtgttgtgaaaagaggtgaatggtatatatatatatcttcatctatatctatatctatctatctatctatctatctatctatctatctatctatctatcttccttcctttttttttttttagggaaacaaattttggccctgccccccaggttgaattccagaaccagaacctcagttcatgtgcagcccccccccccg

SEQ ID NO: 678145 - DNA, 2124 bp, Homo sapiens
  misc_feature (1020)..(1020): n is a, c, g, or t
gagatgatgagtgagcgagtactgtatgtgagtagttagacggagttggctcagttgtggtgctgtgcgaaaattattataacatctccgttgttgtgttactacgactgcaggtggttggtgtagaccgctgattagtcagcatcgtgagtggtgtgagtacacatggtgttgtgcctacgatgagtgtaaagcgtcggggtgttgtgtagaggaacgtgcggacgtcggcagttagtatgaatataggcgctgtcgtgctctaagataggtttgtgtcttgggacgactatgtgtgtgtgtgtggagcaaaagtttgtctgttgtcatctggaggtggtgatgtcgtgtgattgtgtcgcgtgtgacggtacctgtacggcgctggggacatcacacaggatgcggtggaggtgtttggtcgacttcttttgttgagtagtggctgtagtcggatcagttgttgttggtcgcatcgtgctggtgggtggtatagtactcttgtatgatgatctgctattgtggttgcggattctccctgcattgcgtggggtgtagatgaacggtgatgtcgtatttcggtttcttattgtgaaaagaatagttgttggggcgggtttgcttcgaatgcagtgaggagggacatcataagctactggagtggctcgtgggaggggtgtgttgtcagaactgagcagctagcgaggaggtgtgtgatggagatggatatgtgcttggatgcaatgtgacattggtgggtcgcagtaattgagatgatggagatacaacatctggcgtggtggactgacttaggtttggaggtgggagggatagtaggtagggggacggtgtatttacaggcagagtggtgcgaatacacagcatctgcgtggttggttggtgggtggtgagaagctaccagcaagcggaggagggttgtatacgtggggcttcgctggtagtgttgtgtgggttaggaggtgaggatgtgtattgttgtgtaagtaggattgttggttncagctggctttgcagataaggtgagtgagtctgagtgacagacgggagcgactgtagttgggttgttggtgaggtaggaaggttgttttaggtagtcgacgcgactcaaaagagtgtttcagcgagtgagagtggttgttagttgttgagatgaatgatatgggggcgacagtaggtggtgtgataaagctgcgtgttggtctgtcgggggggggggtggcaagaccacgaactcttgttattgtattattacacggcctattatgctgctctctcgtcggggtgaggtgttccactctactgtggctcacgacgggtttctcgcgacgcgtggagtctgagagccgcactactcatctcgcagcgcgcgtatgatattgactgcgcggcgcagcccactcacagcatgtgtttctttgtcgcgccgtggtgtgtgtctctcgcgctggtggttgtgcgccccacgatgtgtgtgtgtactctcgtgtgatatctgcttgttggagagtgttttctctcgggtggggggcagctctcgtgggcgcgcgtgtttggcccctacggtcgcgccgcgtggtcctgctcctcccgtctcttttcccgcgacgcacgctctgtgtgctctgtcgtcgagcagctccgtgatgactattctgttgagagagcacctacggctcggtgtctctaacacagagagcggcacaccagcgctcgtgggtgcatctctagaggagccagcacctactctctctctactacaccacgcgccacgtgtgtgtgtgtggcgccgtcgggtgtgcctcgtgcgtctgcgctgtgttgttcgtggaggagcgtgattgtcttattttaaatagagagagagaggttgtatctcttgttttatacacgtacagagagagaggagagtacacacgcaccgtgatgttgtctcacagagaagaatatacacaccacgctatcgagagagagagtgaggtgatgggctagcaggtggataccccagcttgttcgtggcgcagaactcaataagtgattgttctccccctcgataatatagtgcccagggggtcctccccaacggaaataaaataaaataagaat

SEQ ID NO: 678146 - DNA, 172 bp, Homo sapiens
agatcgagctgttacgtccacggttggctactagtccacggttgccacggttggctactagtccacggttggctttctactggcaatcatggagactgaagagcctcctccaccaggagtgaaacctgaagtagaactctccaccagagtagctttcagagccaaccgtgga

SEQ ID NO: 678147 - DNA, 452 bp, Homo sapiens
  misc_feature (69)..(69): n is a, c, g, or t
tctagaggactccccgctctccacccaccccgcgtctcacagacaaaaacaaaaaaaacaaaacaaacnaaaaaactctgacagagatgtctgcctccttttcctctgcccttcctttctcttagggacacaggtatcactaaaaacttgttgaaaactaggctgggcatggtggctcatgcctgtaatcccagcactttgggaggccgaggcagggggatcacaaggtcaggagatcgagaccatcctggccaacatggtgaaaccccgtctctgctaaaaatacaaaactagctgggcgtgtcggtgcgtgcctgtggtcccagctacttgggaggctgaggcgggaggatcgcctgaaccttggactgggaaggtggaggttgtggtgagccgggatcgcaccattgcactctagcctgggcaacaagagcaaaactccctctaaaaaa

SEQ ID NO: 678148 - DNA, 606 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (517)..(517): n is a, c, g, or t
  misc_feature (600)..(601): n is a, c, g, or t
  misc_feature (604)..(604): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgacgagggcaccacaggagtgagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 678149 - DNA, 911 bp, Homo sapiens
atgctatgtcgtagaacagggcattaattttgtttacagcgttttatgtgccccgagtcccgccacgcgttgccccccgcggttgttaaatctagccggggggtaaatataattcgcaaagtggaaagaaatgtgtcgaaacgcctgaagaagagtggaaatgcccaaaacacctattgttttttgcagggctataaaaccctgggcggtcgcagaccaacaaatagtctgcgtgaaacgggggcatcaaccgcgctttgttttggcagtccttctcggggcgtaactacacctctcttcgacagggaaataaagcatattgtccgttgctccgcatcctgagaccgcagccaagcaaagtacgttaccccgttcaagatattttagtagttacactagcctcggttgctcgagcaaattctccgcttcacaataaaaggggttcttttggtggtaacacgtgtcttcgccaatatgacgctcccttttaaagagagactcttgtatcgccattgaacccctgtcgttgtcgacaaaccactatttgtgtgacctttctcttttactgagaagagaaaataatttccccccccccttacatggcgactttaatggtcacaaacatacaccgaaaattactaaaactttttccccaccaacatgtcacacgacatcgacctcaatactcccccacacccgatggacttacccataacctaacatccttcaacaattgtttaaaacccaacagagtcaagaacgatctctaaatatcgatatcaacacaccaacagacttctagactacttctcttcttacacaaaccatccaactctctctcgtgctcctttaaccctttgtagcaattttttccagcttatataaaagcacaccccacaagccgcaagcaa

SEQ ID NO: 678150 - DNA, 636 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (401)..(401): n is a, c, g, or t
  misc_feature (430)..(430): n is a, c, g, or t
  misc_feature (547)..(547): n is a, c, g, or t
  misc_feature (630)..(631): n is a, c, g, or t
  misc_feature (634)..(634): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgagccgaccgtggagccaaccntggactagtagccaaccctggactagtanagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 678151 - DNA, 586 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
  misc_feature (497)..(497): n is a, c, g, or t
  misc_feature (580)..(581): n is a, c, g, or t
  misc_feature (584)..(584): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgagccaaccgtggactagtagccaaccgtggactagtagccaaccgtggactagtagccaaccgtggactagtagccaaccgtggactagtagccaaccgtggactagtagccaaccntggactagtagccaaccgtggactagtagccaaccgtggactagtagccaaccgtggactagtaccaaccgtggactagtggnnagncc

SEQ ID NO: 678152 - DNA, 357 bp, Homo sapiens
atgggtctgcagcaacctcaagtctcctcagaagaaagaatttgaccaaggggcataaggcagaaggagagacccgggcaagcttcagagcaagagtggaagtttattaaaaagcttcagagcaggaatgaaagaaaaagtacacttggaagagagccaaacaggtgacttgagagatcaagtaaaacctcattaacgtaactgcaacaatgaagacattacctagacgtgctggcttcctctttgccttcctccatgatgtaagtttcctgaggactccccagccatgcttcctgtacagcctgtggaactgtgaaccaattaaaccttttttctttataaattaacaaaaaaaaa

SEQ ID NO: 678153 - DNA, 643 bp, Homo sapiens
  misc_feature (20)..(21): n is a, c, g, or t
  misc_feature (32)..(32): n is a, c, g, or t
  misc_feature (39)..(39): n is a, c, g, or t
  misc_feature (41)..(41): n is a, c, g, or t
  misc_feature (44)..(44): n is a, c, g, or t
  misc_feature (54)..(54): n is a, c, g, or t
actagtccacggttggcttnnaatatgccttncaatgtnanctnccaattccantccagcgtagactagtagccaaccgtggactagtagccaaccgtggactagtagccaaccgtggactagtagccaaccgtggactactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtccacggttggctactagtctacgctggaatggaattgtccacggttggctactagtccacggttggctactagtccacggttggctactagtccacggttggctactagtccacggttggctactagtccacggttggctactagtccacggttggctactagtccacggttggctactagtccacggttggctactagtccacggttggctcacaccgtgcaatcccagcactttgggaggcacaaggcaaggcagatcacctgagctcgggagttcgagaccacaacacgtgactagt

SEQ ID NO: 678154 - DNA, 156 bp, Homo sapiens
gtgatgtacatgagatatgtataccaacctagtttgttgcttctgactatctcacacacatttaagactttaccatttttcagtgcacttttcaatgttaaacaaaattaaatccaattcttgaaaatcagtttgacaaacaacccccactccata

SEQ ID NO: 678155 - DNA, 203 bp, Homo sapiens
  misc_feature (25)..(25): n is a, c, g, or t
aaccagggactgcgatcctgacgtngacatcgagtagtactccgatggagcccccattcgtattataatacatcacagacgtctgcgctcatgagctgtccccacataaggcttaaaaacagatgcaattcccggacgtctaaaccaaccacttttaaccgctaacacgaaggggggatggacacacgaaagggggatggaca

SEQ ID NO: 678156 - DNA, 379 bp, Homo sapiens
cctatacgcggtccggggtggatccatgaacctggagaaacggaagcaagaagattaaacagctcatccttctgttctaaagctgtccctactgccagcacccccgagggaaggctaatctctgtagacctcagcaacaacaagccaggctgggcaggagcagggcccagggtatctgagacgcatgtgagtcccgaggctggaagctgaggcaccaacactggcattgtattactgtaggtggcaatgaccgcctgttaccccttccctcctatcatgcaccatgagccggccttgccctcaagatgacctcagcaaatgacaagagtaggcatgccaaagccataaagccataaacatggctggaaagggggcaggg

SEQ ID NO: 678157 - DNA, 788 bp, Homo sapiens
  misc_feature (344)..(344): n is a, c, g, or t
  misc_feature (411)..(411): n is a, c, g, or t
  misc_feature (496)..(496): n is a, c, g, or t
tgtgtgaggatcccggggccgccgcgctcgctcgggccccgtccagtggcccgtcaccatcacgctcaaaacgctgcaggcagcggaccttcaaggatccgcatggagcctgacgagaacggtgaaggggctaaaggagaagatagaagctagagaaggggtctgttgatgcccttccccgtgcgtccgggacagaaatcctcatctatgccggctggatcttgaagtgacagatgtccctaatcagaggtagctatctgcgatcgagtagagaaaggaaaggcgtgttcgtggtcgtcaatgagtgaccatacgagccagataggcccggtccacggtggttnaccatcagcagcacccgcagtatgcgtccgtgcatcccaactaggcatggcactccaagatggtccntcgtaactgtcctcggtaccctgtcctgaacacgtaatacaattacgtgcattgtgcctaattctactgaaacgtgtccaagaancgaaaggtagtcatcgaaagaaggacacgcctccaagtatagacacttccctgtctgccaaaagtggggtacctgaggaaaacagttccaccagaggctattggttcggcactttcataggggtaagccatgctggcctctgtactaaaggggcctgttgccctccctggctattggggattattcccactagcggaaagtcattacatggtacctagggcttccggtgcaaagatggggtagcgcaatgtacaaacgcataactgggccaaggagggggcgcgccctggtg

SEQ ID NO: 678158 - DNA, 116 bp, Homo sapiens
gtgcatagtcattgaaagaggggaagcgcttgcaaattcacgagtcatcggagtagtcatcgctgggttgcttggcggatggcaagttgggcttggtgcggagattgatcgcctgt

SEQ ID NO: 678159 - DNA, 682 bp, Homo sapiens
  misc_feature (6)..(6): n is a, c, g, or t
  misc_feature (56)..(57): n is a, c, g, or t
  misc_feature (125)..(125): n is a, c, g, or t
  misc_feature (144)..(144): n is a, c, g, or t
  misc_feature (206)..(206): n is a, c, g, or t
  misc_feature (454)..(454): n is a, c, g, or t
ttctcntgcctcagcctctcaagtagctggatcaggcaccaccacaccgcgcgggnnctattttttttttttgtaatttttagtagagcagggtttcacgtgttagccagagtggtcttatctgntgactcgtgatcaccctcnctcagcctccaaaagtgctgggatacaggcgtgagccactgtgcccggcccagttttatttntttgttgtgtctccaccaggttttggagtcaggatgatgtgggcctcacattgaagttaaggaggagtccctctttctcagttttttggaatagtttccgtggtaatgataccagctcttcttgatacacctggtagaatttggctgtaaatccatctggtcttgggcttttttcggtttgaaggctatttttttgctgattcaatttcaaagctcattattgctctgttcagagactcaatttcttncccggttcagtcttgagaaggtgtatgtgtccaggatttattcgtttattctagaatttctagtttgtgtgcatggaggtggttatggtagtctctgagtagtttttatatttctgtggagtcagtggtaacatccactttctcatttctggttgtgtttatttggctgttccgtctctccacccttcgctgtgtccgtatctcaataaagagaatctgctctcttca

SEQ ID NO: 678160 - DNA, 106 bp, Homo sapiens
tccgggttgtgtgggctgggctctggtgcctcttcctggccaggaccctctcctcctgattcccttggcccttgttctttctgtctgtttactcattgtctccccg

SEQ ID NO: 678161 - DNA, 161 bp, Homo sapiens
  misc_feature (60)..(60): n is a, c, g, or t
ccggcgccctctgtgggactgggtttcccgggcgaaagactgaattccttttcccatttntggcatccggcccccgtggaaagggctaaggttggggggctgttccgtctctccacccttcgctgtgtccgtatctcaataaagagaatctgctctcttca

SEQ ID NO: 678162 - DNA, 147 bp, Homo sapiens
cggacctctcgaaccatgactcaagtgatccacctgcttcgtctttcaaagtgctggaattacaggtgtgagccaccacgacctgcatccacttctcaaacagtccttttttgcgtccttgtcctctttttcttcctctttctctgc

SEQ ID NO: 678163 - DNA, 1678 bp, Homo sapiens
  misc_feature (441)..(441): n is a, c, g, or t
  misc_feature (494)..(494): n is a, c, g, or t
  misc_feature (579)..(579): n is a, c, g, or t
  misc_feature (637)..(637): n is a, c, g, or t
  misc_feature (780)..(780): n is a, c, g, or t
gatgctgactacccggaacagatctgactcacctccctggtgcaccagatctgaagtgatacgctagccagatcgtcatgccccgttcgtggataatgatagtaagatacgctgtcccgcgagatcgaaggacggggtataatagatcgctaacgtcgattaagtcatgacgccaaagggacataaaacgcccctcactagcgcgtctcttggctactaagtcgatcttgagcgtgagtacatcttacatgtatatgcaggcggtatcaagtggcgaagcgctgtaacgcactgccccggacaatggctagtaccgcaacttgctcttcaatgacactaggggtcaaaaggaagctattgaacgcgcttcattactagatgacgcccaagtgcctaggttgtgcgtagagggcagtgtcactgtcagagcatgagacaggnctggcaagcaaaacaagctcacactggagacacgctgtggtgggaatttgacnctcggagtgggctccaagagggcccaatcagccaaagtctgtacagcgtcccggagaccgtgtggtgacagagtcaatgacctgngtcccacgcaaagcgacaagtccatcacacattcccccttgtctgcttgagtaacatnttgtgtacacccttgctttgacgctcccttacacacggaacgcggttagaccaacgcaatcgttctatcggagcattggacactccaagcgcaataccatagataccccatcttgttctgtcagggcaaggttatgggttcangaccatagacttatgcaacaggcggggggccacactgaggcttgaggagttcccctccacaatatagtcctccagattctttactccagggcatcctaatatagtacacgggtagccgggtctttcggaaagaccctcccaacatccaccctttttacgattaaaacctaaatactataaagattctcccggcaaattccagtccatgatatacttggagaaaaggttccacgttacgggggttatacccttccagagtttccgtggagacgggccatatattcgttggagttccagaacgcgcgtttcacttcacggttaataaggatacacctttaaccgtgggcagggttggtcaattcacaaggtttagatcggagagctaataggggagcgtattttccttcgggcttggccccggtcggtcactttagaggcggctttggacctttcaacaggggcgaccttaaaaagggcgagcggaagggagacgactcgggagttggacttttaaaaaggccacgagttcgcgcacacctaggtttcggaaagcgagaagtgaccaaagcgccacaaaccaggacaagggtccgcttgtgtacttttttggttcccccctccatatgtgttagggtctcggagcacgcccactatgggtgcccacgtctgatagtgtgtgctctcaccttattagccaggcggaccacgagcggttgtccacctactgtggcgcgcgtgtttgcgaggagccccgagggcgcgcgcgcagcgccaccgaaaggttttattactcacccacgtgcgctgtgtgtgtgtagccccgaagcgatgtgtacgtccgccgcgcgcgttatgggcaagcttgcgcggcggcacattttgtgattgtggccgcccg

SEQ ID NO: 678164 - DNA, 609 bp, Homo sapiens
ctggggaaaaaaatttaccattagattcccggccaaaaggggcgaattcccgggaacaaaaaaaaaggggcgcttcccgagaaaaaaaaaaaaaacccggccaaaactgggagctgggggaaataatgggcatagaccctcccgcacaaaataggtgcccgctcaaaaaaccaaaaaacataagagccctaagaataaaggtaaaaccccggggggcctaatgggtgacttaacccacattaattgggaagcccttactgcccgctttacaaacgaaaaacccaacgtgccagctgtattaataaatcggccaacccgctgggaaaggccgtttgtaaattggtcgctttttcggttcttcgataactgacaaggagggccaggtccttcaggggggcgaagcgggttttccctactaaaaggggggtacccgggatatcccaggaatccggggagtcccccaaaaaacaaattgccgcaaaaagggccgccaaaagggccggatacccctaaaaaggtcccccctcttggcggtttttaaataaagtctccgccccaccgcagggaggaaaaaaatcccgagggtaagttaaagggggcggaacaccc

SEQ ID NO: 678165 - DNA, 459 bp, Homo sapiens
  misc_feature (82)..(83): n is a, c, g, or t
  misc_feature (114)..(114): n is a, c, g, or t
  misc_feature (155)..(155): n is a, c, g, or t
  misc_feature (203)..(203): n is a, c, g, or t
  misc_feature (208)..(208): n is a, c, g, or t
ggaagtggacgctgtgcaggacggttccggattccggggtcgataattaaaattataaaattgcgggcgcttgacccccaannataatgtcagagagcttctactatccctcanaattttcgatagataaagaaatatcataaattgagaagttnattttgtgcattgaaatagttaattaaatctttcccaatcatacttanctttnaatcggcgtcccacttccataggaattgggaacatctttttgaatatcacgggtacgaagacacaagtaatcacagcactaagaattaaaatgcctgaagtttccggagaaatcgcttttaatttttcagcaattttagccgcagctataacaagtgataaagttgatgtaagtaagaaagcagatgcaatggtagttttagtgtcaaaccagcgtctaatgtaaaatactggtatcaattttgtcgacgc

SEQ ID NO: 678166 - DNA, 422 bp, Homo sapiens
gtgtctagaggatcccgctgcgcctactactaccggtgcgcggctgaatccatgcagaccaaaggagaggttggtgagaggctcccagcttgtggtgttgacagcgtgacaccctggtccagtccgccccactgagaattagggagcaggagcaggtaattccttctgggctcagctcacgagctccaacccagaaccagactttgtagctcacctgcacacagggccctggggccttccatagaagcaaaggttcctctcctccaggcgtcccacagaggttccctgatacccacacatcttttggagcagaaggcggtgtctggaaggacaaaatggggctccactcgccccacaaatcctcttctttctccatccggcagcggccatacactttgtagccagtggctagctccaaatct

SEQ ID NO: 678167 - DNA, 916 bp, Homo sapiens
gagagaggcaaagactcaccaagagacgcgctcccccgagcagatcctgaaaacaatgtgggaaatgactgtaaaggaccgcacacctgcagtggggccccgcctcagtgcccgttgtgagtaaacggtggggtatacaaagagggcagggacacccccctttggggtcgacggaaccccgcgtagcagccgtgcgcggccccgggagccgcccgaagtccggtatatgacgtcaaaacggtcgtcgtggtgacatcacgtttagcgccatagggaaaaacctttgtctggaatcaaatactgactcctgctcagggtgtgagaaccacaccattattaacaagaaaggggcaaggaccacttagtacggcaaagatccttgcagatagaaatctccagctagaagaaccactgcgtgggtagcacgccaccacgcagcggtcacccccgtagatggatcgcaccccactgcagcactattgccagagaacagacacccacaagggcacaccattggacgatgaagaaaaggcacgtatgaaagggatctggccccactcccgcctgagtccccaaaagcagaaaggtaaccaatttgggggggcaacaataaagggaccacgagggccccccccaaacaaagggttagaactaagggagtgcccccagaacagcccatggtttgtccaaaagggaacccaaaacaacagggctggtcaaggtaaaccccggagcccccgatagcagacctccgcaattcacgccggaggaatggaagaaacaaggcaaacacaccccaaggagtccgagaatttcacgctgctatatatacaacggaggattgaagcagggaaagaaaaaaagagagagcaggttttatccccaaaaacaaaaaagggtccccacaaacaaaaca

SEQ ID NO: 678168 - DNA, 940 bp, Homo sapiens
  misc_feature (329)..(329): n is a, c, g, or t
ccagtagatatgaacaaggttggaagggggtgatgttcgaacatgtgccaagcggcgtttcattctgaggctccctctttttgcagcaaagttctgaccgccccaagtggcttgtctgtggcgcacccgtgttccgttgttttgcgcccgctcccccccgtctatttggccgcggccgattgtccaacatggtgaacgtttgcctagcaaacatgtgtgtcgataagggttgagccacaccaatgcacaggtgtgggctgtaaaacaacccccctttttgggggatccaggaaccgggatttgcgtattggggacatacgcccgtacgnattaacaagggcccgtgcagtagcgttactcacccgttccaagggtgaacaccctgttaacaaagccacaaatcactagtcccctaagcaacctgtactacactggtacatcaggcacatactccccccttcctcgagcagcctctaccaactttactgaaccaacctggttgttaaaatcgagcagtcccccaataaagtacttgttttggcccccactttttaatttgattccccgcgaaacactgttacgtccttctaatacatgcaccccaacaggcctagaacctctccctccccccaaccttctagtcacgcgaactctccccttcctcatttatgcctcatgagaagctcaaagattctttatcaccaaaaacaattttggttctccacacgagtagcctcctgtccacaatgcactgtgtcgtgcaaaatgtgcatttcacactattattcataaataagtggaaagcatatggtacaaactctactccacccgagattacttatttctggaccccccaactgacccaccgcagcacactctctgtactgcacataattgaagaaaatttccccgaaaaaactttctggcgaaccacaaaaca

SEQ ID NO: 678169 - DNA, 291 bp, Homo sapiens
tttagaagttgcaagtagcaggacatgatccgtggctggaataattcctggcacagagaagcgtatggagactaccagtgtgtggaatccaaggacccgctgtccccgtgtaatttaaagagtattccctgagcttggatgggtgcggtggctcatgcgtgtacgctcagcacttttcaaggccaagtaggggggatcacttgaggtcaggagggaaaatagaaccagcctcccttgtcaagctggttatcccgcaggcagcaatgtgctattgaaacttctaaaactagg

SEQ ID NO: 678170 - DNA, 120 bp, Homo sapiens
gaaatatttagtacaccaagtgtacatagcagctcctctaatcataatagctagccacatggacagcaacccaagtgtccatcgacagatgaatggcatgagcaaaatgtggcatacaca

SEQ ID NO: 678171 - DNA, 909 bp, Homo sapiens
  misc_feature (109)..(109): n is a, c, g, or t
  misc_feature (116)..(116): n is a, c, g, or t
  misc_feature (139)..(139): n is a, c, g, or t
  misc_feature (824)..(824): n is a, c, g, or t
ggttggccgcatccggttttatttctctagtgacatatttacagttcaatataaattaaaggcctgcttgtacaccaaatccaggggggtgggggtggtgcattcaaanaggtaangcctccacctggcttcacaaaanaagcttccactcctttgccctggttttgggattttgccagcctttgactcatcaatattttcttcaatttccttagctggcaaatcctccttaaccgtggtttatgggggggggggactcccacttagtttctaaattttattatcattaaccctttcttcttttcccattttatcttctatacgcctttttgcccaaaaattctccggttttcctcccctgtgttatttccaattgggtttttaataaactggtgacgcccgtggtggcgatggcttataggtacttagatccatcccgttgggggcgcaacacaccacccacgtaggcggtctgttttgttttttgtcccccccgacccgtattgaaggtggataggagtaagagtgtttgcccggtggctcggtgtgggcccgtgttttgagcttgttttcttccttggtgtgtgtgtggtttattccgtccaatctgtttttgctcgccggtgtttgtgcgtttcgtatgtgggggctcagcggggccgttcgccggctgtggtgttctcgtacccgttatggtgcgccttggttctcgttgtgggtggtcgggatattgttggttgctgtttcctgagtgtgcggtcagacagcagtggaagagacaaccacccccggtgccgccgggtgcggtatcggaaattttttgngttgttgttcgctctcgtgtggggttatgccttcgcgcgatgacagcggcggtgtggtcgctttgtgggttatgtggtctggcgc

SEQ ID NO: 678172 - DNA, 237 bp, Homo sapiens
  misc_feature (12)..(12): n is a, c, g, or t
gccgactacggnggaagtgggattccagcctttcatttattctttcacctatttgtcctctttactctgtgtacaaaaaagagaggattatactatcatagactgttgtttctaaacagaaactcaagctgggcacagtggcatacgcctgtaatcccaacactttgggaggccgaggcaggcggatcacctgaggtcaacagttccagaccagcctggccaacatggccaaacccc

SEQ ID NO: 678173 - DNA, 150 bp, Homo sapiens
gttcagttgcacagatgttccttatatataatgtaagacagttcatctctggtgaataagacacttacgtatcagtaatggattgtaaagatataacaatatgcaaagtgctatgccagatgctgagctaatatagactgctgagtctgc

SEQ ID NO: 678174 - DNA, 119 bp, Homo sapiens
cctgggttaaaactgaagggataagcctatacacagaatacggggtcagaggtataatcaggcagagggaagagcaggtataaaacttccagcacaggtatggagcgttggtgctgttt

SEQ ID NO: 678175 - DNA, 458 bp, Homo sapiens
ctgagaacacatgcgtatgtgcacatgcgcacacatagcgtacactatcagcacgtgaaaggcgctctgcacattgaagtcggcactgtgttggtgccttttttgttttttggctcggtggtttgactgcgaggctttttggatagaaatttatatggtagaaaggagctaacacttgggttttatatggcacaaaaaacaagtgttatactaactggactttattttttgaggtcttattaatgaagaacattcacttttgcattgacagggaattcaagaatgcgtttataaacccttaaaggaatcttgactaggcgtgcacatcctggcaagtgcccaatgggtctgaagcactaagctttgggtgggctctgtgataaacactttcactataacttacagataattctgaagcatactccaaggctgaaccactgatcaatttgcatgcatcc

SEQ ID NO: 678176 - DNA, 426 bp, Homo sapiens
  misc_feature (410)..(410): n is a, c, g, or t
gctgggattataggtgtaagccactgggtccagccccaacagttattttgggacatactagtgctttgcatctaatacagggaccactatccacgtgtagctactgagcacttgaaatgtgtctagtccaaattaagacatgcttttaagtataaaatataccccagatttcaaagacttaacatgagaagaaaagaaaggaatcttaataatgtttgttaaatgcctgagagtttttttttgaaatgaagggaagggaggggtagtaatggtagaacattgcccaagccgttgcttttttttttttttggacaaactttttgcccttgccactcatgctggagggcaaatggggaggtttgggttactcgaacctctgccttctggggtcaaagcaaacgttctgattnctttaatggaggcgaa

SEQ ID NO: 678177 - DNA, 352 bp, Homo sapiens
  misc_feature (326)..(326): n is a, c, g, or t
tgagacggagtcttgctctgttgcccaagctggactgcagtggtgcgatctcagctcaccacaacctccacctcccgggttcaagcaactctctgccttagcctccccagtaactgggatcacaggtgctcaccaccatgcccggctaatttttatatttttagtagagacagggtttcaccgtgttagccaggatggtctcgatttcctgaccttgtgatccacctgtcttggcctcccaaagtgctgggattacaggcatgagccacagcgcccagcccggcctacagtatttttaagcaatttttttttttttgagatggggncccgctgctgcaaaggctggagtgca

SEQ ID NO: 678178 - DNA, 228 bp, Homo sapiens
  misc_feature (6)..(6): n is a, c, g, or t
  misc_feature (33)..(33): n is a, c, g, or t
  misc_feature (41)..(41): n is a, c, g, or t
  misc_feature (113)..(113): n is a, c, g, or t
  misc_feature (128)..(128): n is a, c, g, or t
ttcatnccccaaagctcaaacaggcgtatcctnaccttgtntttttccaaatctacccaagcctgaggtggaggaatgatactttccccacaaatggtgggcccactccctgncccagaccctgaagnttgaagagttggaaacccaacggccaacggagagaaacatgatgagaagttggtggtggacacaaggctgcaagtaagcactgttagagcccatcagatc

SEQ ID NO: 678179 - DNA, 198 bp, Homo sapiens
ggattcatattttgcttccaattcaagggctttttgcatatcctcttctgaacaaagcactaatatgagtcgctttaggacatctcttataggttgattttcagctttaagcgtttcaagtgtggactccaattcagatgatgtaagttgcacagtttttttgaccgtctaaattcttactctcaaacaagaatgtcg

SEQ ID NO: 678180 - DNA, 527 bp, Homo sapiens
gggctgtatctagaggatccctataatgtatgatactggaaggcaaagaaatcttagagtctgggacaatagtttatttgtgcaaaaagtagaaaggagcaatgaagttaatttcagtagtatttttccctaagcacaatctgcaatagttatatgtatagacacgagactaattccaaaaaggaaaactatatatcaaagtggtatataaagttggtctctgcaaatcatttcctttgcacagtttttcaaaacaattgcactcatgtttcaaaaaccaaaaaccacatattcagcagccatgggcactatttttacacttgtcttcatctagtttatcagtgacttttttactttctgggtgtagcagtcccacattatttacgttgggtggtactatttaaactttcaacagttcaaactctgaacgaattacgcgataggtgactttcggagataccagtgcaggtggttttacatcccaggaacaaaaactatcaacaaaaagttcgttgggattctcaatt

SEQ ID NO: 678181 - DNA, 407 bp, Homo sapiens
tacttaatatttcagatataaccatttttattaatttctttgtaatgaccatgactgtgactattagtaacatttactaccagtagccataaaaatccccctcaaaaaggtgataatatatttcatagtcatcatggcaatttcatagtcatttaacttcgcgaggttcaaagcaagaaagctgtattttcacatgacacggatcacatttcacattgcacgcttaacacgaaagcaagttgaatcctcagttttcagacctgaaccaaatgttctagattactggtggactcagggaatttaaacatatctttatcatgattataccacaactgtgttctcttgctttctctctgtaaacatgttaaatccagaggagacagaagggaagacatttaatctgtatt

SEQ ID NO: 678182 - DNA, 196 bp, Homo sapiens
aaattgtgtctgctactagcccagaggagaaaaatgtgcctgtttgcagacttccagcgaaaagctgttgtagtttgcccaaagatgaagactataagcaagagcacagaagaaagcagaagtagagaggaaagacctaacagaacatgcggatctcaaaatgaaaggaactttacccaccagaaatagcaagtgc

SEQ ID NO: 678183 - DNA, 1317 bp, Homo sapiens
  misc_feature (880)..(880): n is a, c, g, or t
  misc_feature (884)..(884): n is a, c, g, or t
  misc_feature (890)..(890): n is a, c, g, or t
  misc_feature (924)..(924): n is a, c, g, or t
  misc_feature (975)..(975): n is a, c, g, or t
  misc_feature (978)..(978): n is a, c, g, or t
  misc_feature (993)..(993): n is a, c, g, or t
ggcggggggcacctactacatcgccctccacatccctgattcctgttgttatggaaactgttgccagagatggaggttctctcggagttatctgggaactgtgccttttgagtttcctcaggctgctggaggaaaactgagactcagacaggaaagggaaggccccacagacaaggtagccctggccagaggcttgttttgtcttttggtttttatgaggtgggatatccctatgctgcctaagctgaccttgaactcctgggctcaagcagtctacccacctcatccttctgtgtagctgggattatagattggagccaccatgcccagctcatagggttgttctcctaactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaaggggttgtgggtgaccagttgctacttggcctctggattgtgggaattaaggaagtgactcatcctcttgaagatgctgaaacaggagagaaaggggatgtatccatgggggtcagggcatgactttgtcccatttctaaaggcctcttccttgctgtgtcataccagngcgncccagnctctgagcccctgggactgctgcttctatgaccncagtaagccactgccacaacgtctgaccctctccaacccatagtgaccggntgncttttccctaagccnagggcctcttgcggtcccattcttactccacaccagatgtacccagtatctagggtagtgccctattgtacaatgtgtcacacttgagcgcacgagcaaaagtgaaaggcactgggtcatattccttgcagactggagggtcgggtggtccgggttgagaccgttcatcccaagttgcaccgattcttgttttgacttgagcaagactgttgagcaacatggtgggatctgggccagaaccgcgctggggggccactatcagggtaccatttcccttaaggcgcaaagggtctccctttccaaaatgggtgctcccgcaacctc

SEQ ID NO: 678184 - DNA, 549 bp, Homo sapiens
gtactcacacgcagctatggattactagtcctacaggagaaaaaaaaaaagcctttggtgtcgagaaacattttgacctttcaaggggatcctcaagagtcattagcttccaagtggtctttcctaaaacaaggatgtcccagtggcgggatcatcagcatgcaagtgacccggaaaccacacacactttcatcacagccatggtcaggatctctgagatacacagagaaactggctaagaggctggcagactaattatgttccactataaggatattcccagaaataagaggaattacactttaataaagcaatgaaactatgcgggtaaccatgacgactggctggcaaattcaataactatttaatgcccctgaagagttttttttcctttttttaatggccagtaagatcagagaatttatgagagggaactgagaagcatttatgcctgattggtatgctcagacctccaaagacgtcaggggtgtgctaagcacattataataccaattcacagcaatccttgaaaatgcccttctgggtacc

SEQ ID NO: 678185 - DNA, 144 bp, Homo sapiens
cgtacttcccatgcatcagaagcaggtgaaggatcgtggggttacagcccagacgccatgaaagctggcatggccctggagaaaaagctgaaccagtgcccttttggatcttcatgcccgtggtgttctgcccgctacggtacc

SEQ ID NO: 678186 - DNA, 1521 bp, Homo sapiens
  misc_feature (1084)..(1084): n is a, c, g, or t
  misc_feature (1088)..(1088): n is a, c, g, or t
  misc_feature (1094)..(1094): n is a, c, g, or t
  misc_feature (1128)..(1128): n is a, c, g, or t
  misc_feature (1179)..(1179): n is a, c, g, or t
  misc_feature (1182)..(1182): n is a, c, g, or t
  misc_feature (1197)..(1197): n is a, c, g, or t
aggagaaaggcgagacgacgcgtggaggacgtgggggggcactctagtattattgcggctctgcgataaatctcgcgtgcacaacgctgatatgttattgtcatacagctcgttcagctcatgacaatcagaggtgttctactacgtcagtgattgctgggcgtacgctggtgactcctccgaggtttgcgcttcacgagggtcgtatgaagtacgcgccgagacgtggtatgtacgtcgccgtaccaagagaataagggtgagacgcgtccacgctagcagcaccaataggggtacgacacctgagccaagaagagcatatgaaatatagtactattaggtatatattaattgagagtagggatagtcccgtgagtgtcgtgcctaagagcttagacctttggaagcgtccctgtgggtcttcaaaggcgagtactaacccaaccttcagggccttccctggttggttcgctggggaattttatggacatttggtgtaagccaaccaatggcccaggttcaagagggttgaactccttagatttgagccctgactcaggtctaaagagtggtgttgtgtggacagtcgcgtgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaaggggttgtgggtgaccagttgctacttggcctctggattgtgggaattaaggaagtgactcatcctcttgaagatgctgaaacaggagagaaaggggatgtatccatgggggtcagggcatgactttgtcccatttctaaaggcctcttccttgctgtgtcataccagngcgncccagnctctgagcccctgggactgctgcttctatgaccncagtaagccactgccacaacgtctgaccctctccaacccatagtgaccggntgncttttccctaagccnagggcctcttgcggtcccattcttactccacaccagatgtacccagtatctagggtagtgccctattgtacaatgtgtcacacttgagcgcacgagcaaaagtgaaaggcactgggtcatattccttgcagactggagggtcgggtggtccgggttgagaccgttcatcccaagttgcaccgattcttgttttgacttgagcaagactgttgagcaacatggtgggatctgggccagaaccgcgctggggggccactatcagggtaccatttcccttaaggcgcaaagggtctccctttccaaaatgggtgctcccgcaacctc

SEQ ID NO: 678187 - DNA, 216 bp, Homo sapiens
atcgatctagaggatccctggcaggctctctacctgtggcaattaatgtcttcgtaagagaaatgtctattcatggtcctttgcccctccctccccacttctttcttttttttttttttttttttttttggaaaaaaaacccaaattggccccggggcggaaggggaggggggggggccaagcccagggaaccctcaacctctgtgggtccaggca

SEQ ID NO: 678188 - DNA, 755 bp, Homo sapiens
tggaaagggagtctcactctgtcaccagaatgggagtgcggggtcccatctcagctccaggcaacctctggcctccgggggtccaagaaggttctctggcctcagcctctggggtagctgggagataacagggcacgcgctgccacacccagggtaattaattatatttttttttggaaaacaagatgtctcgcattggtgtgcccaggtgggactggcagggggtagatctcggctcactgtggaacctcggcctccgggggtccaaggcagaatttctcacaagcctcaggtccccctggagtaaagatgggagatacacagggcgcgccgggcacaacaaagcgccccaggttaaattttttgggataatcctcaaggcggagaggatggggggttttcccggccatttggttggcccaacgggtgggcatctaccacatccatctggggaccctcgggggagtacaccccggcatgcggacctctcccacaaaaagggggggagacttaacaggggcgtgacagtccaaaggcccccggggaccattaattcaagccactttaaacagcaataattatgccgaagtttgggtcccgggcgttgtggtggaacgcaatggcaagggggagcaacgacgacaactgtggggacaacccaggggggaggacaatcccaggtgtgccaggtgatgtacaagaaccgcccggtggaacagggggaaaacccattctttctaagacatacaatacgt

SEQ ID NO: 678189 - DNA, 699 bp, Homo sapiens
ggcggggggcacctactacatcgccctccacatccctgattcctgttgttatggaaactgttgccagagatggaggttctctcggagttatctgggaactgtgccttttgagtttcctcaggctgctggaggaaaactgagactcagacaggaaagggaaggccccacagacaaggtagccctggccagaggcttgttttgtcttttggtttttatgaggtgggatatccctatgctgcctaagctgaccttgaactcctgggctcaagcagtctacccacctcatccttctgtgtagctgggattatagattggagccaccatgcccagctcatagggttgttctcctaactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggagggagcttgattctcagcacttgggggatctgttgtgtacgtggagagggatgagggagtgccggtagctgtgagcagcactccttcatgctcctcacagctaccgccactccctcatagctgtctcctcaagtgtcagctcagccgcctcgtgcctataccttttccagtacaggccactgcttgcaggc

SEQ ID NO: 678190 - DNA, 162 bp, Homo sapiens
atcaggatgtacattttttggcatatctccacctcgcccacctgccctgtgtgccctatcatgacgaacgtatgtgctttctctagccccgttgaccggggggtaccgtagctcgatcttcgttaatcctagctcatagcctattctcctgtggtgaacaac

SEQ ID NO: 678191 - DNA, 842 bp, Homo sapiens
gctctttttccggtctggaaccatggagggtgtacgaagacgaacgatagaaggaggttcctgctgtgccagagaacccttaagaatacagcgaaggaatttcgcagtagctgaatgatcaagcgcctgagaacgaagtttgccctaaaaagatgctctcgaaaaggcaaggtaggaagcttatctatgataaagcaaagcactatcacaatggaatatgagcagatgtacagaactgaaattcgaatggcgaggactggcagaaaagctggcaacttctatgtacctgcagaatccaagattggcgtctgtcatcggaatcagaggtatcaatggagtgatgcccaacaggttctgaaaggtgttgcagcattcttcgccttctgtcgaaatcttcgaatgggaacctttgtgaagctcaagcaaggcttcgattaacatgctgaggattgtagagccatatattgcatgggggtacccctaatctgacgtcagtaatatgaactattctacaagcgtggttgtggcagaaatcaactaagaagcgaattgctttgacgagataacgctttgattgctctgatctcttggtaaattatcggtatcatctgcattggacggattcgattcatgagaatctatacgtgtcggaaaaccgcttcatcagaggcaaatcatcttcctggttggcccttcaagattgtctgtctccacgaggtgtgaatgaagaaaaagaccacccatgttgtagaacggcggagatgctggcaatcagggcaggaccacgatcaacaggttatgagaacaatgacctacggtgtctaccaggattctttttctag

SEQ ID NO: 678192 - DNA, 715 bp, Homo sapiens
gaggaacgacatggcggtgctctggaggctgagtgccgttggctgtgccctaggaggccgagctcggttgtttcgaactccagtggtcagacctgctcatatctcaggcattgcttcaggatcgacctatacccataatggtgtgcgacgtgcagcacatagctacttgtcaccgaggccgaccattgcgtgtgactcacaaaggctgcatctctctcactggacatagacgagagggttgtcagtgttttgctcctgggtctgcttccggctgctctattggaatcctttgctcctggaaggactattccctgagactgtagacctcactcttcatggtcactgggggcctatggacaagtatgttactgaactatgttttgccactggggatgccgttggccagaaagctggccaatggcagaggcttttggctactctcagctttatcctttgctgggctatgctattctcagctatcacgagtgtggggcatctgtcaaagctgtggccatgctgtggaagctctgaccttctggacttcatacttggtaggaattgatgttgtgcctccgtggccatctgcttgtcatgccattaagctcacaagtaaggcagtgattaacagataaggtccatggggacaggctgcttctcttactcacgagattatttcagaattcactctcgcggcacacgttgagaggatttatct

SEQ ID NO: 678193 - DNA, 405 bp, Homo sapiens
ctccgtatttatatatgtgtatatatgtgtttgtacagaaagcaatacaaaagtctatttttatacattatttcactgcatgtaactaaaatgaaatgaagatttgtttgtatacttgaaaatgtttgaatgtgagcgcaagtgtggggtgtgtgcatatgaagggctgttttaatcggtacagatttcacagtgtatacaaactattgttggtggtccagttgtctgttatcattattgtgaacaccgaaatactctcaacggaaatggcttttttacatggattttccatgagtgactgtgaaatgtttcttgagaccttttaaagactttctccttgtcaacagacctttttgttacaattttacaaaaatgttgcattaaaaacatacatttggaaacaca

SEQ ID NO: 678194 - DNA, 554 bp, Homo sapiens
  misc_feature (55)..(56): n is a, c, g, or t
  misc_feature (68)..(69): n is a, c, g, or t
  misc_feature (77)..(77): n is a, c, g, or t
  misc_feature (103)..(103): n is a, c, g, or t
  misc_feature (109)..(109): n is a, c, g, or t
  misc_feature (165)..(165): n is a, c, g, or t
  misc_feature (168)..(168): n is a, c, g, or t
  misc_feature (203)..(203): n is a, c, g, or t
  misc_feature (228)..(228): n is a, c, g, or t
  misc_feature (268)..(268): n is a, c, g, or t
  misc_feature (274)..(274): n is a, c, g, or t
  misc_feature (276)..(276): n is a, c, g, or t
  misc_feature (286)..(286): n is a, c, g, or t
  misc_feature (301)..(302): n is a, c, g, or t
  misc_feature (381)..(381): n is a, c, g, or t
  misc_feature (385)..(385): n is a, c, g, or t
  misc_feature (394)..(394): n is a, c, g, or t
  misc_feature (401)..(401): n is a, c, g, or t
  misc_feature (434)..(434): n is a, c, g, or t
  misc_feature (454)..(454): n is a, c, g, or t
  misc_feature (480)..(480): n is a, c, g, or t
  misc_feature (487)..(487): n is a, c, g, or t
  misc_feature (492)..(492): n is a, c, g, or t
  misc_feature (494)..(494): n is a, c, g, or t
  misc_feature (513)..(513): n is a, c, g, or t
  misc_feature (534)..(534): n is a, c, g, or t
tgcatataggtaatggttaccagatactcattttttttgcagaaatttttttttnncccacccaaatnncctttgcnatctgtgagggtgaatgtacctagtntttctnagaaaccatcaattcctctcaacaggttttaacattttactctccaattatctganatnaagttaccaacagccttgagaagaattaggaagtntttctaattttctacctcacctccnggcagtctcaggattcttctcatcccaggtattggtcttncaaaantnttcttaaaanagggaaaactttaannatttgtgtgtggtggggcggtggggggcgggggagagataggaacaactgtagtatttaaagaggtttcttttaatgcnagtnaaatgcagnaatatgntgtgtccccttccctttgaataatctctccctntctaatattttctgtgtgcnctgtgtctgtttctttgttttccctnagccgangtccntnatcccgtaaaattctttgnctttagcacattttgcaaatnatttgtctccctctttaaga

SEQ ID NO: 678195 - DNA, 898 bp, Homo sapiens
  misc_feature (40)..(40): n is a, c, g, or t
  misc_feature (125)..(125): n is a, c, g, or t
  misc_feature (156)..(156): n is a, c, g, or t
  misc_feature (173)..(173): n is a, c, g, or t
  misc_feature (191)..(192): n is a, c, g, or t
  misc_feature (197)..(197): n is a, c, g, or t
  misc_feature (203)..(204): n is a, c, g, or t
  misc_feature (214)..(214): n is a, c, g, or t
  misc_feature (223)..(223): n is a, c, g, or t
  misc_feature (230)..(230): n is a, c, g, or t
  misc_feature (245)..(245): n is a, c, g, or t
  misc_feature (248)..(249): n is a, c, g, or t
  misc_feature (255)..(256): n is a, c, g, or t
  misc_feature (272)..(272): n is a, c, g, or t
  misc_feature (278)..(278): n is a, c, g, or t
  misc_feature (284)..(284): n is a, c, g, or t
  misc_feature (294)..(295): n is a, c, g, or t
  misc_feature (304)..(304): n is a, c, g, or t
  misc_feature (311)..(311): n is a, c, g, or t
  misc_feature (314)..(314): n is a, c, g, or t
  misc_feature (322)..(323): n is a, c, g, or t
  misc_feature (334)..(334): n is a, c, g, or t
  misc_feature (336)..(336): n is a, c, g, or t
  misc_feature (610)..(610): n is a, c, g, or t
  misc_feature (693)..(693): n is a, c, g, or t
taaaaaaaaaaaaagtgtttattataggcaacaaccccanggggaacgggttttggtctaccccaggggagtgcaatttttcattctcccaatggggggcctcaaccttgaggcgaactccactnggcgaaagatgcctttctaggaagcagagcntccctgacggggctaanatagttcagatttgatcnntaggntcaagnngtaaagaccntagtgtagntctcagngaagtcttgggcttntannggcgcnntgggttcgcccaaagncaaaantggganacggtataanngtgggtggnctcccanaantcccgaannaacataacgcngngagaagaacagacgccctgggcgcgcattaccactttggtttccctatggagaaaccctatacaggcaacaaaaacaccatcgtggcgaaaaagaccctgtggaccctatcaggtgtgcaccaccaagagtatccctatttctccaggagaccactattttctggggtgtctccccatgtgtgttttattgcgcacaacgggtgtcctctttggcgccctttagaacagagatcttggggttggctcataataattcagagaaggggcggatangttatccacaagggcgatttaatttcccctccaggagaccatgttgcgaccttgtgttgtgtggcgcaggatactcaaagagngttctggagagccgtgatgataagacgcccacgcgagagtgttggttggcgccagagttcacctcttgtaggaggggcgattgagcctatgaccagtgtcctacatgaatcgcaccagggcgcgttatttgtgcccgtgtatgaacaacgtttggcgacccgaggggtctctcccagaagaacacagtctctggggagaatccga

SEQ ID NO: 678196 - DNA, 226 bp, Homo sapiens
agaagtatagcactgcgaagctaagccatgaaatggcttcagtgacctttccccatcgtcttggataagacccccaaggtcttaactcattccagcatttactacaacatgtctagaagcccaaagtctcaactgagacaaagctgcagtctctatctgcgcccctggacgcgctctgacaatacaacagcaggttaaccacttccaaggtacgattgtccaggca

SEQ ID NO: 678197 - DNA, 241 bp, Homo sapiens
ctgagtatataagtttcctctcttaccgaagactgtcagaaaagaaactagtgggatacgaacaagttatataattgtggtctgaacacagaccctaaactgaagttctgtttaaatatagttacatgaatttctctgatactaatgtactcaacagccaggtataaactatatctcctagataacatattccatgttttgttccaatcacacatacttgcttaatgaaggcatatcagaa

SEQ ID NO: 678198 - DNA, 908 bp, Homo sapiens
tgggattactaatggggtatggaaagcagtaagaggttccaggaaaaccaatattaagaccagttctggagggttctccccaaagataaatttaacaggctccagcttcaagtggtttactcaaaatacaaaaagaaaaaatgtaagagggttggtcttttccgagagggcaaatcgggaccctggcagggctggagggaaaaaaagctacattcacacacaggagggtgggggtgcctcccggaggggcgtgggggctcatagggtggaccgcctgtgcccgagctggcagcgcgcctccgggcgtgggtgaggccccgagaacactcgcgggccagagaggtgctcgtggagcgagaccacacaagaggtggtggggagaacagaagggacacccaactctctggggccacacagagcggcgagaaacccggaggggacaccagaaagtggggggactccgtgggagtctcaccaaagatgagagctgtgcctgtgaaaaaggggtgggaatagaggccgggccctgtgcggcgcacaatcagagtgggagaggtggcccgtggagcgggcctcccccaaaggctctgtgcggcacacccggggtgggatacaccgggtggggacagcccacagagggggaaacaagagcacacgatgtgggcccatagcgcgcacaagtgccgcggggggtgaaacctcacagagagagggcaacagaggcgcgaaagccttgaggggggagggagaaaactccatacatcagacgtgaggtaacacccccgaaggtgcgcgcggaaacaaagctggaggaccctcccggccagcactcgctgcacagatcgcgcgagcccccaaccccaaaccacaacgcgccctacgaagtgggctccacccccgagagcgga

SEQ ID NO: 678199 - DNA, 771 bp, Homo sapiens
tgttcacgtcgagacgctcgcctgtggcagatgcaccgaatatgcttacaagctccgtgttaatgggaccagcatcacgaagatgaaggacaatgttgctcaaagcatttacatgtagcctaaaaacgaggtcccgtggctgatgccccttgcagccttggtagcagtgacctgggaatcctgctgtcctgtgggacaagatggaggagcagatgacatcttccatgtcaaggctcgtaaagtacgtgaatgcagttctcagccgcggacgctggtctatgtgagacatttcgcgagaagaagcattgatggtattcagaacacttcaagttagacttgggatatatcatgcgtcaacatgaaagttgtcatgaatgggagaagagcctattttgttgtggtaacaacagttgagagcgagcaccaagtgcatttagttgaatgaagtcttcttggatttgacccaagataaaaaggatgtgtaggaataaataacagtcttacctaagatcattaggtagtgaatggtgagccagtcgttgaatatcttaatgcagattttttgaaacaaaaacgtaaaatgagtctatctgtattttagaggattcaacggatcagtatttccctgggatgggttttttgaaatttgccccttaggaggtactccaggtattcattttctcgattattaaagtatgttatatttgcacaatcagaaaaggttatctaagtgtgattataccggggggtttacaagatgtaaggcattag

SEQ ID NO: 678200 - DNA, 205 bp, Homo sapiens
agaccctgccgggcctatgctgagcagtaccgaatagacgcccggaagttagcacacctgtttcagctagtctcgcccttggacctgcggggcccacacgggagatcctcgccgaaagggacgtatcaggctctatggatgacaacttggaccagctcatcagagtacaaagcggtaggtagagcggcctcgaatattcatgtat

SEQ ID NO: 678201 - DNA, 352 bp, Homo sapiens
gtactggcactctagtcaggtcacaatccacgtgactcagcccagtctcagcgtcaaaagctttcctgtagtgcaactgcctctttcacttggattccagttagctcttcctgcttactggttaactgacggccgaggatagttatgattcagaagctatccaaagaaataggttctatttcaagattaatttggatgttaaggccggaacacgatgagtctatcttttctgggtcctcggggttgccataggtcttaacttgaggcaaaacaacagctcaaatcaatataaaagcatactctatggaatcttccaggcgaagtgtaacccaggtttaagcagggttttctg

SEQ ID NO: 678202 - DNA, 811 bp, Homo sapiens
  misc_feature (210)..(210): n is a, c, g, or t
  misc_feature (254)..(254): n is a, c, g, or t
  misc_feature (346)..(346): n is a, c, g, or t
  misc_feature (444)..(444): n is a, c, g, or t
  misc_feature (452)..(452): n is a, c, g, or t
  misc_feature (486)..(486): n is a, c, g, or t
  misc_feature (529)..(530): n is a, c, g, or t
  misc_feature (638)..(638): n is a, c, g, or t
ttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaanaacagtttggatctcttagtattgcctttgaaactgcaacatangcaactcaacaatattagttgcattcctttatagacataccatgtcaaagaccgttttctatcaagtgggcatcattctgtctatacccttngcatctgtagactctgatgtgtgatttgtataagcagctgaactatgacatgactctgagagacatctcactgacttataagcaatgtccatatactnatggagtnttaggcatctgggccagatttatgatatgatatnggcattatcctctactcttaatctgatgatgttgaatggctannatagtacttgtacatgtcatgtagcatgcatgattgacctgaatgtggtgattctgacccaggtttagaactgccttgaaagatacgggcatttaatggcaatgtcanggccaatgaaccaaacttggttaacaaaggtaaaaaaaaaaactggaattccggcgattgcagcctttaaaaaaaaattaaaaaaggaagggtgggcacacaaagggggcggaaatctctttgggggcggagaagggcttaaaaaaaggttagctctccatctggggggagaa

SEQ ID NO: 678203 - DNA, 875 bp, Homo sapiens
gagagtctgcggtggcgggacggtggcgagagccgcgggggccgtcggaagccaaacttccctgtcttctccggggccctcgctcccctcctccccacaaaatcagggatggaggcgcctcccacgtgcatcactcttagcagcccatccccagtgaaagagtgtccccacctagagactaccataatctgctcacccaaatcaagctaacgccacatgcactcaccagaggcacattgcgtcggccacagtgggccgccattgtatgccacctggtgcttggtgcgtaggccacctcgacggatgtcatggatttgtagactgagaggacaggggagtagagcatcacgagatgctgggaacccataaccaccaaaatactacaacagaagaaacaacacgcaggcagggaaagctccaggcgatccagcacagaggaaacaccacacacggcacagcagcccaatgcactccgagcaaacacgcgatcgcagccacacaagacaaaaacatccgtagcgagcaagcaacggccacatatcgcagcaaatagagaggctaggcgcgcgcggctttgagaacgtttgatggagcgaacatagagaagtaggattacgtctcatgttccacatctagcgcgcgagaattggtacgcagcaactcgatagaaatagaatcgtaggtaagtagaatcacgattcggatcatcatgcgccccctcgagcaagaggagcacgcaatcgtccccataggcacagggacgacccttacgtaggcagagccactcagaactaggcgactgcgatagaccaagtcgccagacccagcgtcagtggcaaagagcgtcagtatgcatccatctaagggcggcacat

SEQ ID NO: 678204 - DNA, 104 bp, Homo sapiens
agcggctactggcagaagtcggagcatggaggatctagctggggagatgctgtgtagggagaactgctcagtgctgtggtagtgaggattatttaaggatgtta

SEQ ID NO: 678205 - DNA, 914 bp, Homo sapiens
gaagagaactggacggcgatgtgcgacggtctgcagcaaatccagctgctgctgcggctggctgtggctggcagtgacagactgtgcgtgtgactgacggatagagagccaccatgcacgatggagctgccatggcctggacagccagtggctgccagatacgaaaactggcgatgatgctgggcgagaacgtccactgctgtggccggctgaaagctggttccttgtggatgaagcactggtataagcatgtgggacggcatacagtgcagggaggggaccaggactccagcaccataccctggctgcatcaacaatgccacactctttcaagatgagataaactgtgcgcctcaaggaggcgactggctggaaggcgagcgattatgtgactgctcccagcaagctgcattggaccttagcatggatccgactgagtatggctctagagacactggccagacaccccattcgacctgcaacggtcatagacgctgaccaacatccagaactcgtccacactgtacccagctaccccctgctgccttgatccgacacacatgcatctgcctcaactctcaacaacttgctttcaagacttacacgccgcaatacgcgaataacatattatggacctaggtatctgtcgacacatcttacccggacgctgtgatttctcgtgctctagacaccgcagcgaatcgaaaatccgtcctttgcctgcccaaagcacagatcaataaccggccctccattagcccttacgcgtttcgtactgaccaccaccctagtcccgtgatccttctcacgtgccctagcaccattcccacctgtggccagtccgacaccagtcactttcaaatcaaccgtggccacaaaccagaggccacttgggcctagagccaccagactgt

SEQ ID NO: 678206 - DNA, 833 bp, Homo sapiens
aatacatcttccccgtaaaaataaacccctcatgatatttaatactagggccaacacagcacatcttcttcttttgcctcggcttccaggattccggtatgaaaccgctgccatttgcactgcacactaatgacaagctggatgtttgcatgaaagccaatatgttcctacactgctttttgagacaagtaataatcagtctgtcatcaatgtcatgctgcaatcaggctttgacaaggtttgcaaataactcgaaaggaattgctcattcctgaacactacagatcaaaaccagacctgaacataaactagaagtctgctgagtgtaaactgcagcatcttatgaaacgtgctgcgaataagcagaagcaacagtccatggaacaaccaagccttagccacccgaaacccctgtctataattaaaaaaaaaattttttttttgaatatagctaccttcactgactaacactaataaacccctcgctctaaatgacaatgttatccctaaaaacacccaccctggctagaattaccacctgtcttattatcgagaatcaccggcaacccaacataaatacccattattcctgcggtttgttctttacattaaagacatgagatggcctctattctgggctttatccatcatttctttacggaataagatctccgccccctaaccttgagacaaccaatatgattcttgatttctacgtccttccgtaccgtcctcctttattatgatcgatgcccgtattaattatttgacaccatctatccaaacaaatgctctttgaacgcctacaaaaccctaaacatcgatgtatttat

SEQ ID NO: 678207 - DNA, 496 bp, Homo sapiens
  misc_feature (1)..(1): n is a, c, g, or t
  misc_feature (379)..(379): n is a, c, g, or t
  misc_feature (382)..(382): n is a, c, g, or t
  misc_feature (454)..(454): n is a, c, g, or t
nttccggcggcagagctccaccgctgaggccgacgaggccgaaagtttatttattgaaaatcatatgtataacctagcagacgagggagcagatttaaacacataacttcaagccatttctgagaacatacatcaggagctctgctcagctagagtcagactccagctccagcccgactgcgtgcggggacagcgcccgcgttgatgaggaccagccccactgcggggggaggcggggtcaccctgggaagggggtggggcgttgtggcatattaagtctaaaccagatgaatgtgaatatctctttgtgaatcatttatttcactctgtgccatccagggcagcaatcagattgtgggatgcggggggactggggccncanccgggccacctcttccgacaggcgtctgctctccaggagaagctgggtctgcttgctgaggagctgcaccanctgctgggctgtgggctggctgtgcttatccagctggcttag

SEQ ID NO: 678208 - DNA, 1094 bp, Homo sapiens
  misc_feature (1034)..(1034): n is a, c, g, or t
  misc_feature (1094)..(1094): n is a, c, g, or t
gagaccgttcttcgaccgagagtcgtcggggttgcctgctacaacagtgcttggacggaaccgggcgctcgttccccaccccggaccgatggaccatagccagccttccgtgcacctcttcagcgcaccctcggtatttggcccaaaggggccctgcgggtggattcaagtgcttggtaagacaatcacgacagaggccggcgggctactcttccattaggtcgccgcgcatgaaggacgggtgtgcaacactcgcaagggtgcgctgaaaagtataccaggccacagggcaatcatagtaggggcggctatttaaacgcggctacagaatcaaacgcgtgagtctgtttagccacatctatagtgtatatgactaggcgggtggtataacataggttggggaccgggaaggaattggtggtttaagcaaagaattgtgggcaaaggagtacgtttgtctattaacgaatagtgcttattgacgaggcgcaaggagaaactattgcttgaagaaatgtggagtatgaaatgctgtggaagacaccagaagtacgtgtgacgcagaaagtgtgacatcagaggatatataagagacctcgaagaggtgtgtgtatcactgtgttacgatcgcggtggccgaagtgctcgatggtaggtgtcgtccactcagtgtgggaacaatgatttgacatcagtcacttagtgcgaactggcagacactgtggtcggtgacaaagtggtgccccccatcgtgtggggccgtctctggaagacgatctttaactgtcatgaccacgttgtaagatctatccaggcactgtgggttgccacgttgaaccatatgtggcaatgatgggcacgcccagaagttgggtgtgaggacaatattgctctgaccgagcacccctggcagccggggtagtagactaagctgcgactattaccataggcgtgggtgtttccgggctacaacgctgtagtcatgggggtgctaactttaatgatggcagaagcgatcagtgtggtgtgactcngatagcagtgtccacacaaagacaaacatgtgcgtgtggtgaatacatggcggcggacgn

SEQ ID NO: 678209 - DNA, 419 bp, Homo sapiens
ttggggcttggtagtagcttgttcgtttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgcgtgtgtgtgtgtgtgtgtgttgagagctggagcctcaccctgtctcccaggctggagtgcagtggcgcaatcttagctcgctgcaaactctgcctcctgggttgaagcggttcccctccctcagactcccgagtagatgggattgcagatgtgtaccaacacacctggcgtcgccctctttatgtacgtgagtacccatgt

SEQ ID NO: 678210 - DNA, 2245 bp, Homo sapiens
gagctcctggggcaatgtggaccagagaatgatagtgggacttcctggctgagccttcaaggtctcctttgtctctcctccttgtcccctccctcacaggcctgcagcccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagtttacctgcaaactagctgcttgctagttaacctcacgaggactgggggtggcttgcggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggcttagaaaccaaaggcaaggacgtttctttcatctgcctttcatcctgcaaaaagccctccactcaaggcaagaaagggcactgaagtttattgagtgggagacagcggcaggtgggagaccggggagggaggagagaaagggaaattcaggaggaaggagtccagcgtggattgctccaaagctcacccaccacgccctgactgcaggtgtgattcggggcccccgtggctctgctgggtccaggtgcaagcaggcaagaggtgtggcgtcagctcgattcgcaggccctggactactgtctaaacaggacaggcccgggcaagcagggcaggggcgtctgcaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtcctta

SEQ ID NO: 678211 - DNA, 352 bp, Homo sapiens
taggccggtagataagtcaggtagtaaataggagagcaggagtgtgccatcagataatacagcatatgaggcggagaggaggaccaattgatcgacactgtggtggatttggcgtgaacaattatgtaccaaattaactggcaaatttctatgtgctgtcccatgtgcttctttattaaaatttccccaatgaaactctcttgtggactatttccagagctcagaggtgtaaggcagcgtgtggtgtctgagaggcaatagcgcatcatgggtgatttttattaccaggtccccaagaagcaggtgagaggctctgttcctgtgccgtctgagctgactggtgacctgtgga

SEQ ID NO: 678212 - DNA, 2749 bp, Homo sapiens
gagctcctggggcaatgtggaccagagaatgatagtgggacttcctggctgagccttcaaggtctcctttgtctctcctccttgtcccctccctcacaggcctgcagcccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagtttacctgcaaactagctgcttgctagttaacctcacgaggactgggggtggcttgcggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggcttagaaaccaaaggcaaggacgtttctttcatctgcctttcatcctgcaaaaagccctccactcaaggcaagaaagggcactgaagtttattgagtgggagacagcggcaggtgggagaccggggagggaggagagaaagggaaattcaggaggaaggagtccagcgtggattgctccaaagctcacccaccacgccctgactgcaggtgtgattcggggcccccgtggctctgctgggtccaggtgcaagcaggcaagaggtgtggcgtcagctcgattcgcaggccctggactactgtctaaacaggacaggcccgggcaagcagggcaggggcgtctgcaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtccttatttcatttcctttttttttttggtttccatggaaatgatccttgttaaattcagggttgaaacgaggcaggaatctccatttttgtgctttttgaaaatgcaatgaattcctatacgggggagcgggaaaggtgcctcagagagagacaagtctggatgagggaaatattgaatattctcaatcaaatggatacgctggcagcaaagagtggttaaagtccatcaggacttgaaagacctgagtccattacgttgagaagggacctgctgattgctttgattccccctggcaagtgctccctggttgtgaatgccaggcactagagatggtgaggggttggggggcagttgggcacacacagtgtaagagcaattcagagccgttagtcctgcactagccctcaagctgctggcaacacctagagaaggtcgaagggccctgccagagatcccttcaattctaaagggaggtatgttttgcgggatgggcactagacggagctc

SEQ ID NO: 678213 - DNA, 443 bp, Homo sapiens
  misc_feature (115)..(115): n is a, c, g, or t
  misc_feature (155)..(155): n is a, c, g, or t
  misc_feature (276)..(276): n is a, c, g, or t
  misc_feature (383)..(383): n is a, c, g, or t
  misc_feature (392)..(392): n is a, c, g, or t
aggagggagccggagggacgcgcccggaggaaagatggaagactaccaggctgcggaggagactgcttttgttgttgatgaatgagcaacattgtaaaagaggctatagaaagcncaattggtggtaacgcttatcaacacagcaaatgaaccantggaccacaaatgtatagaacaaactttaagccaatcaccaagctgggccttttacatctgacctgtgtattatgcagaagatggagctggattacacacagcaattcctgcttctggganagcttctactgacgggagctgcactgtgcatgggagaataagaccatgtactgcatcgtcatgcttcggactgtctatttgacctgcatccagcctatggcctttcncctttgtcnctagttacatcctctaaccaccagccatgaattcagtgctctttcactccc

SEQ ID NO: 678214 - DNA, 957 bp, Homo sapiens
ggataatgacagcggtaaatggacattcacggaacgcgcccaggacgtcatgaaagagccatgagacacgctaacacaagctagctaacgacagtataatcataaacctatcatagaatcaggacgagatattaccaacgacaactgccactacacccgacgacgacaaaggcgagcgctgaaacgcaatgctcgcaaccccactacgcggacacaagagacacatcgaggtcatagacacgtcaactcacctgattgctacacgctgatacgctagagagcacaggaagacgagagacaagcgagtagctagagactcaacctgtcacagagataaataccaaaaaaccgatctcttcctaactctcccccaagaagaagaattccacacttcactgaaataaagccatgaatccctgaatagctcgctacctatcgacgcaaaaacacaaaatctccaacaccatgatacccaacatcataacataaccaaactcaaaaaattcattaacaaacaaaataatgcacctattactcaatagaaacatcaaaacaaaacatataaacattcaaataaacaaaacataatacacacataactaacatctaaccaaaaaaacacaaccaaaacaaaaacctaccctaacaccatacaccctaaactcaaacaaactaacaacacacaactcaactattacactccagccccacaccctcgacaccaaccaactaccattatcacacaatcaatacatcacctaaattactaccatattcctcacaaacacaacaccacttccctacacaaaccaacataacaactcaacacttaactcacatctctccaacaacagaaaaacctctcatcctaaacacaacaaaacacatatactagaccaatcaacaaaccattccacaatctaaaatacacttaacaaccacaaaccatcacaaaac

SEQ ID NO: 678215 - DNA, 2169 bp, Homo sapiens
gagctcctggggcaatgtggaccagagaatgatagtgggacttcctggctgagccttcaaggtctcctttgtctctcctccttgtcccctccctcacaggcctgcagcccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagtttacctgcaaactagctgcttgctagttaacctcacgaggactgggggtggcttgcggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggcttagaaaccaaaggcaaggacgtttctttcatctgcctttcatcctgcaaaaagccctccactcaaggcaagaaagggcactgaagtttattgagtgggagacagcggcaggtgggagaccggggagggaggagagaaagggaaattcaggaggaaggagtccagcgtggattgctccaaagctcacccaccacgccctgactgcaggtgtgattcggggcccccgtggctctgctgggtccaggtgcaagcaggcaagaggtgtggcgtcagctcgattcgcaggccctggactactgtctaaacaggacaggcccgggcaagcagggcaggggcgtctgcaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtcctta

SEQ ID NO: 678216 - DNA, 2864 bp, Homo sapiens
gagctcctggggcaatgtggaccagagaatgatagtgggacttcctggctgagccttcaaggtctcctttgtctctcctccttgtcccctccctcacaggcctgcagcccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagtttacctgcaaactagctgcttgctagttaacctcacgaggactgggggtggcttgcggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggcttagaaaccaaaggcaaggacgtttctttcatctgcctttcatcctgcaaaaagccctccactcaaggcaagaaagggcactgaagtttattgagtgggagacagcggcaggtgggagaccggggagggaggagagaaagggaaattcaggaggaaggagtccagcgtggattgctccaaagctcacccaccacgccctgactgcaggtgtgattcggggcccccgtggctctgctgggtccaggtgcaagcaggcaagaggtgtggcgtcagctcgattcgcaggccctggactactgtctaaacaggacaggcccgggcaagcagggcaggggcgtctgcaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtccttaaaaaaaaaaagaaaaaaaaaaaaaaaaaaaaaaaaaaaagaaaaaaaaaaaaaaagagaggggcgggcggcgcctgcaaagaagagtctccccataggaaggggccgcacacgttagtaggccgcgccccccagtttttttggtacaagggggcgcccccccaaaagaggggcgcgattattacaataacagccgaggacgacgcgcggggcgcgcggcggttactcaacaacacctgcgcgcgacaatgggggcaaaacacacgtgcgtgacgcccagtgggggagaccaccagtggggggaaagaaggaagccccttctacctccggggggggaggggagcgacacaaccagtgtgggccacaaacatctccccccacgaagagactttatcaagagcgcctcagcgggggagaattatatataactattttgtaagaggggtgtatatcttcgtcgtggttgaaacaatccgcggggtgaaatatgtgtggtgcggcggggagttaagaaatggttgtgggagattacgagcaggagtattatctgattatctgtgaagaaaatttttattattatatcacgagaggagtcgtagactgagtacgaaaaaagagat

SEQ ID NO: 678217 - DNA, 991 bp, Homo sapiens
ctcctactcctcattgtacccattctaatcgcaatggcattcctaatgcttaccgaacgaaaaattctaggctatatacaactacgcaaaggccccaacgttgtaggcccctacgggctactacaacccttcgtctgacgccataaaactgcttcaccaaagagcccctaaaaaccgccaggcatctaccatcaccctctacatcactcgggcccgagcttaccctactcaccatcagctcttctactatagaacctcccactctcactcatactcccaaacacaccctgagattaatacttcgaccaacgcgtcctcctatttattctactccaactctagcctagctgtttactccaattcattctgatctacctgatcgtagcatcaaacctcaatactacaccctgatacagagagacaatagaaaaaaaaaccccaaacaatctcatatgaagtcaccctagccatcattctactatcaacattgactaataagtggctcctttaacctctccagccattatcacaacacaagaacagcctctgattactcctgccatcatgacccttggcataatatgattgatctccacatagcagagacaacgaaaccccttcgaccttgccgaggggagtcgaactagtctcaggcttcaaatgaatacgccgcagggccttcgccctattctttcataggcgaatacgcgaacattattataatagacaagcctcacacttacaatcttcaaggacaaaattgaggaatttccgaagtcaaacaaaaatttggacccagacctatttagccccgtcttatgagtgaccgcaaccccgagtcgtagacagtatactcaagaaatcacaccaccaccatcattgagctctgcccaaaatccaatcccagcacaaaaaggcggagactcggcacacacctaagcacgacaagaagcgaacgcagaaggcaagaagacacaaggcggcgcgaccg

SEQ ID NO: 678218 - DNA, 180 bp, Homo sapiens
gaacatggcgtgtaagttcaggggctcgtacggagagaaggacatcaagctgcgtacgatgcgagacttgcgaaagaagaagcgaggcctccggtgggcaggctgaagggcaggtagaggtaggtatcctggggctcccgccagaagaacctgtcctggaagagctcgtctatgatgctg

SEQ ID NO: 678219 - DNA, 2134 bp, Homo sapiens
gagctcctggggcaatgtggaccagagaatgatagtgggacttcctggctgagccttcaaggtctcctttgtctctcctccttgtcccctccctcacaggcctgcagcccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagtttacctgcaaactagctgcttgctagttaacctcacgaggactgggggtggcttgcggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggcttagaaaccaaaggcaaggacgtttctttcatctgcctttcatcctgcaaaaagccctccactcaaggcaagaaagggcactgaagtttattgagtgggagacagcggcaggtgggagaccggggagggaggagagaaagggaaattcaggaggaaggagtccagcgtggattgctccaaagctcacccaccacgccctgactgcaggtgtgattcggggcccccgtggctctgctgggtccaggtgcaagcaggcaagaggtgtggcgtcagctcgattcgcaggccctggactactgtctaaacaggacaggcccgggcaagcagggcaggggcgtctgcaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcatctgaatgacacggaacgctcccactgcaggcaaaccgtgacgccctccccactcgggagaagcagagctgaccttaggaccgagcaccagggcaggttgcgctgcaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtcctta

SEQ ID NO: 678220 - DNA, 119 bp, Homo sapiens
catcctctctcacgttaatcccttaacacataaatatgagtcatgatatctaagggctaccaccccacaacccatctacttctcgggtcgagatgagagcggcttcagatatcatgact

SEQ ID NO: 678221 - DNA, 1107 bp, Homo sapiens
tcctccggatacctgcaccggtcctactctggaccttctttgcggttagttcccgcctttgtttgacttctctcgcgcgcctgtggttgtcccgattgctatctttttcgttctcctccggtatctccgctgcgtcttggtgcttatgtgcctctgaggttgtaactgttgctaatggcgtgcgaaagtctatcccttgtcaggccgacagcttgcctggagttcactgtacttatagagtgcactgtagttcaggcgggaaactgtgaactagtggtacagtactcccgcacagtctacgtggacaaacgcctgtaaagactggcatcgtcacaggatgtcagcggtttaaatgttagtaaacttcttctttggggtgtttatttgtttttgttttttagtaaggaatgaggaaacttaccaccctctgggggtagtttacagactgagtgacagtactcagtatatctgagatgaaactctactaactgtgtttggagtacaaatgacagttccaatcagctatgtgtatatatgtgcatgtattttgtgtagaattaatagatgtcgtagttgctgtgttatatgaagaccatagaaggtagaaaatccgtactaacctggaacagatttgtgtgttattcactggcttgtgatgatcgtttccctattcagtacacctagtaaatgctgctaagcagagaggtcccatttgaacgtgcgcttgtgttccatgtgacgaaaccaaagatttgagcttacgagtggataggacctgacttgagaagtgttccaagtccaaatgaatgcatcacaacttgacaatgcgtgctcattgttgtgagtatctatgagattcaaaggttttctaacattatggaaagccttttgtcctccagaagatgagtagctagggatcactgtgtttaaaaaccagaaaggctacgatgtactgggcaagaagaaagatgggaaactgaataaagcagttgatctagcatcattggaacatggggacgagtgacggcaggaggaccagcgaggaaataccctcattaactaccctgttacacatatatcctcgcgtgggggggcgggggggggggg

SEQ ID NO: 678222 - DNA, 234 bp, Homo sapiens
  misc_feature (21)..(21): n is a, c, g, or t
  misc_feature (54)..(54): n is a, c, g, or t
  misc_feature (92)..(92): n is a, c, g, or t
  misc_feature (203)..(203): n is a, c, g, or t
ctgtgatgtatccccaacacnaatcaacacctcccctggaatggggcaatagcngcaggacctcttccacaggagtctatagaggaaaagcnggtaatacagctattataaatgccagccagacacaggcctcacttctctgcccagaaatgcctacttccacaggagcctatcattaagaaacacaccagtgagcttatttngctaatgaatctgggtgttgggcgataaata

SEQ ID NO: 678223 - DNA, 88 bp, Homo sapiens
tggactcacgcggttggactcatgcgcagcgagctgaggtagcacctttgcactctagcatgggcaacaatgaacgaaactctgtctc

SEQ ID NO: 678224 - DNA, 298 bp, Homo sapiens
  misc_feature (225)..(225): n is a, c, g, or t
  misc_feature (267)..(267): n is a, c, g, or t
ctaattgtgtggtgttatgacaggaagagcacaagtggtggtgcattctttatgggttccagattagtatcttggttcagcaagaaacagagttcgattgccctgtctacaggctgaagcaaaatatgttgctgctgcattcttgcttgcactcacacttctttgagatgatgcagaccgctgcagagattttcaacatcacattgtacacacaccatatctccnatcctcatgttatacatacacagtgcaatacagacatttcanaagaaccctataacaccacagggtttaccga

SEQ ID NO: 678225 - DNA, 715 bp, Homo sapiens
cgggcagccatcccaaatatggggccccgttcgtggctgccctctttccggttcttgcggtcgttggatgggtgttctggcctatcgattttgcccggctgtgatcacgacggtgacggtgtgtttttgttccttcctccttctcttgtttgggggggacgcctctgcacagctcttctctctaagcgcgagccctctcctggggcgattattctccgctcgctccctcattgttatgcggcgctctctttcatatcgcgtagggctacatcatctcgccatagggggggagaatctcctttctccccataaggggggaagtattaaaataatggagcatcattgcttttttattagttggtccgtggatgtggtccatggaaacaccccccgcctttgccaaacaacccaacgtatggatgtgatatgctatgtggtatgttgtatgtgtatggtatgttttgtttacacgcacgcacacacacatacacttgtgcatacacatacgtgcgtccacctattataagtgcggcgcgccacattttcatcgcgcggctcattatgtggacacacgccgcgtagtactatgttcattggataatattgtgtatgccgccgatcttccttataaggatagactctcttccacccgcgcgacctagagcaaggacctaacatataacagcttttatacagggacacaaattgacagaga

SEQ ID NO: 678226 - DNA, 248 bp, Homo sapiens
tagagtcgtatctagaggtatcccctcataggttcgcaggcacgagaacatgcctctcgcaaaggacctccttcatccctctccagaagaggagaagaggaacacacaagaatgaaacgcctggctgcagagctccaattcctacttcatggatttgaaatgcccaggatgctattaaatcaccacggttctttagccactgcacaacacggtaagttttgatagtgttggcctgctccacatgatcc

SEQ ID NO: 678227 - DNA, 599 bp, Homo sapiens
tggatgatggtgctatattatctctccagtgtgaatgacagaaaggtgccgactatcctggtgacggaggtggaaaatggatggctccttgaggcaagcaagaagggtgtgaaccttcctggtggctgcatgtgagacttgccatgctagtgtcaggagaaagagacataccaggatactagtattgtaaaggaggtactttttttttctgtaagataatagagtagataatgcgtacatatacaatccagcacaggacatctagatagtccatgaaagttaggaaagagtcctgaggagcagacagggtattttgaacatacacagcattaatcagcaaaatcatcgaagacaatcatgacgtgggcggtacgagaaggatatagaattgcaccatccctagagaagagcccaagttagaattggtgaataccattcgggttcgaggcttccggtcgagtatgactaactcaaggagacaattatagaaagaattataccctaggacaagaacaacaatgcgtacataaaacctatagaactacatgtaaagaaatgacatagacatatgggaaaccggtatgacaacacccgaaaga

SEQ ID NO: 678228 - DNA, 119 bp, Homo sapiens
actccttctgcccccgttcttctagtgagaggggcggacaagggggcggcgaaaagaggagaaaggagagaaacaagagtcgagggggacaggggagtcgaggtctgcatcccctcccc

SEQ ID NO: 678229 - DNA, 105 bp, Homo sapiens
tggagcacgatacgattgtgctggccgacaccatgcgctcccctattgagtgctctgaggttgtgcagcgctcagttacctataatcttattcaacaaattctta

SEQ ID NO: 678230 - DNA, 227 bp, Homo sapiens
  misc_feature (94)..(94): n is a, c, g, or t
  misc_feature (101)..(101): n is a, c, g, or t
aacaatattatttaagtagtatgtgaccgagctataaatttttgtttttgttctaagtagtatttaatttggtgaactgacaggacaatgtttnttaggcnttagcattttgtttaaaaacctttaaagaaacctttagtaagtgtacttagtacctcacatattaatgttgtagtaagtttctgtcttaaattttaaaaatggttttctataaagggtttttattg

SEQ ID NO: 678231 - DNA, 247 bp, Homo sapiens
tataccacatgccaactaattttaaaaatgtttggtagagatggggtctgctgtgttacccaggctgtctcaaactcctgggctcaagcagtccttccaccttggctcccagagcactgggtttacaggtgtgagccactgtgcagcctccttttatctaattgtccccacagcagacttgtcgggtcttggctattttccggttgttaaggtgtatggtggtatagggtggtatagggtggtatag

SEQ ID NO: 678232 - DNA, 137 bp, Homo sapiens
ctgtctgagattgtcacattatttgtcatagacttcaaggctgtctgcagcgtggctcccacgttacctttccagccttgtctcgtgtgtcccttcaagcctctgttgacatgtgcttccaccggccgcgcctcgtg

SEQ ID NO: 678233 - DNA, 435 bp, Homo sapiens
ttctccttgattactcctgccaatcagtgacccttggccataactatgatgtgtatcttccacactaggcagacgagcgcaaaactcgaagcccgcgcgttcgaaccttgcccgaagggcgagtcgcgaacttagtctgcaggctttctaacatcgaattacagccgcaggccctcttcgccctattcttgcatagccgaatactacatacatgtagtataatgaacaccctcaccacttacaatcttcctaggaacaacatatgacgcactctcgccgtgaactctacacaacatattttgtcaccaagaccctacttctaaccttcctgttcttatgaattcgcacagcatacccccgattccgctacgaccaactcatacacctcactatgaagttacttcctacaatctcaccctagcattacttatttac

SEQ ID NO: 678234 - DNA, 1360 bp, Homo sapiens
  misc_feature (391)..(391): n is a, c, g, or t
aagcctcagaatcatggtgttaggtgaaaggtacttcttacatggtggcagcaaaagtaaatgaggaagatgcaaaagtggaaacccctgataaaaccatcagatctcgtgagacttattcactaccacgagaacagtatgggggaaactgcccccatgattcaaattatttcccactaggtccctcccacaacacgtgggaattatgggagcacaattctgagatttgggtggggacacagagccaaaccatatcagtactcaatatttagctcccacttataagtgagaacatatgggatttgctattctgttcctgtgttggtttacttaggataatgtcctccacctccaccaatgttgctgcaaaggacatgacctcattcctttntatggctgcatagtatttcatggtgtgtatgtaccacattttctttatccagtctactgttgatggtcatctgggttgatttcatgtctttgctggtgtaaatagggctgtgatgaacatttaggtgcatgtgtctctataatagaacgattttatctttctctttgcctttttgaatgcctaagtaaattttatatttgaaagtgtcggaagaattaagcatggcggtacatccaatttaattgcctggaaatggccccaacctttccttctggtaaggtctggtaggtctctaatgaaaggctttgacgtgccttacctaggaatttgtcttgatttgcgagttgtctccctttgcgtcatcctcacctgactcgtcagcttcttctttcactgatacctctactcatcccaacggtttccttccacgctattttccagcgctcggtctcctttcacactcactcttttcttgtcacccctatctacacatagctctctccctacactccctcggcctctggcctgtcatccttttctctatccctcgtctcacgctgaccctctcttgtctcatcctatctctctcttcgctctctctctcctcctgtctctctccccacgtccacctcctcttctctcacccgacctctcttctctcttcgatctctcctacccttctcttctcctatacttctcgctcttctccgctcctccctacttctctcactcactccttccttccccatccttcgttctctctctcactactagactacctctctcgctccactcctcttcgttcacgaccgcatctcatctctttcttctctcttcgttctcttactccgtcctcactcgctcaccctcctcgtcccctatctttcctctcctcatctctctccatctcgtctccgcctagtagttctatctctcgtctcttgttcttttccctcacgttgcccctcc

SEQ ID NO: 678235 - DNA, 1725 bp, Homo sapiens
  misc_feature (384)..(384): n is a, c, g, or t
  misc_feature (428)..(428): n is a, c, g, or t
actatactctgtcaggttctgcatttcaagacttcatattggctcttccttgtgagtcaagattgatgtaagatcagttcggtagtaaggtgaggtcgtcggtcatcaggccgtggttcccccaggtctctgactgccatgacgcggttcatctgactctcataacatgaacctgcgttgcccgaggtatggacttagctagcttcattgctcttcgagatcatccactgaagatcaactagtgacttacaaggctgtcactatcgacacgacatccactaggtacctctggataagtggggcgttgatatgacatgggtttttacgcaattgattagacgctggcgctggcccgtttgcattcgtcacctgacccccatctanacgttgagctcgttgccctcatctctttttttggcttgctcccntataaaggtagcctgagagttaattacatatggttctgctagcaaggtctatctctagctggcttgctatggtcccctattggatatacggaggtaacttcactggtcataggacaccctttggtaggaagcatctattcgggggaaccaaccacatttagaattgacgcttgctcttagaattaccctttaaggaaacaacttcttggctcaaaccctcgtattgatttctctaacatgttgggcaaggaatattcccgtgtaacgcaggagttagcctgagttttgtaccggaacacacatttttcaaatatttcctctccttaaggtttaggttacgtatatttaggcttaaccttgttttgccactagttggtgtgccagccgatattaggctttaccaaatttcgattttggatgggatcaatttttattgaggagaacccttccgctttgtgtgaaccctaaagtctctttgagggtggcttgcttaccctcaaaaaggagttgcctgttttgggtgggggggactactgataatcggggagaaacgcaaccttaaattagcacacaccttcccttgaaccaaagacaattgtgggtgcacacattcaacttaatattatgaattttgtcggtgccacgacgggctttgtgtcaccacacgtagacatcgacagtgaactctctcacgctcatgtacactataggtacgccgccgcgacggcgatcctcgtccccgctattgcaaacagcgcaaatccgtccgcccttctcggtcgaggtgtaggggacccccgcacagaggtgttggttattcacccccactagtagttttacgccgcccgtgggcgttgttctattgtttttgtatcacccacaaaggtggtgttagggccgccccccgatcaagctaactggtagtgatgaggttcttcgcagcactaattcataatcaagtcggcgatgaaggtgggagacacgaatgaagtcgctagccgcgtggccttcatgattgtttgattgagcaaacaacactcctctcatgttgctggtagcaccgcgggggcgcaccacacacatcttcgttattcacagcgtggtgagtgcggaagacacactactagtcaggagcagggagaccacccccttcaaaactcacttgacgtggggtggagtgttgttatgaacccccattctacctttgtgtggcggagcatgacaagacttacatcccctagccagccgtgaatgacatagtttaatcagtaccacatgctggagtggagtaccacac

SEQ ID NO: 678236 - DNA, 266 bp, Homo sapiens
aatcctctgtggtggaggccgaggatcatgtgaggctgccttggataaagcagtccactggttacacttgcgcagcttctggtcgccacgggacaccaaaagacccgagcacgccgggcagccacttcctacttacttttgctcaagttctggatggcagcgaaggacccggagccaaggtacagcccataatctatcctcgggggcaccctggaaaacccaccggcggagtccttgaacaccagatctttctgcccactagggga

SEQ ID NO: 678237 - DNA, 143 bp, Homo sapiens
atcagacagcggtgcttacctcctaaggtagctggatacgaggcgccctgtctaccatgctcagctaatatttgtatttttagtagagatgaggtaacagtatctatggctggtcttgaactcctgacctcgtgatcgacctg

SEQ ID NO: 678238 - DNA, 267 bp, Homo sapiens
agaagttcactagcactagtaagaagtttcaggtaagaagctggcaatgacaataaaggtaaataacgtagaggtgtccctgggtatccatggggtatggttcctggaccgtccccccaacccacagataccaaaaatccaagtatactcaagtcccttacataaaatgacatatttgtatattaccaacgcacatccgcctgtatactttatccctagactaatacctaatgcaatgtaaatgctattgaaacttctaaaactagg

SEQ ID NO: 678239 - DNA, 311 bp, Homo sapiens
aaaagaatgtaaaacttgacaacaccctttttagtttgggtcaggaaaatgtcctttggaccaaaacaaatttttgtaaaaccaggtcagttttccgggagttgccccaaatgttccccctaacccaggttttttttagtcaacggaaactcccgttaagccctttgctcctggtgggaaaaggaaaaataaaccccctggggtccaggatttacttgggaaacccgagtttgggggggcccttttttgtgactttttaaaacagtgaaatactgtcccccttatgggcaagtttcaataaaactttgtta

SEQ ID NO: 678240 - DNA, 427 bp, Homo sapiens
aagctgtacacgcattgatccggtcaggggatcacgtaagtctaatggtccgggcagtgctccgtttctcatagcctcagtctcctcccagaaacaatggatgtcaagattcctatctcgtgtacctttctgtacagtgcccgcactgcccgcattgagtaatgcttgcgttatttcattcctactacagttgcgtcccagcatgtagggcagtgcttgcacgttccatctggtgcctgaccagatgtttgctgaagacaatgtgtgaccgcgtgctctagctcatgttcaacctccataaatgccacttacgaatccatgatgtaagattacgctccggcaccgtggatatccatttcttctaagccacattctgttcactgggatctcagcattgcattaatagcaaacatttacagagggcctg

SEQ ID NO: 678241 - DNA, 324 bp, Homo sapiens
tgatccaggtggacacgagtctgttttaataaagatccccagatggttggcttacacattaagtgtgagccatgctgctgcatgagttattagcctgaaggagtggctgtccgaaccaagtctaaatcaaaattactgacttgtcagatgctgctgttcaggattggctagtcttaacatatctcaagatgttgttgctcagcttcgtgcttaaccatctgaacttctaatcgccctcctcccagtaagaggagatagttctcccaagacaaagtatggggagtgaaacgtgatccaggcaagagcaaaagctatgtctttcta

SEQ ID NO: 678242 - DNA, 380 bp, Homo sapiens
gtaaaattgaggatctggacaaggagcttgacagacactcagtcggtgcactgcagaattacatcttgtttaaccgtaaggttgatcaaccagccccagctgttcccatataaacaagcaaaaatattctcaaactatcagatcttgaactctccttggcaatgcgttatgggccatagcaatgcttatcagcgtggattcttcaggttactacacacatgcacttgttttccatcattgagtaatttgaggaaatactagattaaactgtcactgtatatgtagaatatataatgcttacaactatgcaacaaattgtcattcactgcatgggatagtttcatgtaacatactttacacgactctagtgtcccagtcgc

SEQ ID NO: 678243 - DNA, 142 bp, Homo sapiens
ctcgagctcacaccctatccatgactacattggctgttggttatttgcctaattacctgatatgtagagcagtctgttggcaaatatcattagcgatgcgacttttggaaacattctggggatccttcttagtagttcgacc

SEQ ID NO: 678244 - DNA, 1716 bp, Homo sapiens
ggcatatcagaaacaacaggatacattaattgtttggtcagaagcagagaactatgatttggctctgagttttccaggcagcaaagctggctgtgcatgcagcatctgggcacaaacacatttgtccaggcacagcatgcagcaagtttttgtcctgcacagtttttgccaccaattcacaccagcatgcagagctcaccagcatgcatgcatcacaagcgtgcgatgaagttgggtgtaagttatgtatatcaagggaagattatgtgatgacagttatatcatcgagagcactatagcaaaggcatcaagagacagaggaagtggcaattttatgtcaaaaaacgagtgtggacaaagagagttgggggaagtatcgtgtcactgacatcgtgtgcaacagttggtaactgtgagcacatgggaatagatgtgtgcgaaagtgtcaagaaatcaagacgtggcgtcacaggcatagtcaattgtttcagtatcagtcgtgagagtcagacaaatatatcaggtcgcattcatagtgggatacccagaagagagaatgtgtggtacaggtggacaaaggaaatggcgtgcaggagcatgtagaggtgagtgaaccggaaataattatacgtgtcgtgtactataaagtgggatgggtacagtctgaagagcagaagtggagtccatggtgaaataacgatgaagtacccaatgaaggcgtgaggagagagggagacatgggtagtgcaagattaaaaggtgagggaagttgatgtttgcagagaaggtgtacatgagaagtttggaatcaagaggaaggaagaacgaatggacgtggggagtataagcagaggtttaaagatgagaaagagaggacggagaaaaaaacacaaggatggaaaagtataagcggtaaaagagatagtgtatggatagtcagaaggcaaatatggatagtgagcgaatggttaagttagagaaagaaaagacccaggcctatagggggacacccaaacaagtcgccttgccaggacaaggaaccaccatcgtcggttcaacacgacagcggggatcacaagtcaatacagaatggggaactaccggacagccgacaagagcacgcaaagcaacgaaacaatctgaggagcacggagagaaaggcgagatgcagagagccaagagacacagacgacgatcgattgcggcaccaagaaaaatatggaaccagaaaggtagaacatcgcaaaacatgtgtagggcggtagggacgaagatggagcaacgaacttagcatagaaaatcgagaagaacacgagaaatagactagaaaccacaagggacatagtggcgaataacaggagagacaggaggcaaggaaatgaaagctaaaagggaaaacagatgccaggggcgaagagataggccaaacgaaatgcagacactgcggcgaaaaaggggggcaggacaggaaagaaagagaaagggggaagagagaacacagggagcgaagcgaagacacagcggcaagcaggaagaaagaggacacacagaggcagggataaaggaaacgagcgacagagaagtaaaagaacagaggagacgagacgaacgaaagagagaaagaccaagagagaagcaagcgaaagacaagaagagaaaagaagaaatgaaagaggtcgtgaggacgaagatagaaaggaactaataccactatag

SEQ ID NO: 678245 - DNA, 938 bp, Homo sapiens
attaatcccctggcccaacccgtcatctactctaccatctttgcaggcacactcatccacagctgctaagctcgcactgcattttttacctgcagtcaggcctagcacaatcacacacatgctcagcttttattcccagttctaaccaaacaacaataaaccctcgttcccacagcacagctgccatccaagtcatttcctcacgcaagcaaccggcatccatcaatccttctcaatcagctatcctcttcaaccaatcattactctccggcacaatgacaccagtaaccaaatcactcaccaatccaatcactcatccattcaatcaatcatcaatgggctcatcagcaaataacaactcaggcaatcagcccccatttcacttctggcagtcccaagcaggttacccaaaggcaccccctctgaccattccttgccttgcttcttctcacatgacaaaacactagcccccatctcaagtcatatacccaaatctctcccctcaactaaacgtaagcccttctccgtcactctctcacatcttatccattcaatagccaggcagtttgaggctggattaaaccataacccagtctacgcaaacatcttagccatactccgtcaaattacccacaatagggctggcattcatagcaggttctaccggtacaaaccctaacgataacccattcttacatttcactactgtctattatccctaagctactaccgcatgcctacatactcaatttaactccaggcaccacggaaccctactaactattctacgacacttggaaacaaggctaacattgactaaacacctttattccattcaccctcctttcctatgaagcctgccccggaacacggcttttgcgcccatgggcctttcggcgattccccaaagcaatgctcattatcccagattatgcctc

SEQ ID NO: 678246 - DNA, 84 bp, Homo sapiens
ctagaagattcagcaaagtacttttgtgctcttggggaactgtccttcctagttcgacctcctgggcacaccgataaactcact

SEQ ID NO: 678247 - DNA, 799 bp, Homo sapiens
gccctggtgtgataaccgtcttgcagcggttgtgctcttgtacccagcggtccgcagaatctaccgtctggacgttcgtctccatagcttaagggtgcgtaggctgcgagcacgtagtgccatcatttggatcgcattacctggaggcatgatgcccgcctgtatgcgtgcccacgcatcgtagtctaaaaagaggattgccgatactaaaggaggcggatagacagtactaagtcaagctatactgagtgagtgaaggtgagagagaaagtgaggacaggccaggtctactctgtgtgagccagatggagaacacgccaaaaggggtgcctagtattgtccctccagggatagacgcctcggtgcaggttagcttttgaggaggctaaggcagggccaaccatgacattttcacgggaccccgggcaagggaccggagattacagagtttaccccactgagtgaaaaccttcggggacattatggtggtgaggcaacaggtacaggaacgcattttttcccccttaatggcgagtgcgtctccagggcagaaatattggcgaggcgacccaaggagtagcgcttctcgacactagtgcctcgaaataggtttgtctcgtgggtaacaactgttccgccacgggggttcgcctatagtaaattctcacagatagggacaccaccgtctaggtttatgaaggaaagaactttgacctgggagcgtcgcagaggcactagcccacgcaagcttccgggacgcaggcattcgacatgcacgccaagggcggagatacgagga

SEQ ID NO: 678248 - DNA, 264 bp, Homo sapiens
aataagcatgaagatgcctccctaaggacagaaacagccacgttaaagtcagccctaagctggtaccccagaaaggacctggccctggagtctgatccctatgggttcaaatcctgatattgccacttactccccgtgggaccttggcaatttacccagtctaagctgaagtttgctcatctgtaaaaagatgaccatatcagctttctcataaggctgccttgattacatgacctggcacaccacagaagccacggtcaacca

SEQ ID NO: 678249 - DNA, 178 bp, Homo sapiens
gatgtaaagagtcaactgtacactcacactcgcaaggtatgtatgagggttctagctgctctacatcccccccaaaacttagcatagttagggttgtatcataaattgggtcatatccattgggcctgtattgctatctcattgtgatttaaagttgcatttcccgtcggctaatata

SEQ ID NO: 678250 - DNA, 346 bp, Homo sapiens
gacatcgggtatgggatgaggaaaggaattgagcagaaggtacaggagcaatagcaattccctgtagctctcaaagcacattttgagctcatttttctttttctgcgagctcagcagcagaaatgccagagtcttccctggtagattgcggttccattagcgacgttctcctgcaatgcaggctgggtattctgcaatagcaagggcatgtttttcctttgagcctggatgctttggagcccaagctttcgtcccatgcaagggaaacaaacacttctgggatgtccgctgcaatctgctccgggggctgcaggaacctcatcagctcctgccaagacttgctcag

SEQ ID NO: 678251 - DNA, 1162 bp, Homo sapiens
atttctgacctcaagcagtgacacctggtggtgtgggacctggcccgaggccctggctatcagtcagcaggtggcagcagcagtgacaaggctggtcaacaagtgatgctcaccttcctgctattctcctgccctgcaccgcctgctggagagcacctgggagcagcggtgcctgcggtaaaccctggagtgggaattgtagcccccgctccgatgcagccgtgtgggcccgacccagctatgtcctgtgcgtttgtccgtgcttacctgcatgcgctcttcgtccgttctacccctccgtgagcttgcaagcttcgtgttcgctgctggaatgtggcttgggccgcctagtgctaccaggccaagagggtgactttccggctcccatactagtgacaggattccattcgcagcggcctatctgtactgtctagcttagatcacgtcacagacagttggtcgactgatgccaccagctacttgcggtgccacttggtgccatgcaacgctgtcgtgctttgtgcctgcatgccccccatctgaggcttgtgcatacttgtgatgcctcttctcagccccatctgttcccatacctgttgctctgcttgcgtggcgcgacatccggtctcaatctgccgtaggctccgtttgccttactttccacctgtgccttgccgaggccctgttcgggacgcgagccctcgtagctccgattggtagggcacctctgcattcgacggccgtttgccggcttcgcccgaggcctcccctttggcgcgattctgtctccccttttcgagtttcgtccaggacgttaccactccgagtgcgggtcccttcccctttgtccccaaacgctcgccatgggggcgcacggtggcacccaagcgcggattcgcttggctttttggccaacgcggagattggtctccaccagttccttgaatattccctacggggcccacaccacttcccctgtggaccccaagtttctcggaccaagatatccccggacacttggtcttaacaacagcgccagtaaatgtggtatacgttccacggggcccccactttatcaatttgctctgagtacaacgaacccatccccttgcgagcctcaccgtgggccgtttgtcattgagcacccctccccaacaacagg

SEQ ID NO: 678252 - DNA, 319 bp, Homo sapiens
tcccctgcagagatagtgatttattgtggctggggatgtagcccttgagggtactgggttgtttgaaactgtccaagactttgtaacagcagctaagattgagaaccatggggcccagggaaagagactcacagtggaaagtcaggtgactttgtgaaaatactcagcctgacacacgcaagcttctggatcagtacaatgaaaggggtggatctgcaaaatttttaacaacctatgtgtaaaatgacatcctattggtaaagaggcttttgtcaaataatgactgcagtagttctgttttcaaaaaaacagaaaaaaa

SEQ ID NO: 678253 - DNA, 337 bp, Homo sapiens
tgactagctttaatatcacagacaacctggagacataccctagagatcctgagaaagcagttgtatgggcaaaacatgtagctaagacaaatggctacttgggccaagccatccgcaaaggcctcaatgcctacctggaatgaacatggcatgcaggcttgctgaataatgtaatagcagcagaaactggaattggagtgtcacagacaaatatagcacacatctgtgaggagagggcagaactggccaggagatacttgggtgtaactagtgtaaggagatactaaaatctctctgttaaacaaatcgatgctccttcctttgcatatttgcggat

SEQ ID NO: 678254 - DNA, 571 bp, Homo sapiens
  misc_feature (409)..(409): n is a, c, g, or t
  misc_feature (458)..(458): n is a, c, g, or t
  misc_feature (571)..(571): n is a, c, g, or t
gtggaaatagatcatcatagaggtcttcatccttatcttcaccttgagcagactgacgaggaagaagagggattagtcttgctgtcttgggtggcacagttagaagaaaatccacatataagtggactttcatccagttcaaactcatgttgttcaagggttgactgtatttacttttctgaggcaagttcaaaactttgatcagattctcagtcacccctgaaaaagttagaatcattgtttcagaatggatagcagggaggccatgggaatctggtttctggactttacccacttagttacatttccaacaaacttatttattgatttattttttagagacagtgtcttattctgtcatgcaggctgagcacagtgacaccatcatggctctcactgcagccttganctcctgggctcaggcaatcctcttgcctcagcctcttgagtggcatgcncctgtaatcccagttactggggaggctaaggagaatcgcttgaacctgggaggtggaggttgcaatgagctgagatcgcaccactgcactccagcctgtgcgacagagacccn

SEQ ID NO: 678255 - DNA, 771 bp, Homo sapiens
  misc_feature (45)..(45): n is a, c, g, or t
  misc_feature (85)..(86): n is a, c, g, or t
  misc_feature (90)..(90): n is a, c, g, or t
  misc_feature (93)..(94): n is a, c, g, or t
  misc_feature (100)..(101): n is a, c, g, or t
  misc_feature (103)..(103): n is a, c, g, or t
  misc_feature (108)..(108): n is a, c, g, or t
  misc_feature (118)..(118): n is a, c, g, or t
  misc_feature (120)..(120): n is a, c, g, or t
  misc_feature (122)..(123): n is a, c, g, or t
  misc_feature (127)..(127): n is a, c, g, or t
  misc_feature (141)..(141): n is a, c, g, or t
  misc_feature (148)..(149): n is a, c, g, or t
  misc_feature (156)..(156): n is a, c, g, or t
  misc_feature (163)..(163): n is a, c, g, or t
  misc_feature (165)..(165): n is a, c, g, or t
  misc_feature (184)..(184): n is a, c, g, or t
  misc_feature (195)..(195): n is a, c, g, or t
  misc_feature (205)..(206): n is a, c, g, or t
  misc_feature (227)..(227): n is a, c, g, or t
  misc_feature (277)..(277): n is a, c, g, or t
  misc_feature (316)..(316): n is a, c, g, or t
  misc_feature (322)..(322): n is a, c, g, or t
  misc_feature (336)..(336): n is a, c, g, or t
  misc_feature (338)..(338): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (388)..(388): n is a, c, g, or t
  misc_feature (402)..(402): n is a, c, g, or t
  misc_feature (411)..(411): n is a, c, g, or t
  misc_feature (425)..(425): n is a, c, g, or t
  misc_feature (456)..(456): n is a, c, g, or t
  misc_feature (459)..(461): n is a, c, g, or t
  misc_feature (471)..(471): n is a, c, g, or t
  misc_feature (477)..(480): n is a, c, g, or t
  misc_feature (494)..(494): n is a, c, g, or t
  misc_feature (539)..(539): n is a, c, g, or t
  misc_feature (542)..(544): n is a, c, g, or t
  misc_feature (546)..(547): n is a, c, g, or t
  misc_feature (551)..(553): n is a, c, g, or t
  misc_feature (555)..(555): n is a, c, g, or t
  misc_feature (557)..(557): n is a, c, g, or t
  misc_feature (568)..(568): n is a, c, g, or t
  misc_feature (574)..(574): n is a, c, g, or t
  misc_feature (583)..(583): n is a, c, g, or t
  misc_feature (637)..(637): n is a, c, g, or t
  misc_feature (651)..(651): n is a, c, g, or t
  misc_feature (661)..(661): n is a, c, g, or t
  misc_feature (663)..(665): n is a, c, g, or t
  misc_feature (676)..(676): n is a, c, g, or t
  misc_feature (692)..(692): n is a, c, g, or t
  misc_feature (694)..(694): n is a, c, g, or t
  misc_feature (703)..(703): n is a, c, g, or t
  misc_feature (768)..(768): n is a, c, g, or t
ctcgccctcctcctcctcaaactccccttgttcgtcgaccgtagngtcctggtactactggtactcggacaccaggacgttaatnnaganctnngcatcnnanaaatnaatctcgtcnanannctcncccgtataccagtncaggaannccttgcnccggaananggccgtgaactgctcgganatgcgcttaancagctcctcnntggccgtgctgttgccgatgnccgtggccgacatcttcaggccgcggggcgggatgtcgcacacggccgtnttcacgttgttggggatccactccacgatgtagttgttntttttnttctgcacgttgancnttttctcntncacttncttcatggacatgcggccccggaagatggcagcnaccgtcaggaaggnggccgtggngcgggtagcaggcngccatcatgttcttggagtcgaacatctgcnggnnnaactcgggcncgtgannnnccggtactgctggntgccccggctggtaaggggcgcgaccggggcatgaagaagtgccngcnnngnngggnnncntnttcaccgccancttgcncaggtctgngttaactggcccgggaagcgcagccaggtggtgaccccgctcatggtggccganaccaggtggttgangtccccgtangnnnggggtggtcancttcagggtgcggaananatgtcatanagggcctcgttatcaatggagtaggtttcatctgtgttttccaccagctggtggacccgagaggntgg

SEQ ID NO: 678256 - DNA, 423 bp, Homo sapiens
  misc_feature (125)..(125): n is a, c, g, or t
  misc_feature (423)..(423): n is a, c, g, or t
tctcttcagccacttccgggtcttccgtcgctccggaagcccgcagattccggaagtgagggcgacccagatgcggccacggaatgcccagctttccggagattgtttgagaaacggccgtgcgncgcccgggcgtcccgcagaccccgcaggagacatatgaaaacccactgatgagctaaccaaggatacattccagcaactcctgctgaaatcgttctccaagactctcagcaagaccataagccaaggagttcacatctcgggtcttttgcacagcctgttcctttttcctaactcttggcaagtatgaggtaaaggcctcctgaagcagctgtgcagcagaactctctatcaacttcttggtaggccgctgagtgctgcaggggccacgggaacggagcacagccttttgttttagan

SEQ ID NO: 678257 - DNA, 184 bp, Homo sapiens
ggtagcgaatgaagtgaagacatctcagagggaggatcttgttgtggattttgcaccatggcttatgaggcaggagtgaagtgaccaggcttagcttgtggagtttatgggccaccaggtttggggaaatcaccatcccgcgagatgctgtgacctcccgttctacgagagatgcaggcagatg

SEQ ID NO: 678258 - DNA, 1510 bp, Homo sapiens
gatcgtgactcgatcacttagaatcatgacctgggaaggcaggtccatcaccatgcgacagatccaattagatccactcagatcgatcatacatccaactcaccaaggctcatcctactcgacttagagactctatcattcggatggctgcatgcgtcgtatcaggactccatgtgtggttctcccgcatgcagatgtgtgagagtagcaagatagaggggcacacggagggggaactgtgatagtggagtggaacgatgagcgaacttctagaggcacaaagaggctaccctcatagaaattggacacagataactgcgaatcccgcaagatctcaagcacagggaacgatctcgagagggagtagacagactgggcacggttggtacttataagacgcacgtctatataatagggtggaatcaaaggacgctagagtactagatggtctttcacgacacgattgatgcaatagcgaaggtacagttcgatacaccggtttacaaggagagatatatgatattgcagattggaaacgtcattgggaggatgaaacctattctaagtagggtttaatcgaaaggccatggagattaacagtggctgttggtgcgtaagcacaaggaggagtgagaagaccggaagaattgtttggaacttaaatacgcttaatggaacatttctggggctttaaaatagttcattctacataaccagggcaatagcgaattagcgtaaggacattttctacaagtggaatatatccagtctccgtgtcttgagtcaagtctgtgagtgaaaaggatacggttcttaaacataggctagctaatcatgggagaaggttctacacaaagttgtgacccctggtgcttagtgcttgacaggtgaaaacttacttatacacgtaagatttgaatgctgggaaaggggagaggggttgagactttctgtgtttcactcacagaggaatttcaaaatgtgtcctacctatgggagcacggcgagacaggataaagcaacgcgtgtgtgccactaagggtagtcctaggaagcgaatgggaaaggtccccaagatattggagattaaccagaatatgtcgattggatatgtcgcaaaaaacaacagaatggtacggcacgtaaggagcggacacacttgaaatttagtttggggcggacatagagctcattgcgagccacttgacggcagagcaccacggagacagttcaactaccagcatggggaacaccgcagcacagcaccctggatgcaggccagactgacaccgacgacccaactgcgggtgtgaacaccctgaccacgagaatagagagacaaccatcaccagcagacctggtcagggaacacatcgggtggtcccacatcaaccagaacgatgagcagaaagcgagcggacaacgggagacacaccgaaccagaagataagcacgcaaacaacgaaaatcctctgacgagactacgacaacaacatcacagacagcacag

SEQ ID NO: 678259 - DNA, 454 bp, Homo sapiens
  misc_feature (300)..(300): n is a, c, g, or t
tcgagtgctgactcttgagagatccccaagcagccatacagactcaacatatagttaatgtttgatggctgctttgaagaaatcaagttcagtactccttccctggtaggtattaaatttttgatagccacgaattacatatcaccatcatgtaaaagtagtttattattaaatacagctataatttattatttttttgagacggagtcttgctctgtcacccaggctggattgcagtggcgcgatcttggctcactgaaagctccgatccccgggttcacgccattctcctgcctcagnctcctgagtagctgggaccacaggtgcccacaaacacgcccggataatttttggaattttcagtaaagacaggttttccactgtgttagccaggggtctcctgacctcgtgatccacctgccctgggctcccaaagtactcggattacaggcgt

SEQ ID NO: 678260 - DNA, 431 bp, Homo sapiens
gtcgaccaaggcaaacggatcacgaggtcaggagatcaagaccatcctggccaacatggtgaaacccatctctactgaatacacaaaaattggctggacatggtggcgcatgtctgtaatcccagctactgtaatctcagctacttgggaggctgaggcaggagaattgcctcaaccgggaggcggaggttgcagtgagccaagatcgcaccactgcactccagcctggcaacagagcgagactctgtctcagaaaaaaaaaacaaaaaccagtttaggctgggtatggtggctcaccagcacttatgggaggctgaggcaggtggatctcttggaggtcgggagtttgagaccagcctggccaacatggtgaaaccctgtctttactaaaaatacaaaaattagccaggcatggtggcgtgtgcagtaat

SEQ ID NO: 678261 - DNA, 381 bp, Homo sapiens
tacgtcgcacagcaggcggcggaactggcacgcaaggatggcgaagcccgtcttgaagccttgaagaagagcggcagcgccgatggcttcggcccgatggagaccgtgtcgcgtgccaaggctgatggcgtctcgccgaaggctgtcgatacgatcatgcgtgccgatgcctcgaagctgccttcgctcgtgggtgtggacctcggcgcggatgggtacgcgatctaccgtatcgccaaggttggcacgccgccgcaggccaacgcaaaccagcgcgaggctgacgcacagcaactgggcctgatggccggccagacggaactggcagcgttctatgacgtgctcaaagccggtgcgaaggtgaagattctgcatccggcc

SEQ ID NO: 678262 - DNA, 574 bp, Homo sapiens
aaataaaatttttaatttttcaattaattctatctacaatctaaaaaaaaaaaatcaaaaaaatcattcaaccaccatccacatgtcgcgcccccacacttcaacaacaacaaatcaatcccaaaaacctttttaacaacaaaacaccctcccatacaacaacctactctatcttcccaccattcacacaaccccccctttccttattaaatcacacaacccccccattcttccccccataacaaacaaaaaaatctatttgctctcctctccacaaaaacctttaaaccacacacctcccccccctcacaaagccaaaaacattcactccccaccacccaattcaaaacaaccatcctcccaataacacccctaccacaccaaactagcacacaccaccactcaaccaaccccccacacaataattaacaacctccctctctctctccgctctataaatttaaaaccaaacacaaaaccactctctcccaccaaaatactttaatccccccccacacaataaaacataccaccctctcccctcctcgaccctctcacataaaaaaatacaaac

SEQ ID NO: 678263 - DNA, 344 bp, Homo sapiens
tttaagggggccccaggggggggaatgccctccctttttttccgggccccagggggtttttgggggccccgcctttcacccccgaagtcaagccccccctttttttccctttgttgggattatcccccccccaacgtttgggggcccccattgggggggggggccaatggggggcccccttaatttagggcccccctttgtgggggtttgggggggccccccgtccggccctccgggccatggggcccctagggggggggttttggttttgtttttgttgggtttttttttgggttttgttttttgtttttttgtccccccccataaattttttttttttgtta

SEQ ID NO: 678264 - DNA, 517 bp, Homo sapiens
  misc_feature (2)..(2): n is a, c, g, or t
  misc_feature (9)..(9): n is a, c, g, or t
  misc_feature (103)..(103): n is a, c, g, or t
  misc_feature (322)..(322): n is a, c, g, or t
  misc_feature (376)..(376): n is a, c, g, or t
  misc_feature (387)..(387): n is a, c, g, or t
  misc_feature (391)..(391): n is a, c, g, or t
  misc_feature (405)..(405): n is a, c, g, or t
  misc_feature (420)..(420): n is a, c, g, or t
  misc_feature (476)..(476): n is a, c, g, or t
  misc_feature (498)..(498): n is a, c, g, or t
tnttttctntttttttaggaggaagatatcttgtggtaatggttttagctgttaacattgacatctgtatacttcaaaaaaaaaaaaaggatccagacccacncaggatcatacattccctgagagctgatacattaaaataacaaaaggcccttgtaatgattctctgagataaaaagacaaaaggaattcaagagttaagaatagtataaatagaagtggctgaagtccctgcctttacccttctggaggagaacacgaatctttgggaactagttcaggaaggtaaaaaaatttttttcttctaaagtatgccagttgntttctttctcctcagctctaaatactctgaagtccaaagaagtgtatgttgggngggctcccttnaacnttaacatgggaagngcttctgtgactttngtaagtgcttccatgttttagtaggggtggaatccaatttactttctcccaaatangaagcacgctccccatttgaanggggtccccctttgctttc

SEQ ID NO: 678265 - DNA, 178 bp, Homo sapiens
ggttctgctatccctctatctaacatccatgtagtcttgggaataattctttaaggtaggcctctttttctaggttggggaagttctcgtggatgataccctgaaatatgtcttccaagttgcttccattctccctatctctttcaggacatcagtgaattgtagattgcggtgtttg

SEQ ID NO: 678266 - DNA, 155 bp, Homo sapiens
  misc_feature (51)..(51): n is a, c, g, or t
gattcgatcgagctctgtaccgactgcatctgtgctcgtaaaactcttttntaattgtaacacacagttcagaaaatggcactaaaataaagtccaggataggcacagtggttcatgcctgtaatctcagcactttgggaggcacagattgcagt

SEQ ID NO: 678267 - DNA, 864 bp, Homo sapiens
tgggtttggttttggttggttttttggttccattgggaagttcatctgccttttataacccatttcaccaaaattttcacctgtgtaacaagcttcaccaatgtgaacttttcagagcaactcggcttatttaacagaccttaaaataactcctataggcaagctcagatggaaaagtgcttcgtgcgggctaagggaatcagaggtgcgtccatttaacgggcatagctatttcaaaaagtagaatctcaaatctcgggcaccgaagcattgctaattgggtttgacgggtacctgggggaggctttccactcataattttaacaccgggggtattttttaagaaacgggttggggtaatatatatgggggatctagggatactacatctcaaggcttaatttataatttctagtgtcaatacaaaagttcccctcacagacttctcaaaacagcctcaagcaaatatttgggttatgggcaaatccgttcgcgtggacggcgttaaattactttcaccttcctgggctttaagctggccaaaccaggttgtttcagtttcgttggtacatcagacaaattttttcccgggttttcaacctcattgggggtctcccgtggagcccgtttttaaacccccaagaggttttttctggcaaagttgggcacccaatttttttgaaaggtgcggtccccaagcgggggcttccaacattaccttgggttgggcaaaagaaacacagtctaagcgctatatgcggggccttgctccaggcgggggggcccacccccccacagggtgcccacctgcgcactggcgggggtcccttgcctacacactgccgcagatgggttgtttcgcca

SEQ ID NO: 678268 - DNA, 981 bp, Homo sapiens
  misc_feature (981)..(981): n is a, c, g, or t
ggtggactcgtatgtgtgtatggttgggtatcctgattcggttgttctggggatggaggaggagaaggaagaggaggaagaggaggagggctaagaggcggagtgggaaggagtgggggaggaggggaaggagagggaggagggcgggcttggctatcatacatcaattccgagtcggtggaggttaccgagaggatggcggtgccggtgtccgcgcgctcgtaaaacccagcccatgacccctaacaggggccctctcagtcccctccataatgactctccgggctagccgatgtgatttcacttcgcactcgcataactgctcctcatactaggcctactaagccaacacactaaccatatacccaatgatggcgcgatgtagacacgagaaagcacataccaaggcaccacacaccacctgtccaaagaggccttcgagacgggataatcctattgattacctcagaagttgttttcttgcgcaggattttggctgagccttttaccagctccagtcgtagcccgctacgcccccaagttatggagggcactggccccaacaggcatcagcccgtaagtcccctagaagtcccactcctaagcacatccgtagtactcgcatcaggagtatcaatcagctgagctcaacatagtctaatagaacacaagcgaaaccaaataattcaagcactgtcattacaattgttactgggtctctatttagcctcctaaagctcagagtacttcgagtctcctcacatttccgacgcatctaacgcccattttttgtagcacaagcttcccgactcacagcgtttggtccattccagatctgtcgtcgcatagaatcttatcaaatccttggctcagcccgcgatgattgaaggaaatggccccggggtgaaaaacaccaaaaacgctccgggaaaggtctcccgagccgcagaacaccggccacacattcctcacccccacggn

SEQ ID NO: 678269 - DNA, 258 bp, Homo sapiens
cattggagctcggcacccatccttccttctctcacgcctgtaatcttgacactttgggaggccgaggcgagtggatcacttgaggtcaggagttcgggaccagcctggccatcacggcaagactccatctctactaaaaatacaaaaattagctgggcgtggtggtgcatgcctgtaatcccagctactcgggaggctgagacaggaaaatcgcttgaacccaggaggcggaggttgcggaggttgcaatgagcccag

SEQ ID NO: 678270 - DNA, 435 bp, Homo sapiens
tacatgggggtccttctttaggggggtcttgggcgaggagggccccgggggaatcggggctcatatatcccgcgaatacattattcggcctcacgtggtcataccgtgggttctccgtgacacccgtggttgtgctcagacacccttcacataatattctcccgggcaccgagggagggtgtgggaaaaatagcgtggggctcgaagcgcccccaagagggtctcttcgcgacaagtgtatagccacagggggtggggaacacccttttcgacgcgtggcgagaatgagaggcgcggagcgaatgaggtaggggcccgggggcccttctgcggggagagacaatcattctgcgcgatataccctctgacgattctctgtatgtcccgcccaatctctcttccatctatatatcgcgtgggataaacatatgcgcg

SEQ ID NO: 678271 - DNA, 147 bp, Homo sapiens
tagaggatccccatcatctacattggctccccaccgatgaaggctgagcaagggggaggaagatgaggatggttggaccttcatcagaccactcccttcccccatcctccaggagagggggcaagggcaaaccaccatctactgtgt

SEQ ID NO: 678272 - DNA, 816 bp, Homo sapiens
  misc_feature (377)..(377): n is a, c, g, or t
cagcctttaaggttccaaacactctgctagaagaggaagtgcagatttaaactgagtgaggctgtggagtggtgggaagttgatctgggtctagaccaaagaacttggcaggaacttgcccagagaccctgcgtgcaatcagacctacaggcagtacatggcaggccgtagaatgaataggtggtcacgaagaggggtggaacattcctgcagatggtcttcaatatatgcagatgtcgtctgatatatggaatgaaattaccgtcttttggaacatagttaaataaggtcaaatatacttgagagctttaaacacattaaagcggatgatgacgaatccagaagcatcgcatatattcatgactagccaattgacnaaactcatctagcagatggagactttggacaccagtggcctatttcgcacatgagggagcgtcgggctcgcatggatagtagctccccgaagactagagcgaaaatcgagctgggcctcgtctaataacattttcaacactcgttgtatggagaatggatctagcagaggatgaacggtcgttggagacagggagcgaaaccgcaataagggtcgccttgggtgagtagtgcgagagttcctgaccgtagcctctgggatgaagacctctagcgataggagaagataaatcaatggatagtcgattatggggcgatactaacttacttcatgggaaagtttaacccccttattttgccggctgtcatattcgggggttactactaattccggggggttcaggtcaactgttttatttaattttcaggggattcccttgc

SEQ ID NO: 678273 - DNA, 359 bp, Homo sapiens
  misc_feature (220)..(220): n is a, c, g, or t
aagcccaagatcccaaagggtgtcaaccgcaagctcgattaacttgcctacattgcccaccccaagcttgggaagggtgcttgtgcccgtatttccaaagggctcaggctttcccgcccaaaggccaaggccaaggccaaggccaaggatcaaacccaggcccagggtgcagccccagcttcagttccaggtcaggttcccaaaaggacccaggcccctncaaaggtttcaaagtaaatatttttgccaacataaggaaaaaaggggtggtgcccccccccccccccgcccctggggtaccatttgaaagggggtggggtcctcctttgctttttggtcaaataaccctggggccggga

SEQ ID NO: 678274 - DNA, 160 bp, Homo sapiens
gcgatggggcgtctgtagtccagctactcgggagctgaggtgggaggatcgcttgagcacaggagtactgggctgtagtgcgctatgccgatcgggtgtcgcactaagtacggcatcactatggtgaactcccgggagcgggtgaccaccaggttgccta

SEQ ID NO: 678275 - DNA, 206 bp, Homo sapiens
ctcgtgcgctgtctgctgccggtcgttctacgacggactccccgacccgggtgactgcggttggtgacctgacacggacgtttgacactttaaccgcagacactgacgtgaccgtacttgcgtgtggaacgcccggttgtcccggactgactggggaccgttcttgcttgacttggtgccgacctgacccgacggtgaccgtacgg

SEQ ID NO: 678276 - DNA, 848 bp, Homo sapiens
gcagcgtttcaaagtactgggattacaggcgtgagccaccgcgcccacccggaggtcccctcctttaactccggctggatctatccgcgaggtggggtgggcgccggaataactctctaagggatgtgactgagtctgtttttgcccgtgcacatagacctgcattttatgcagttttgttcacttttgaaagggagtcacgacaaagggagatttggaatgaggcgaggttagttatctcgtattggttgatactgggtggtggaggtttgacagactgccaaatcaggtctgtctagttaccaccacccgcttgttctacactagtgtctcctgcatgacgtagccactgactcttagggaacgtaaacattataataaagatcatttatttccgttatctgctaagcacagtgctaaacctttacacgttttatatctcgtttagtcctcacaataatcctttacttaaacaggtgagagaactggagcccaaagaaggaactgaagcccagggtaaacgagtcagtagatagaagccttccactagcagaaagacgaagaaagaaccacacagaacggcaaagagcagagcaacgcacctgaggggggcacgccacgccgcgagcgtagcggcagcaccgcgcgcgctacagacccagggggcaagcgaggtgccaaaaaggaggggaacaacccgaggaagacgaacatagtattgtgaagaacacaaagaaggggggacaaaaaatgcatgccggcgggaccgcccgcacatatggcgagcagcaccgactataaaaaagtgcacagagagccagacgagggagcacacatgggacataaag

SEQ ID NO: 678277 - DNA, 129 bp, Homo sapiens
cacagtggaaatcatggttaactacttagaatcatccagtcagcgtggactgctcctattttatacagaccagcagattccacagaggaaatgagcagagacaatcagttcccagtgtacactatagtc

SEQ ID NO: 678278 - DNA, 502 bp, Homo sapiens
  misc_feature (2)..(2): n is a, c, g, or t
  misc_feature (61)..(61): n is a, c, g, or t
  misc_feature (71)..(71): n is a, c, g, or t
  misc_feature (75)..(75): n is a, c, g, or t
  misc_feature (103)..(103): n is a, c, g, or t
  misc_feature (110)..(110): n is a, c, g, or t
  misc_feature (112)..(112): n is a, c, g, or t
  misc_feature (115)..(115): n is a, c, g, or t
  misc_feature (137)..(137): n is a, c, g, or t
  misc_feature (189)..(189): n is a, c, g, or t
  misc_feature (194)..(194): n is a, c, g, or t
  misc_feature (253)..(253): n is a, c, g, or t
  misc_feature (272)..(272): n is a, c, g, or t
  misc_feature (293)..(293): n is a, c, g, or t
  misc_feature (296)..(297): n is a, c, g, or t
  misc_feature (341)..(341): n is a, c, g, or t
  misc_feature (366)..(366): n is a, c, g, or t
  misc_feature (370)..(370): n is a, c, g, or t
  misc_feature (377)..(377): n is a, c, g, or t
  misc_feature (384)..(384): n is a, c, g, or t
  misc_feature (396)..(396): n is a, c, g, or t
  misc_feature (435)..(435): n is a, c, g, or t
  misc_feature (484)..(484): n is a, c, g, or t
anggatgtctcatgaccctggtccggtgaagctctcctctgcacacagtctctggaagggnagcagggaanacangacgccctgagccaggaactccacaatnacctccncngancccacctccagctctgcaggangctgcagcgccaccaccaccatcttctcgtcctcgatgatcaggttgcgganttgcnctgccgcgggttgtagttctctacccggtcgtggatctccatgtgcctccgcaggtggncctgtcgggtaaacttgtngccacactcggtgcactcaanctnnctcacccccttgtgccgtctgaagtgcacacgcagttgctccanggctttgaaggtcttgccgcatatntggnagaagtngggccgnttctcctgatgnttgtttgttacgttccttttgttgtgtcccttctcagtnaagcgctgttcacagaactcttttttttttgtctttttttttttttttnttcggtttttctttttca

SEQ ID NO: 678279 - DNA, 508 bp, Homo sapiens
atagacggaagtcgttcacatcattccactgaaactgcctttctaattgcaaaatctaaagagtcctttccaatacttatttcaaacaggcgtctctgggtctttttcaaactccctcccactaatgcctttcaggcatcctccccagcttagcctcccctgggaccagcttcctgccagtcctgaaatgcccacatacacggggaagattcctgcttccacatgaccagcccccagtgacatctccctcagactccagacctcgtctttttttctttttcttttttcttttttttttttggaaacagagtctcactctgtcctaggctggagcgcaatgttcccgtggcggctcactgcagcctcgatctcgcaggctcaagtgatcctctcgcctcagcctcctgaagtgtgggaattacaggcgtgacccaccgcgccgggcctaacttccatctcttgagggctcccacagccacttctcacatgacccagtcagcataaccca

SEQ ID NO: 678280 - DNA, 106 bp, Homo sapiens
ttagagataaccccatcctttacattttgtgcagtagattatttaattaaatgtcttctttcatgttagtagcatccaggagctcaatgcatccaggtgctcaatg

SEQ ID NO: 678281 - DNA, 141 bp, Homo sapiens
atgtacgtagagaggagcttcagtgagcgcagtcgtagcacgtagcactccatactgagtgacagagtgagactccgtctcacgaaaagaaaaagaaaactgtgaattacagttcgggtgtacgtggatcacggcctacag

SEQ ID NO: 678282 - DNA, 120 bp, Homo sapiens
gagcatggtatcagccccgagggcatcgtggagtgagttcgccaccgagggcactgaccggaagggacgtcttttgtctaccagcgcagacgactgagcacatacatcccccgggtccgt

SEQ ID NO: 678283 - DNA, 923 bp, Homo sapiens
agcgggagttgctggtagtgcccgtggtgcttggttcgaggtggccgcttagtatgactccgcggaggtgcatctccctggtattacccgtcctaacgtcgactcgcctttcagtcaggatgtctgcccgtggccccggctatcggcatcgacctgggcaccacctattctgtgcgtcggtgtcttccaacatggcaacggtggagatcatcgaccaacgaccatgggcaatcgtcaccacccccagctacgtggccttcacggacaccgagacgtcctcatcgacgacgctggcaatgaaccaggtggcccatgaaccccatgcaatgactcatcttcgacgccaagaggctgacttggtacggaaattcgacggatgccacagtgcagtcggatattaaacactggcctgttcctgggtgagctgcgcgatgaggacggcaagcccagagtgcaagtagaagtacaagggggagaccaagaccttcttcccatgaaggagatatcctccatggtcctcacgaagatgacagtgagatcgctggaagcctagcctggggggcacactgtgcacatcgcgggtccctaacggtcccggcctatttcaacgactcgcagagccaggccaacaaggacagcaggcaccatcacatgggctcaagtgtgctgctgcatcatcgaacgagcccacggcggcggcatcgcctacggcctggacgagaagggctgcgccgtgcggcgacaagaaccgttgcctcatctttgacccgggggctgcgccactttcgacgttgtccctcctggaccatcgaggatggcatcttcgaaggtgaagtccacgggccgggaaaaccacctgagccgttagaacttcgaccaagcccattggtgagccacctggccgaggaattcacacgccacga

SEQ ID NO: 678284 - DNA, 382 bp, Homo sapiens
aacgctccacccgacggggtgggacgtgcagagaggtatagggtaaaggcaatggaagcagaggatgagaccagcaggccctgggggcttcaggagccttgaccacacctctccggccagagctctcagcgccgcttccagacacagcctcccgcgccttgctcagctccaacatggcaaaaatcttcagccctacagagactgagcggtgcatcgagtccccgattgctgtcttccagaagtatgctggaaaggatgtttataactacactctctgcaagacagaagtcctaagctttatgaatacagaactagctgccttcacaaagaaccagaaggaccttggtgttcttgaccgcatgatgaaagaaactggacacca

SEQ ID NO: 678285 - DNA, 105 bp, Homo sapiens
caaaaagtgtggactcagcgactggtaggaccatcactctcgaagtggagccgagtgacaccattgagaatgatggtcttaccagtcagggtcttcacgaagatc

SEQ ID NO: 678286 - DNA, 302 bp, Homo sapiens
caaataaaaaaaaaggaaggaaaaggaatttaggagggaaaggaaattcctggccggacttccaaggccccccttgaaaggggccctcctttaatttaattccccatcccacccaggggcaccgaaaatttttggtccccctaaaagggggggcatttttttttcaacctccagggcccagcggtggggaaaaaaaaaaaccctgcttaaaaaaggggcctcccaggttggttaaatcagccccactgggccggttcaacccggaaccaaagggcccaccacccaaaacacacggacttggg

SEQ ID NO: 678287 - DNA, 228 bp, Homo sapiens
ggctgtacagaggatccccatttactattggtgaatatgtgctataatggtatggaaatttctaaaatggccacagaaccagttcaggtactgccattgtggtcagaaaacagtaatgatcctaactcttgtgggataatctgtaatattcctggaccttggatttaattcatgtgtcccaagattaaaattaaattatgctatggaacctcctaaaactaggtgggg

SEQ ID NO: 678288 - DNA, 452 bp, Homo sapiens
  misc_feature (452)..(452): n is a, c, g, or t
gtcccggttgagggataggaggttaatggcggataggtgtctgaccgtcccggatgatgcacttatgacacactgatgtcatgattatgaccctccaagtagtttttccccggacaagctcttggtcataaggccccatcacgattgcgaccctgcctagtgatcccctttcatgctttccggcctgctctctttataaccagattccccccatgcccgcccctgccccccttcttaccgtaagtaccaactcactgcccaaccatccgccgcccattcttacgaaccaaactgccaaaacttcctctaggcttcccccagcttcttatgaggccaccagcactctgtttcaaagagatccccctccggccttctgcgtcagactcagagcctgcgctctcctgtgtttgcccctctataatatccgatgctaaaaaacgtcccttccccan

SEQ ID NO: 678289 - DNA, 335 bp, Homo sapiens
cccagctatgcgggaggctgaggcaggagaatcacttgaacccaagaggcggaggttgcagagccccaagatggcaccattgcacttcagcctgctgggtgacacagcgagactctgtcaaaaaaaaaaaaaaaagggaagggaattaaaaaaccccttcaaaaagttgggcgctatggcccatgcctggggtcccagcattttgggattttgagggggggggatcacttgacccccaaatttcggggctccagtaaggtatgtttgccccattgcactccagcctgggaaaaaagggcaaaatctggtctctaaaaaacaaacccaaaaaaaaa

SEQ ID NO: 678290 - DNA, 345 bp, Homo sapiens
  misc_feature (11)..(11): n is a, c, g, or t
  misc_feature (51)..(51): n is a, c, g, or t
  misc_feature (97)..(97): n is a, c, g, or t
  misc_feature (120)..(120): n is a, c, g, or t
  misc_feature (176)..(176): n is a, c, g, or t
  misc_feature (242)..(242): n is a, c, g, or t
  misc_feature (264)..(264): n is a, c, g, or t
  misc_feature (314)..(314): n is a, c, g, or t
gggcagctctngcgtgcgcgaaggctggctgcgcgagcggcgcgtgcgctngggaccaagatggacctcccggcgctgctccccgcccgcgactgcncgctgagggcaacattggcggcngcgcgccgggcgcgcggctgcgcgccgagccccatgctgcgcggctgcgggcgacngccgcgcggcgcagcgcggcgcggcctgctcacttgttctgggcccttaacattggcgggcccggngcgcgcccggggacggcctccnggccaaacccgccggcccgccgaggagcgatcaggctagcgggcgatctncttttcttccgttgctcgctcggaagttgcc

SEQ ID NO: 678291 - DNA, 329 bp, Homo sapiens
  misc_feature (119)..(119): n is a, c, g, or t
gtttccctaccctgggtttgccatcaacctttaagggcctcgattaagccttttttgggaccccttcagcccaggtccccctcagccttggccttcccgctgtggaaacaaccaagggncctttccccccccttagggccccgggcctctttggggagtggccggaaagctcccgggcctttggcctgcagggcagccccagtcattactcagacccggtcccccccttagctgccccccctcgagagcccgatatttttgtagtttttttgcccttgggttttattaaaaagggtagtgtgttcccccccataaacttgttccttaga

SEQ ID NO: 678292 - DNA, 666 bp, Homo sapiens
ggtggatgcggctgatcaaggagttctccatctacatgacaaaagaatggccgcatctctgtggcagaggtcacctccatgcaacgtgggctaccttgcccatgccattcaccaggtcaccaagtaatgtccctggtgcgaggaacaacagagacaatcgctttctgtcttcagcctctgctattgagagcttcgacacagacaatgagagagggtggatggtggtgatgtggatcatttctttgcagcccacagtgtgtaacactcaggcatttgaatgtttctcatgaaaagtagacatgtagtgacacagtgggcataggcatccatggctggcgtctggtaatattaagaccaaactctccccggtccttttttctccaacttttctcaaagagtttacatgtgcaaatgaaagtcagtcgtcacctaaatagaacctgtcaaattagtgccattgcaagtatttcatgaagctttaagctgaagtgtcacggttcctcgtgagaaacgagcgacacgttagaggctttgagagaaggcctaggttctgtctatgaggtagtcggctcgtgtctgtcctcccatcttggaacaaccttatcaacaggccgcactgcagaaatgatgttttatgaaagagcaatgaggctgctgacactccag

SEQ ID NO: 678293 - DNA, 554 bp, Homo sapiens
  misc_feature (40)..(40): n is a, c, g, or t
  misc_feature (444)..(444): n is a, c, g, or t
aacatggatggacctggaggacactatgctagtgaaatangccatgatctcacttggatatggaatcacaaaattgaactcacaagcagagtgtagaaaggtggtttcatggactggagggaggggataaatggggagatgttggtcaagggtacaaagtttcagttaaacaggagtagtacgttctggagacctgttgtgcagcagggtgactagttaatgtatacttgaaaattgctaggagtagatctcaccaggagaaatgaatatgtgaggtgatggatgtaactagcttgattgtggtaatcaatttcgcaatgtgtacatatatcaaaacatcacattgtacaaaatacatacagtttttgtcaatttaaagatatcagaattctagaatatgataaagttgtgttttcaagcaagtaaagatagattacttaaaanaaaatatatattaataattttattttaaatacttgtggggggtccttgtacccattttgttcctattatgagtcttattcaaatttattggccgttttttttacattctt

SEQ ID NO: 678294 - DNA, 444 bp, Homo sapiens
  misc_feature (315)..(315): n is a, c, g, or t
  misc_feature (344)..(344): n is a, c, g, or t
  misc_feature (383)..(383): n is a, c, g, or t
  misc_feature (396)..(396): n is a, c, g, or t
  misc_feature (413)..(413): n is a, c, g, or t
  misc_feature (431)..(431): n is a, c, g, or t
  misc_feature (439)..(439): n is a, c, g, or t
gttatgaaaaacaattaggaaaggataggtaaatgtaaaataggtgaagggtggggcttaatcacaagaaagcaagccaaacgagaaaatagcttctcaatctcgtccgtgtattttacttgtagcttggatttcgggctttcaactgtctttgccttgtcttctagtaattaagtatgtaccttggaggtagggtttcaccatggacccaccttcatctgcctaggcatttggctgcctcctgccactgtcactgggaattttagcccagagtgccctctttgagtcattcccttcagggctcaatggcccttnactccaaagctggcaggggtttgcacttncttgtggaggaaaggggaggttggccagtttcacactgncaggaagcctccntcagtttgaggaggacnttaattaaggcaatgggntgtttccnttgtt

SEQ ID NO: 678295 - DNA, 685 bp, Homo sapiens
tgctttgaacacatcttctgctgaacattatgtagcagacctgcttaacttggacttgaaatgtacctgatgaacaaaacttttttaacaaaaatgttttctttggagacccttggctccagtcctatggcagaaaacgtgaacattcctgcaaagtattatggtaacaaaacactgtaactctggtaaatgttctgtggtgatggtaacattccacagattctacctttggtgttcgtctttttttttacaatggtttaaagccatttcaggtcccagtggtcaagataagggaaatggtgataatagcggtttcatcatggtctccaggagagctttccagagtggatcatttcccctcatgggtactctggctcagcaagttggccacgtaggtccaggtggtagtcggtcacttttttcgagacgggagtctcaactctgttacccaggctggattgcacggggcgacaatctgtgggctcaattataacctcacattctccgttggtgccaagcaattcccctgtgccttgtagactccgggagtaggctgggactatacagcgcacaccacacacacagcgcccagtaaggtatagggatccaaggaacagacggggtttcaccatggcaaaggcccagtgtggcaacgtaggttctcaaaggcaagggggcgtagaaa

SEQ ID NO: 678296 - DNA, 482 bp, Homo sapiens
aatctcgaggatccccccgccagcccttaaccttacagctgcgactcctcatacaggcagctcagagagtgaggtgagactcatggaggacgctgactatgctatgctgccctgcagagggagagccactcctgcacagattgtgacccacactatacacaactctaagcaccgccggcgaacagtgttattggtgttgctttaattgacactgttgatgaaggtgctgagcatacgatagactcaaggtttacaaggctagaggcccggctcgttggcctccagaaagcggtcttcaccccaaaggtaaaccctgacccattccatctatcttggctctgcaccacagcctgtgatctgtgtgtcatctccatgccagacacttgctactctgtgctctagactgcaaatcaaagcaggtggctagtgagaatagcctttctaatggagttccgtcacgtttggcttaagtgccaaaaccc

SEQ ID NO: 678297 - DNA, 662 bp, Homo sapiens
caaggaagtcgagacagcctgggtaacatggcgagaccctgatatcaatattaaataaaatttaagagatagattctaagactaagtaagattggtttacgcttattttagctagctgtgacaaggacctgacataaaataaatgatgtctttctgactcacaatataaaactggccgtcatatcatatagagtagtgatagaggatttcagcaccctgggagatgctaaatatggtatagctgctaagtcttttctttgctgacaaagaattttatatcttaggagataaagaagagagtggtcataagtttaatctgtaagaacaaattgcttggtgaagtagaagtgattggaagtttttgggaacaggaaccatgacccaccccctaaagtttattacagcagaaatgaggagttctgagcatgtactttagggaaacagattttaaaatgtaaacatcattccaccctctgcaattttaaaaaagataatccttagagaaaattgaaagattgtcaacaagtaaaattatgattcactgcaaacaatactatgagaagaaaagttgccaggtggtgctgctactggtctggggaccacgctttgggaggtacccatgtatccattggctttgtgactatggtaacacttaactctat

SEQ ID NO: 678298 - DNA, 123 bp, Homo sapiens
ttttttggttgagtcaaagcgtcacattggttttgtttatggtttggtttatctcatcttggaccgccggttgatgtgccgatgacctgcgggccccgctcctctgctggcattctaatctcg

SEQ ID NO: 678299 - DNA, 377 bp, Homo sapiens
gtatcagatttgatatataccaaacaacaacactctcataaaacagaacatacctcccccgtgaacaggagatgcttcttccccaggcctgacatctccctactgtgagaagttcaggtcatacaactccaggcttctttctgaccccttagtcaacctgctaaggatgtctggatgtatgtccgttaaaaactcatgtagaaatgtgatccccaatgttggaggtggggtctactgggaggtgcctgggttatggtggcagatccatcatgaatgtcgtagtaccatcttcatcctggcagtggcaagtgagtatgcactctattagttcccacgaaagcaggttgtgaaagaacctggcacctcccaacaacctc

SEQ ID NO: 678300 - DNA, 213 bp, Homo sapiens
cataatgcatgtggcacttacggtccaaggtctccagagggtgcaagctggagtcagtcaatgtcctacgtgagacagcacagccaacctagctagcaacatgtggtttagtctgaacaatatatccttatagaatccagtcaaagatacacaatctagaaacagcttcataggggtggcactctacacagtagtggccaaattgttttcagc

SEQ ID NO: 678301 - DNA, 646 bp, Homo sapiens
actagttctagatcgcgagcggccatcctgcacttcagactatatgtcggagcacggatctagcactaacatgtcagtatgagacaccccttgccccagccaaatagagtctatagagattcaaagtccggatatggagttactcatttccagtggctcacaggtagctggaaagtaaattgtaactgtaaggaagatcagtacacactaacagacattccaggattgtggttgtaaaagcaattctgtaactatccagatatttagtaatgtaattacttgttacttcagattttaggtaaggaggggtggagacaagtagtgaatatatgaaactggtggtaatactccatgttctgaattattagcaagttgctctaatatactcatgatattgtaagtattggacatgtaggagttaaagaatatctataacaatagtcaattcttaagatactttagtcttgatttttgaacaggtatctatgcctatattaatattttggaatcaattggtctagtgactctaggatcaatgaatatacacaacgaaatactcatacagcatattgagacatctcatacaaagaatttgcacccgtatagagaaaacctaatattttccaatactagcttgaaaaccaga

SEQ ID NO: 678302 - DNA, 645 bp, Homo sapiens
aaaataaaaaaaaaaccagggggggtggtggcctcgggtatctccaccttcccgtgggctcttaaaatgagaactgggtttttcccagagaggtgaacctccagtaagcagaattaccccccgcgctcaacattgtgggcaaaagagagaaccccctttataaaaaaaaaaaaaaaattctgagctttttcttctcccggcctcaatattggtacgaatatgaaattctcccccaaaaaagggggttggggtaaagatttccttttttcccaacaaaaaatggcctaaaaaaaaaacgggttttttcccgaattttgttaaaaagaataaaaagggccccttaaaaggtatttccccccgctgcccggggggggaaaaaaaaaaaaaagccattttttttttagaggttacacccctggtaacgggatttttttaagtatgtccccgccccaagaaaaaattaaaacttttggactagggcagtttgtgcaaccttttgggcccctcacgcaaagggggggtaaatttcaaaaaccccggggggccggtttaaaatttttatggagggccggtttattttcaaaaaaagggggggcccccccaaaaaaaaaaaaccccccccttaaaaagtatggtttaatggca

SEQ ID NO: 678303 - DNA, 1409 bp, Homo sapiens
tagggctcgcccgtgcgggggtcgcgtgtgtggtgcgggcacgtcttgtgggtacgcgttgggtttgtcgggttgggtggcgccctggcgtggtgtggggggtcgcttgcgggtgcgttgtggccgttcgttctgttgtgggcccgcggctgggtgtgtgtgccgtgtggggcgcgtgggggctctctgagcgggttttctggtgctctgctggggagcagggggggggggtgtggtgtgtgtggtggggtggggcgtggggtaatgttcgtgggggggtgtgggggcggggctgttgtggggacggtgttgggggggtgtgtgggggggcgcccgctttatgcctgcccgttggggtgtgcgtgcccgcctatccggagttttggggtggcccgccgtagttgggagctcgcgtagggatccgcgcccaggggtggtcccccagtgaggccagggcgtgggtgtataagcggggcgggcccccgttgtagtgagtttaccgggtcccttataggggttattccgaaggcccctctggggttgtggccgagagtttctgggcctaccgatggggccacccctttccccaggggaatatccccccggggcgccccttttgtggggcgccggagttcccaggccgttttccccccggccgggaggctctctcaagggaggcctgcgttgccgaggatggagagcttggcgccccctggggacccccggcctcgaggtttttttccggggaaatttgtggagcttacccacccacaaatgtgtcacgcgaggtggttgttcttggagcacccccgaccccaggtggtctggccgcagaggttggacctcttttgtggcgaggtgatatgtggcgcctgtcacgtgtgccgttgcctcttggtcttcttatctgtccacccgagggtatctgtcacaaggagcttgccccccctcacagagggccccccctttgggtctcccggtatgccctctgtgcgtcacccggggggtgtccgcctggcctttcgcggggcctggggcacttgtcgtgcgccaccaccgccccttctctatcccttcttcttcctcgtaacccctcttcacaattctggagacttggcccacggttctttctgcgagtccacgcgtataccccactctttatccctatggagggcccacagaagaatttgaagggctcccttcctcacggatgcccacgccgaaatgaaggggtatgaagcccacttctggggcccacgcctgcctgccgcaacccctgtggcctcccttgtggaatgggaagaaggcgggatctgctctgaggccctcgaggctcacccgagcgtgcccccatgagacccccatgggaaagggcctatttaactccttattaaaaactggcctccaga

SEQ ID NO: 678304 - DNA, 1200 bp, Homo sapiens
  misc_feature (340)..(340): n is a, c, g, or t
  misc_feature (497)..(497): n is a, c, g, or t
cgggacgcgtgggtgcactgttcagaagtaacagagagagctgggttctcaagggtcggccacccaagtgataagtcagctggtggtttcaaggctcctgatataaggtccgatgcccaatgtttttcaaaccgaagacgttggggatgacgtagaacgaggaacatgatgagttggtcattgagagcgatcttgcagagagaatcctgggtagtctttactcgtgtctggtctcgttacaggccccgaagcacgaatagaatgtttacaacgttatggtatgcccaccatgctgattagcgatacaggttggcgagcggttggtaagctccgtgataantggtatctacgagtagcgagggggtcaagcttcctctgaaaaacgcataaaatcaaagtcactagtaagacaagctaaatgttcagtacatgccgttcaggaacgtggtgaagttgcgttttaatcggcttggatgcacagcaaacactagcctggntttccaaaggagcccaagtgcgttgttgtccgcgataaagccatcttgtggtatgctgtgaaggctatagtctatgcaacttggaggagatagcgtaggtggagaacgttaatcggaggaccgtagcaaagatacgacacgtgagaaacgatgagtggacgatggtaagccctttagcttgtgcttggcaactggagtgcagcaggtgtgggttcatgactggcgttatgtgatgacactggaactcatgtactggtgattttccaagggtctgactccatgcgtacgaatgggccatgagaccgaatagtagggcctagggtcagatggcgcattgcgcgcatagcactttcataataggagagggtgctaatggcacccactccgggataagatccctctgggctgtaaagggctctcaaaagcatgggaacctgcaggtgaaaaaaaaacggtggaaaaagggggacaataatatgcggtaaaagagcgtttaatccgcgtgattagagatggggtaaataaaaacacaagaagagtattacaaaaacaacaaggtgaagagcatatactacaaaattaggataataactagttaaggaaagaatcatatgaatgtagagaaatgattgagagtaagatagtaaaaaataatatgtagctacgaagatgactatagttttatttatatattattatatgg

SEQ ID NO: 678305 - DNA, 117 bp, Homo sapiens
agagcatcctaacagtggtgctgcagaaggtgttgaagttttcatactcgggcatgtcctggtagccggctttacgccactgggctatggtctcaccaagataaatgacaatttgaa

SEQ ID NO: 678306 - DNA, 301 bp, Homo sapiens
agacacaggctcaagatggctagtttctggaggatttttatcatgaggggatgctggattttattaaaagcttttcccatgtctattgagatacacagatggttttaattctgtttatgtggtgaatcacatttattgatttgtatatgttaaaccaaactcgcatcccacgaatgaagcctacttgatgatgatgaattaactttttaatgtgctgctgggttttgttgctagtattttgttaaggatttttgcatctgtgttcagcaaggcattgtgtgtcatgtggatcttagttacc

SEQ ID NO: 678307 - DNA, 201 bp, Homo sapiens
agattgatatatgtctgtaagctattaaagaattagaggatgtttgtttctctataaagattagccttttacttgcaaaaagaaaactacaaagtttatagatatacttgctaatttttaaactttctgaaacgattagctgtagccaaatatgtggtttacgtttgctacattagaatttgaaatgcaatatgtgtggta

SEQ ID NO: 678308 - DNA, 606 bp, Homo sapiens
agagagtcagaaagaatcaaggtaggtatgtttaaaaaaccaaatgaaagtgagacaattagtaatttccaggaaaacaaaaaagcagtacaaaaaacaagtctgcttataattacactacctgactcaactgtgaataatatttaccatttaatgatgtaaatactgaatattaatctaacaaaaaattaagatatacactcctggaaggatgaggggatgataatcgtatgtaagagagcaaaaccccacatctttcatagtaccaagtcattaaacagctaaaactataaatgaaaatacagcagtaaaaaagcttccttggaaacatagggaaaatgccaaaagaaagagttaaaggcttgaaattactcctcatagaagtaagaatcctaggttcagaggggtggggaagattactattttttcttatgagccttgtagaatcatttttctttttatttactgtgacaagtataaatataaaggtgaagaaaagtttaggaacattacatgctaataatgatggaagttacttgtccaaggccattcagctgaaaagaggcagggcaggatctaaattctttactcattacaagtcacgtg

SEQ ID NO: 678309 - DNA, 286 bp, Homo sapiens
tctgtggccacagatgcatattacaagcccatccagagccattatgaagagaaagtggcaattttattctcagcctgagaaatccacaccaatctagtctgggtttccaaggatctgccgtttaagtcacttagcctctatcctttccgggaacaacctgcccctagagagggtgaacgagaatcgtccccagtgcctccaacataacaaacccaatcgccctgttaactttaaatcttcaactcgagaaaaaggctcatgactacttctaaccatgcccaaaccc

SEQ ID NO: 678310 - DNA, 443 bp, Homo sapiens
  misc_feature (329)..(329): n is a, c, g, or t
tcagcctgcctacaaatacatagactgctgctggtagtgagaggggacatcatggtgttactcgtagtgagcatctgcatgagctcatcgttgtactgttgaggttgtcggcctggcccagtgttctgttggccgcagagtgataaaggaaggggcgggataatccatgccagcggatgctcctctttgaggtcttgtccagtctgcgcgaccttgagagtgtctgccttatacttaaacttatctgggacgtcttgctggtttagtggaaagagccggacaaacttgaaactttctgcaaccacatagaaaggtttgttctgtgcttnggcacacacagccatctggttggttccaatcttgttaataattcctccgttttcaactttacaccagcaacagctatgacaaatccttactccatgatgtagacgacagcagat

SEQ ID NO: 678311 - DNA, 417 bp, Homo sapiens
atttatttcccggcaaaaggctcaattcctagtgcattgcttatctcatggtagggaagcaaataagatttcctgaaaaaatacataggtttttcaaaacttcccaactttttggcctccaagagcttaagtatttccattttcattctcaagttcattttatgggccaaaatggaaatgaatagtcatctaaacgtggatttcttccaacctgttcatttcaaatataaaagctaatagtaccttttatttaggacccattgggtgcaggcaccaagctaaaagcccttcccacatcatctaattaataactctatgaggcagatacttttattatttccatttcacagattagttagttgaggcaagttcatgcagctatgaacgggcaatgccatagtttgaacttagccagtg

SEQ ID NO: 678312 - DNA, 323 bp, Homo sapiens
tttttttttgggggggttttttttttataaaaaagcctcaaaattttttccccagagaagtttttttcgcccttttttaaaggggacccacaccccatttttggcggggtatacacaccaaagtttttttttctcccctggggggttcttggagggtgttttcccccctgggggttttcccccaaaaaaatggtcttcaaatttccatttgcctccccggttttccccaaattgttagccaaaattttccgggttttttaggttttaatgccctttgccctgcctaaatgattctggcttttggaaataaccttgatgctcaa

SEQ ID NO: 678313 - DNA, 980 bp, Homo sapiens
gcgcaagtagctagagtgtgaaatttctttcgctttagcttcaagtgctaacatacgatgcccacgcgtattgagccttttttacatttgtctgcgcgaaagcgtttctgccgggtttcgaaactcttgctcatggcggtttctccctgatagtaaaatttggcgcaacctgagaaatcgccccccaggccgaattagccacactatggggggaccacacaaccaaacaggggggacacaacgacctgcgaaattcccccaccggtatgatgggggacccaaacatcttactccttgcgggcatgacccgttctctacaccgtccctggtctctggccccccccctcttgccgtgggcaactctgtcctccatagctccgctgtctttttcctagtccttggtcttttccccccccgttgttgctcacgcgccccgggtggctcccaacaaaggcttttgtggccccccctcgccccatctcaccactcgggtgcgacaacacaggcgccctattattttcgtgcagcggggacccacagcgaggattcttccggctcgccgtgcctactcccctcaggagggtcttcccatgctccttaggcacgcgcttcctgccgtgatgaccccgggcatactgttggactcccccttcctcccctgcggaagacataccgcgaaaatgtgctcttggggagtcctcacaagggagggcacagacattcacagcccgggcgtgattgagtgggcgacccacctggttctcccaatggagcaggagccccacacagcagatatgtgccacggcggggagtgcaggcggaccaccccggaaagacaaaacacgcgggggctctacacacaaggagcccaccaaacgagcaaagggatcaatcaacccccgaaggctgccaggagcagaagccccccagttttttttcaggtttaaacccaaaaaagaccccttttcccccaccaaaaa

SEQ ID NO: 678314 - DNA, 458 bp, Homo sapiens
  misc_feature (453)..(453): n is a, c, g, or t
gggcaacccgctcgggtccccttccacactgtggaagctttgttcttttgctctttgcaataaatcttgctactgctcactctttttgtccacgctgcttttatgagctgtaacactcaccgcgaagatctgcagcttcactcctgagcccagcaagaccacgagcccaccgggaggaatgaacaactccagacacgctaccttaagagctgtaccactcaccgcgaaggtctgcagcttcactcctgagccagcgagaccacgaacccaccagaaggaagaaactccgaacacatctgaacatcagaagggacagactccagacacgccaccttaagagctgtaacactcaccgcgagggtccacggcttcattcttgaagtcagtgagaccaagaacccaccaattccggacacagtgctgagaatcatgccttgaaatctagcagctctngttaa

SEQ ID NO: 678315 - DNA, 615 bp, Homo sapiens
acttccttcctgtcctgttcaatagtgatcttacgactgcatcaggcagtgtagaccttctaatccgccatgaaactcctccctggaattatacacatactatcaactctactatttgatcatcctcagtatcttgaatgggcttgccacccgtgtaggccccttacatgttgtctactcccaaattatcgtactatgctaaatatggaattgagtgtgaaaagtgcctcctaagccaatctgtttctaatacatgtacatagtagtaagaaaaaacatgggggaatccaataaggaaaaacccagtatggtgtggtatcagagggtcttgttatgatgagtctactgggaatatattatgtagagtagataggttattgtaaatggtctttttctcagaggagatcagtttctttaattgtttcattccttgaagggacaatgtcaaagctgttgagcccaaaaacaccccctttgactcatttagctcacatggacaaattttccctaaagaatgcagaaaggaatctctacaaagcaattaattaatcctcttttgcccaactgcaagcagtagcacatgagccttggcatttcctgtcactttataacaaa

SEQ ID NO: 678316 - DNA, 279 bp, Homo sapiens
cataataaacatgtaccacatcatgtataagtgtacatcatgtctcagtgtcaaatataggtaattattgcaacatttcaaacattctcattgtctctgctatggtgatctatgatcagtggtctttgatgttactattgtaattgttttggttagccacaaaccacaacaatataagacagcaaacttaatcgatcggtgttgtgtatgttatgaatattccaccagctggccattccccatctctcttcctatcctcaggcctccctattccctgag

SEQ ID NO: 678317 - DNA, 479 bp, Homo sapiens
tcgctctgaggattccccgtattttgctctacaaagtttccggtattcgaaagagcaaccagcagaaccggggacccatcaattgcagcaaccggtgcacagaattagtggagtacaccagcaaagatgaggttgctgttggtatttgggtttcccgggccctgattatgtttgtcacattcagaacacacatacaactttaagaagtttggctgaagtcactaaagtcgttgtccgaaacttgaattaaaattattgatataaactactatcctgtaccagaggcattcctatcaattaaacgccatcgccccattggattgggggtacaaggtctggcagatgctttattcctgattagataccctttttgagattgcagaagcccagttactgaattagcagatctttgaaactatttattttggtgctctggaaaccagttgtgacctttgccaaggagcagggcccatacgaaa

SEQ ID NO: 678318 - DNA, 892 bp, Homo sapiens
tcgcagtggaggaatatatgcgcggtgtggcggggaactcattcgcgcccgctgtggtcgcccttgacgttcctgccgggggtgtacaaccttttgttcatggaacttgaccgcccttcctatggccgccgagctttttgtggccccccgccgtgtaatgtgaacttaggaacatatttggtcgcctcctagaagtgtgtcgtggaacaccccctgcattgggggacaactccccccatgtgttgagcaaccgccccctcatgcgaaacaatgggccccacgctggttttggccgctcgtggtgtcctttaagcggctgtgctttaaacgtacgcgcttaggatgtcggtccatcccgaaacgggtaggcgttgagcatgctgtaaagtttttcccgggcgccttttttgtgcaccgggagcatccctttggccacttaagtggcccacaaagtgcgttgccccccgtggagacactcagtcacaatcaatgataacagaaagttgctttgccaaaaataacaattgttcttggggtttaacagacccgtaaaagtagggtcctccaggcgtctgtgtgagaagccgtgatcctactaaaaggggcaaaaaacatcagaaatattgatccagggcgtgtcctttcacgggaaaataaggagcgagtctatctgcaccgccgaaatcagttcatgaggggaactagtcgggagacatatgtttgcgcgcacttctctcttgcattggcacgatcaggagcgagtccccttctaattggggtgtttaaagcgcagcattcctccaatgacgccctgtactgctggggggctttcacaatctttgcggagataaaaaaaatttttacaacaacaaagttttcaaaccacaaaaca

SEQ ID NO: 678319 - DNA, 130 bp, Homo sapiens
acctgtaaaaaggcacagaggctggagagaaggtgcatgtcccagactgcatgggctcggggtagggggatgcgaggtctgaactggcatagtggccaggatctcgagctctactccatggacagggggg

SEQ ID NO: 678320 - DNA, 282 bp, Homo sapiens
gaccagaggactcttcagaggcaccaaggaggtgtgagcatagatgctgtgtacttctgcattggggagtgtgatggcttaatattgagctgtcaacttgattgaattgaaggacgcaatgtatcgtcactgggtgtgtctgtgaggcgtgttgccaacaggagattaacacttcgccgtcgcgtggcactggcgagcaagcacgacccaccccatccttcctttggctgccctcctgggggctaccggagcctcgaacttcgctaactcactggctcacta

SEQ ID NO: 678321 - DNA, 192 bp, Homo sapiens
cgtgctcgtgttgttgctggcccgcggagtgtctgctcatcctctctgcttcttactcctcagtctgcttctgggttcagctgccaaaccaaatactcacagcttcctggatgcaaggacccgctaggctgcaggtctgacacccacaggcctccaagccggtcccaacaagcccctcgccgccccacaggc

SEQ ID NO: 678322 - DNA, 229 bp, Homo sapiens
tcagcggcctgcacagtgatgacctcatgaatgactatcctaaattgaagtatgcagttctctatttgctgggtttatacagtgctggttcatcgtgagtaagaagcctgccttgcatgtacctgggcagatgccatagttttcgtatactcggctgtttggtagtagatacgtggtctgtgatatagtggaataggagaacacacgtagtcggtgctatctgggtagc

SEQ ID NO: 678323 - DNA, 212 bp, Homo sapiens
attaaaagggttttttttcttcccccaaccccaaaaggggggttttagccccccgggaaggggccccccccttttttaacccccgggggggccttttttttcccccccccccccctcccaaaggggtcctctttccgggccctttttttttttttttggccccaaaattgggggggggggggccccaaaaaccccaacccccccttttttga

SEQ ID NO: 678324 - DNA, 115 bp, Homo sapiens
cgctctagaggaccctgttgctacggtggagtgcctggcttttaagacagggtctccgctggcacggtggctcgcgctgtaatcccagcgcttatgggaggctgaggcggtgaat

SEQ ID NO: 678325 - DNA, 254 bp, Homo sapiens
ttctggggatattcagaagctgctaaaaaacggatcccccggtttccgactgagtttggggattttggccttgttgaccctcctaggtgccctgggaattgcaaacagctttttggatgaaaatttgggcctcaatattgccaagaaactgagggggcaattttaacttttttttttccctttaaagcttgcagaaactgttccccccatgaaggtaatatgggatcatttgttaaataaaaataaagtcttta

SEQ ID NO: 678326 - DNA, 492 bp, Homo sapiens
gtgtgcgcagtgatctagaggatccggggtcatcgatgcactccacatcactccggcttaagaactattctctctttttaaaaactaactttacgtgggcggggcacaggggctcaggccggtaatcccagcacttggagaggccagggcaagaggatcactggaccctaggaatccggacagccggggcgtggtctggcaaaaggcttccaaagccaccttagccggttctattcagcggcaaccccaaagcaccggttaagactccggacccccaaggtggcatgcagcccccaggcccacggggaccgggtcagcacagatctggatgacttcccttgctagggcagagggggagggtatccaggaatcgggcccggccccaggggcgttttcaggcggtacagggacctaaagtgggtaagatggtcataagggaccagtccaggtgatttcagtatatacaattccaccagacccctccaacccgat

SEQ ID NO: 678327 - DNA, 308 bp, Homo sapiens
  misc_feature (170)..(170): n is a, c, g, or t
  misc_feature (252)..(253): n is a, c, g, or t
  misc_feature (296)..(297): n is a, c, g, or t
agaagacggtagatgagcgtggacccttgccgctctcgtccgcacttgtgagtgtgtgtgcgccgcagacgcacacacacacacacatattctctctctctcttatgcacacatccatccacatcccaacaattgcaggtgctaagtttggacataacccagtggactcnttcccgtgacttcgtgtcgaggtccgtggaaaggaagcaagtaataacatgaagacggcagctgggacgtgctcagatgcanntctctcctcttccaactgaagaagcgggcaagagggggatccnntctagagtcga

SEQ ID NO: 678328 - DNA, 1117 bp, Homo sapiens
  misc_feature (333)..(333): n is a, c, g, or t
  misc_feature (562)..(562): n is a, c, g, or t
gagcgcaacggcgggggagcatgaacgccccgtccagccttcgagatcgttacttgctcttcgagggcgagaaggatcactcattaatagaggacacgcatagggttaccgcatagtgcgccatgtattattcaccgagtgaagctgatagaagtacccactacgactggtgagaaccatcgatataaatcgacggtgcctggctgtcccctgtgccgccttctggccgtgcatagtcgagtcttcactgaaggcctccaccaggccgatcggctttcctggtacagtgctgactagaacctgtaggaacttacgccttgccctgacagaggnctagcggagatcgaaggacggatacgaggacagcacggtctccctaggataaaggcaggctggtaagtgcacgtgagtgaccatcttaggcgtcagctgcaagcgcatcgaacctcccgaggctcgaggtgatcctccacacgcatcaggtccttaaaggacagcagtcgctaacattcggcggactcgttgtgagacgaaggtagaatccaacgagggtcagacgttnaggccggtgcatacgtccctttggggcacggctaggtatccttgtaggcttgcccctgccttccttcctgcgatgcacctcccttggtcaaggctgctcctgggtggtgtcgggcgcggcggcgtcaagtcccaagtgccttggtggtttgggaacctggtgactggttcctccgttacagtaggacccgtacctcatgcgtcgatggaccgagtactctcaactgggagctgagggagatttcgtgtccacccaaaaacttgtccgaaacaggaaaggtttctggaagcaccggaaaggtggcgataggcattaccagcacgggtggccataccatcggacgaattggccacggtgacacccaaggtttgcaccctttatggcccacagggacagagaaactcacacgatccattggggggaaggcccctcacatggagggggattggaaagaccagcctgcgaaacgacgcgggacaagggggcaatcgacaccgatattgcggcacaacaacggtgggacaccggttttgggccccgggcgcacaaaagggg

SEQ ID NO: 678329 - DNA, 323 bp, Homo sapiens
  misc_feature (13)..(13): n is a, c, g, or t
  misc_feature (43)..(44): n is a, c, g, or t
  misc_feature (108)..(108): n is a, c, g, or t
  misc_feature (171)..(171): n is a, c, g, or t
  misc_feature (263)..(263): n is a, c, g, or t
gatccatagcgcnttctcaatgtgtgtcacccggaaccctgcnnggggagggaacactggggtttaggaccacaactcagaggctgcttggccctcccctctgaccangcttatcctgagtttggtggctacttccctctggcctaaggtaggggaggccttctcagattntgggggcacattgtgtagcctgacttctgcaggagctcccaattccaggaaggaaaagagccaaggccccacttttggggatcagggtgggncctgatcactggggcccctacctcagcccccctttcccctggaagcacctgcccacctgc

SEQ ID NO: 678330 - DNA, 1398 bp, Homo sapiens
ttgataagttgaaacacccttggtgttgagagacgcccatctgcccctctgcttgtcctaagagagatgagggggttccccacccagccccactacaacggcgaaaatttgtgtgtggacagatacttgtcgtgggagaacttgttcccgtgggcatattagagtgacacgttccttccaccttctgtgagaggattataatttcctgcgtgcggagaaaattaagcctactgtgtgacctctacttgcttttaaggggccctcaccggccaaggattttctgttgcgggcttttgtgggttaatgaaagaaaaatgaaaatagcattgtgtggccttctcttaatgtttaaccttggggggggtttcacccagagcaacatgtgtcccagcgaagtattttcttaaggttcttggggtttttttaagaaaagtcccaccttgtgaggaaaaatgaggtctgtgactatccccgggggatctttggtcacagcgcattttttaaaagatgcgcggtttgtagaaagatgcccccagtcccccgtatttggtctctgggcgccttcgtggcccgatagaaaagtgttgcggtggccaactatggcgccttgggcccctcctttgtgcggtttgggtgttttaaaacaataggcttgttcattgtccttggcgacccacaagagcctctgttgttaaagtaaaaattatctttacaggggggaggccccccccccctctttgggggagagtcttttgagatataagatacccacaggtgtcaacagccccctgttgtcttctccccctctcaaagtacataatgatatatatgagaccctctgtaacacgatgtctccataagagacatatatataggtaaatttctctgagaatgagattgtaaaattttgagaggagatattgttataataacacaataaaaatacccaagtgtgatcacaaacctttctgtgcccacactcacgagattgtcttttctctccacatcacatggtaaccttatggttattttctccacatgttaaccctaacaccacctgagttttgtaatggctaactccctctggtagaaacccacaaatttctgggtttgagactcacggtttttggggtttaataaaactctttggaaatgggtaaccccgctgttaatgtgaaagaaattatgagcctaatcacgtcaataagctaaaataagtgaaacctcacaaaaggggtaaacttttgagctaattcacatgtgagggtttggtattttgcacatttaatgtaacacatggctgtaaaattttgggcactttactctgtatttatgttattttagctgacttttacttgaattgttccaaattttataacaatttaaatacgctcatga

SEQ ID NO: 678331 - DNA, 234 bp, Homo sapiens
actatcatactacatgataactctagataataatagtaatatatacttcaaaactgatgaaagtaatttaaatattctcatcaccaaaacagttgagaaatacttttcatgaaacacatggcaggtcataaataaggacaaatttatttgtagattcataattaatgtaggtaagttaaaaatttttatatcaggaactaagtatttcaccctaagggagaggggaaagagtct

SEQ ID NO: 678332 - DNA, 183 bp, Homo sapiens
  misc_feature (17)..(17): n is a, c, g, or t
ggtcagataagatgaanaggtatcatgccagggggctgtgagtctaaagattagggtgaaagaacacggcatacagtcaccctccatatcttgcatcaaaaatattcagggaaaaaaacaaaacacaaaaaatagcaatacattactaaataattgccaattttttaaaaatttagtattttt

SEQ ID NO: 678333 - DNA, 171 bp, Homo sapiens
gtccccccccccccccccccccaaggtaaaaccgaggttttttttaaatttttggttttcccccggggggggtgtttggggcccccccccggggggggggccctttttttttgttggggtttttttccttttttgtggggggtggtatttataaaccccggggccccttta

SEQ ID NO: 678334 - DNA, 265 bp, Homo sapiens
  misc_feature (110)..(110): n is a, c, g, or t
  misc_feature (127)..(127): n is a, c, g, or t
  misc_feature (200)..(200): n is a, c, g, or t
  misc_feature (261)..(261): n is a, c, g, or t
aggcaaagcgggaaagaaagaaggaacgagagaggcgatgacggcggaggcgacacggaaagaaagggggcaggaccttcgggaggggaacaaaccagaaagagggaagnagagagcttacacgcangacggaggagaaaaccacgcgacggaccagcgcacgaccgacgacaagagaacagcacagagcgcgccggcangcaacacacgaacagcagcgacggagcgcagcagcgacgacacgcggcgcgagccacgcgnagcc

SEQ ID NO: 678335 - DNA, 235 bp, Homo sapiens
gaaatgtttatattttcttattgaacctttatcattatgtagtgatgcctccatttcaaatgcttcttctctttttgtatcatactaacagagccacaccaacttcctttttgttgacctaatatgctattttttacacttttactttcctactcttaacccctaggctagcctgcttctctacacttttactttcaaacatttcatgtcattctgctttgctgtagcttttgga

SEQ ID NO: 678336 - DNA, 794 bp, Homo sapiens
agcgggagagtcccggtggtgagcggggatggtggttgtagcggcggctgccggctggctactcggctctgggcggctggggctgatggggctctggccgtcggcttcctggcgcggtggctgtgcgcggtggctttattgcagcacctgccgaagtactgtccgaggatgctgcgcctagcaggcggccaggtgtggctccatttttacttgtccatgcgcagatccggtgagcaccgcaggatagataccgaggcgagatactcgatggacaagagtcgacattctattttccgacggtcttgttacaccaattgtcgcgcttgagcatgaagctctatttggcgcataagcatgcgctacgtggagctagagtagtttggctgcaacgatgttgctcttttgagtggacgtctgttaggatgcacttgttggcttgccgatgacaaatatggcaaacagatagagttattaataaccccatttgctgtgaagcataggacattgtctggcatttggaactcggaatagcagccactggagctactggcattgcggaaattcagtcttgcagattactattttgccctgcatttgatcagcttgttaatgaagctgccaaggtatcgctatcgcgtctggggatctttttaactgtggaagcctctactatccggtccccttgaggctgtgtgggtcatgaggctctctatcattctcagagtcctgaagcatttttagcccattgccccaggaatcaacgtggttatacccagaagcccttttcaagccaa

SEQ ID NO: 678337 - DNA, 297 bp, Homo sapiens
tgcctgaagtccacgtaggcaggaggcagacagaaggagaatcacttgagatgggaggcagaggtcgccgggagccgagatggggccactagcactccagcctgagtgacttggacacagcaaacaagaaaaagacgcattgacatgaatagaacaaagaactccagtatatctcttaaccagattcaccgatagttaacatacagccccatttgctttatcatttatgtgtgtgtccatatatcaacaatttaattgagatataattcgtatacctacctatttcacaatcgggga

SEQ ID NO: 678338 - DNA, 187 bp, Homo sapiens
ctgacgtctggcccgtcagaacatgtgaactcacactcctgggcttccagaaatctaagtagaatggtaggctccctgagattaagacttcctgtcaacggttgcagtgacctggaggcatagctgtcaccatcttgcagagcagagagctcgaacaagaagccgtctcgatgaccctagcttgcat

SEQ ID NO: 678339 - DNA, 157 bp, Homo sapiens
tgatggacatcccaataacactgatttgatctttacaaattatatgaatgtattaaattatcacatatatgcccaaaatatgtacatctattatgtatcaataaaaaataaaattaaataaaaaggctgaggcaggtcctacaggcactaaaagtta

SEQ ID NO: 678340 - DNA, 1070 bp, Homo sapiens
  misc_feature (133)..(133): n is a, c, g, or t
tataattggaaatagggtcttaactcttgtccaggcttggaggacgtgcagttcgtacagtcagtggctcactgaagtcttgaccccgttgcctcagcctcccaaatagcgtggggccatagggtgtgcaccnacaagctctcagctaattttcaaaatttttatatagagggtggggttaacatatgcttgtccaaacgggtcttaaactccggggctcaagtgatccccctgccttggcctcccaaactggtgaagattacagggcatagagccaccaacaacttggcctgaaatctcttacaaggatgggagtgtcagatgacaggcaccttggcatcgttgtgcctaacctgggagacggaagaaagcacgccagtgggaagtgtctcacccttggggcacaacgtgctaagtatttgtggagcccatagccccttgagatagatggctacttgtgcctttcttctgtgagctgtcttgcgactgtggacttgggggcgtaaggtggtcttgaagggactccatttagtcaccctcaaaattaagacttttcacttcatcttactggggcctgcacctccgaagataccaaaggaagaacgcatggctcgtgccaaagaggtccacaaccagttgtgccttgttcaactggcagccattgtgtctgttatgacctgtggcgttgtcgttgtgccccaatgacccagggtctactaagagaatccattcattttgaacgtgttcaagggctgtcacagtccaggcaatggtttctgaaatggtaagccacctcatcttgaaccgcctctattatacttctctcagggcgtggatgttgcaagctccacttttccccagtgtgacatttgttgcctcttccgacgcccaatgtggctgcgtgaaaattggaccgtcctgaataacacgaggtccaggacaccgaaaactcccacgccccaaaatgagaaccgttcgctgtgtcgtggaccacaatgaactactccaccaaaagccctgattagagagcgcgcagcgttcatcggaactggataaacacacgtctgtct

SEQ ID NO: 678341 - DNA, 582 bp, Homo sapiens
gttactcatacctctgctcacatgaaaacaattctgtaagctgaaagacagtgtgtgccagtgtgttttagaatgttaaggttcagttagcaaatctttattgacttactatgcatgcaccaattgttggtgctataaggttaaaatagactgatagggttcctggaagggcctccctagtagccctttgaaaataagtaactgcacctctacttcccatgtgagtcctaagttgaattcagtgttgccctaaacagtggcttgttagggtgggttttactgggtggatttgtagctataaagtactgtgtcttgaatgactgtatacaattcagaactaaaaggatgtaagtggcatctagaattttttttttaaatttcagagtagtattagaaaggcacattaacaattactcataattcttatgtatcagaaattaatcacagtgttttgcatatagtaagtgcacaataaatgtttgtaaattgtgactttttattcttatagggaagtttgtctggtttttaatgtttttttttgtgatgataaaagtttttaagactttgaaaactggatttaaa

SEQ ID NO: 678342 - DNA, 297 bp, Homo sapiens
tgcatgcgtgtcctaagcagagtgctgagccagtcacgtttcagcaccactgggagtctgagtgctgattcagaagatgacgcgggaacattcgcgtcctaaataaaccgtgtcctaggccatagcagcgatgcctgcacttatctggcttctgtacacaaatgcgtactatgagacgaaacttttaaaaaacagtgtttgtcctctatactgcactcaaaccttaagcacaccaccaagaggtacacaatacaaccactctggcgaaacactgcgtgtcctgtgaatgagggctac

SEQ ID NO: 678343 - DNA, 657 bp, Homo sapiens
  misc_feature (273)..(273): n is a, c, g, or t
  misc_feature (288)..(288): n is a, c, g, or t
  misc_feature (291)..(292): n is a, c, g, or t
gtggccgggtcacggtggcatggccctgtattccaaactggggtaaagggggtgaaaaggagggggcaggtcctagggtggaggtttctcattaccaagtaaggtgagggctcaagtaatttgcaccatcacattttggcccgggcaacagtggacccctgaatcagaaaattagaacaggtcctgcctgttgacaggtcacaccccggggctaattgtttttgtttggaaaaatggggttttcccatgttgccctggctggtcatgaactcntgagctccggtgatntgnncacctcccctcccaaagtgctgggattacaggcctaagccgtggtgcctgccccaaattaaatgtttaaaatacaaaatacttaaccttttatggcttgctaaggctcaggtttttccagactgaattttgtcacccccatcttttaattttgtggagatcattggtttgaaaaccaggaagatgccagagactttaggaatacagatttttgtgaattgtgggtgtgtgtctgtggtcttagctacttgggaggctgaggtgggaggatctgttgagcccaggagttcgaggctatagagtgcaattactgcacctgtgaatagccagtgcactctagcttgggcaacagtgtgagactctgct

SEQ ID NO: 678344 - DNA, 1609 bp, Homo sapiens
tatctgtctgcgtgagtccatacgatagtatattgtcttcttgatggttgtagtgtctctacctctctgttgtatatagaacagtatggatgggctgggtgtgagtgttcttcccccctgttgtgtgctctgtctctttataatagtcagcgccatttgttgttatgtctccctactttccccctgttgttattctttctgtgtctcgcgtgggtgttttgttcggtgagctcagcaattctggggtctctttctccctttctgggacaccaaagcgaagggggggtacaactacgtgggcgtggggggcccctggcttttgtgttcccccccgccccggggtgccgcccacccgtcgccaagaagttggttgttgtttctccggctaactatttggctcgccagtagggagtagggttgcgcccatatttgtgattctcacatggaaaaggcccccccgggggttaaaattttttggggcgtggagaagtttgtggagagacttgaggttgtgcgctggcttgtgggtgttcacacagccccaataaagtgggtcacgccttgataatatgctcaatagacgccccgagaggtttcctttggttgaacacaacctttggggagagtatcccacggtccaaccgtgcctttgggggagttgtaaccccccttgtttcgctcagatggtcccggtggtagaggggccccctgggcggtttctcccccgtaaagcccccccccttgtggctctttgtgttgggagggccccctcgcccaaagtgtgggcgcaccaatagtaaatgataatgttgtacacttttctcgctcaaacaccccccaaagaggggggccacacacaaataagaagatttctctggcgttctaacagcccgcacccaaggggctccccccctaaggcgtctctgtggggaaaaattatcatgccatagggccttgggccccactgttggcgctgacacagacgcttttatgggccacacctctgtacccccctcacaccgcactccctatggcgcgtagcacaccctgtttttggagacgcttatatatatgagttgaaatatgtccgtctgagatctccacgagatatgttgtgtggttgtgcgccccccttgatgattatcctgtgttgtggtgtggtcgccacacgtcttcttgtgttaaccctgcacatttggtgggagcaccaccaagtagttccctgttcccaaggcgccctctcggcacagtggagttcacctcgtgtccttatcaccccctaatatctctcagcacctcggggagcacaccaccccctataattcacctcttgagagcctcgggagaaaataagcctccctcacactaccacttcctttctttataacacctccttcacgcagaaaatctgccactttctattttctcacagtatataaaactaggaatcctcccacccacgggctccctcgtgaataaaatttcttttaagccccacgattttttatttgagggttttttgtttttttaaaaaaaacttggaccaagactactaatgactttgtttgaattatccaccatgaaaattaagagccctagtttccaaaga

SEQ ID NO: 678345 - DNA, 322 bp, Homo sapiens
gctttttaaaattattattattatttgagacaggatttagctttgtcccccccggctggaatgcagtggcacgatcatggcttactgcagccttaacctcctgggctcaatctatcctcccatctcaccctgccaagtagctgggaccacaggtgctcatcaccacatccagttaaattttgtattttttgtagagatggggtttcaccgcattggccaggctggtcttgaattccaggcttcaaatgatccatctgcttctatctcccaaagtgctgggattacaggcgtgccccctagttctagatcgcgagcggccgct

SEQ ID NO: 678346 - DNA, 204 bp, Homo sapiens
  misc_feature (77)..(77): n is a, c, g, or t
  misc_feature (119)..(119): n is a, c, g, or t
cttcaggttatctgaattcattggagtatgaatgctgttctgaatttgtatcttaagggaaatactacaaaatgtcncaaaagggggggggggggtatctaaagttcaaaaaggaaaanaaccacacgagctggagattcaggaagcatcagtagaagtcaatggccattaataaaaacattttttattaaaatattgaatctg

SEQ ID NO: 678347 - DNA, 1732 bp, Homo sapiens
  misc_feature (1467)..(1467): n is a, c, g, or t
tttttttttcacaaatgtattcaagggcttaattgggggccgccttggttgcccctcaaagggttgcaaaaacccgtctggtcttgctgttgccttggctcttgggtgggcttgaaatgagaaatggacaagagggatgagaccaactttattctggagaaataaagaatggccacattcttgggtggtctaaaaccatggtggtggcgagaagacaagattatagggagaggggagagggccttaatataaagagggctgtggaaaagtggagaaagtgggggcttgcctctcctgtggagagtgtggtggtgttggttccacgagagagtgtgtttgtggtattgtgagtgggaagggaaaagagggaaagaggggaagcgtcacaccaccacagaacagttctgaggaaaaaaagtgtggtatttgggcggtggggctcttctgtgtggtcacactgtgacaccatttgtgtgccactgtgctcccgagtggtcccaagagaaggtgccaaaggtactatagggtctagtgggcccaaaaagagggggtgtggctcacctgtgggaagggaaaaactatgtggcagacaagtggtttcagacaaacaaaagggctgtgacaactccggtgagaaggagggagggtgcgttgggcccccaacagacccaaagttttcccggcagggggggggggcccccaagagcgaggccgcccacaaaagtgtggcccccaagaccaccacacagatggtcgcagcagcggcggctaataatcatctttttcggttggcgacactaatttctctccccacaacgctcttgtggttgttcccccgagtaaagtgcacacccgccgtggtgggcggaaataataacgacgagcgtggggcaacagcactgtgttgccgacaaggggcggacaagatgtgcgccccacagaggggctcccacaaggggggtcacagagcccccccctttgggaatgatctcacagcgggggacatcaccaggggggaggagagcgccaccaacaagaaggtgggtgccgccggggtataaatattcccaccacggttgttgttttttttccccagtgttcacaagggacagcgggatatcacacaccaaccccaattttttggaaaacggggcacaaaaggacgcgtttgtactttggtgtgccccccagatgtaaaaaacagtgaaactttcccaagtgatggcccccacagcgaggggtgttcaacacacgacgaggggggtgcccccccaccaacatgacagaacaagttacgaacgggcgagggcatggtgggtaaggactcacacaacaagacggagtcctccagaacgaccccaacacacgggtgcggaccgtcgccgtgtggcgcaacacagtgtgggcgagacagacgaccacatctgagcgtgggtcggtcggcaaccctgattcattgctaccacncccgacgaaatcttctgtctgtgtccagacaacttccacgagaaaagcggcgtcacctggagagaaggagtggttcccccccagtcgtgtccggttatagctggacgggaagagagacagcgggagggaagaaaaaagagtctcaccaatcatcaatcaagacactgtttgtgttgtgtcccccccagccaaaaattagagcgggaggtcgtcatcaacacactcacaccgagaggtgaaggtgagagggcagcgtgaacgcaaa

SEQ ID NO: 678348 - DNA, 275 bp, Homo sapiens
  misc_feature (67)..(67): n is a, c, g, or t
cttccgagtgaggccctggataccatcccagtgtccttatagaacagagcacaaaaggcattagcanacactataaaacaaagccatgtcgaagaggagcaaagagaatatggccacaagccaaggaatgctgacagctgccataagctgaaagaagcaaggaatggactctcccctacagcctccagaggcaatgcaaccctgccaacactttgattttagacttctggtcctatgagaactcgagaaagaataaatttctgttcttttcagct

SEQ ID NO: 678349 - DNA, 149 bp, Homo sapiens
tgtgctgtgagaagtttgctgaggaagacaaaaagctcacgagcgcattgatactagaaatgagttgggaagctatgcctattctctaaagaatcagattggagataagaaaagctgggaggtaaactttcctctgaagataagcagca

SEQ ID NO: 678350 - DNA, 692 bp, Homo sapiens
  misc_feature (656)..(656): n is a, c, g, or t
  misc_feature (662)..(662): n is a, c, g, or t
aaattaatgaaagtagctacactggtcaggcatggttgctcacgcctgtaagttcagcactttgggaggctgaggcgggtggatcacctgaggtcaggagttcgagaacagcctggctaacatggtgaaacccaatctctactaaaaatacaaaattagctgggtgtggtggcgcaggcctgtaatcccagctattcaggaggctgaggcaggagaatggcttaccaaggagacagaagttgcagtgaacggggattgtgccattgcactccagcctgtgcaacaagagtgaaactccatctcaaaaaaataaaaataagaaaaaagaaagcagccaaaccaaacaacagattttcaataaagacaacatagacttctattgtaagaagatataatctaggactttcatagctatagagaagtcagtcaatgcctggcttcaaagcttaaaaggacaggctgattctcttgtagggactaatgcagacaatgattttaagagaaagccaatgttctttaccatttcaaaaaatctagggcccttaaagattaatataaagtctattcagcctctctatgaataggaaaaagcctagatgaccgcacatcttgttgaaggattggttacggaatattttaagcccatttgtggactnactgcntgatcctctttataactactctgacgggcg

SEQ ID NO: 678351 - DNA, 592 bp, Homo sapiens
gcaggaggatcacctatgcctgggaggttgaagccccagtgagccatgatcacgccactgtagtccagcctgggtgacacagcaagactctgtctcaaaaaaaaaaaaaaaaaaaattcctcatgcaaaaagggaaggaccaagtcccattcccttttgcctcatttcaaagcctggggtagggcctacttggtggcataggaaggggtctgcaaggtgggtgggactttggcaggtgtttgggaacgaggaattaggggtggcaagttttcacttggtgaaaagacaggctgaggggttgtggtggaaaggctgggggacgaaacggtgagaagtgatggggggggctccctgattgagtcctcatggagggtgctgaggcaggacacaggtgtgcagggacagatgatcagggccctggtaccttgaccactttgatgatggcattctctttttaagattgcccaagttttgccgcatttatatttccttttatttcggggccttagcaaccctttacccaacccaaaaggagggtcagatggccaatgcgttgtgggcaatgtcgctcaccaaacaaccacaataaagg

SEQ ID NO: 678352 - DNA, 336 bp, Homo sapiens
ggttacgctgtacccaagcatcactataaccattaaatcgaattttcggcactttattactcatgtttgcctccaaataattgcttagctgatgcgataatctcctggctatcttctgtgactgctaaatcactaatcatcgctaataagtcagcttcactttgcgcaatgtcatgattaacatcaacgagatcctggctaacagcaaccaaatcaactggatcttcttcttcgaaggtgtccacataacgtgggatgttgaggttaaagtcgttttccttaatctcttcaaagctcgcaacgtgcgcatacttgtccacgtctttccgtttaaga

SEQ ID NO: 678353 - DNA, 148 bp, Homo sapiens
cttcttatcatatgggaaagttcataaatgacctaattttaacttaattacagtctttaaagaccatatctccaaacacagacacattctgaggtactgtgtgattatgatcttcaatatgaacattttgtgggataaagctcagata

SEQ ID NO: 678354 - DNA, 436 bp, Homo sapiens
gcgtgggcccatacccggccgtctgccggcagtcgagagtggacgggaacggcggggacggcgcgcgcgcgcgacgcgtagtgctgtgcgtcggaggagcggaggaggcgagcgaccggcatgacgaaacaacccgtgaggcctattcacgactgacttcagctactagatgacggagaggcgtacgacagacaagcgcgaaagaacgaactacacacgctagaggcccttattttatgagaccatatcccagagcataccatgctaccgacgacgtgcgcgtcacccaattagaggacagtaccacgtgtactaaggcctacgagccaccgaggacgccaagaagctcaacaacagatccgtccactagggaaacaaactgcgccaaccccatccacacaccaatgagaggcacgccacaacccataaacctgcc

SEQ ID NO: 678355 - DNA, 233 bp, Homo sapiens
atcttgactatagaagatctacaaaacagtctgcccaggcaaggcataggataatgagtggtaaagtcaaggtctgagggaatgttggaactgttgaatgggcggatcctatagaagatcctgatcctgaggttatggcagaggtaaaagtgctgtttgtacgcaaccttgccaatagtgtaacagaagagatttcagaaaaggcatttagtcagtttgggaaactggaacga

SEQ ID NO: 678356 - DNA, 729 bp, Homo sapiens
cgtgctggctcacgcctgtaatcccagcactttaggaggcctaggtgggtagatcacctgaggtcaggggttcgagatcagcctggtcaacatgatgaaaccccatctctactaaaaatacagaagttagccaggcgtggtggcacatgcctgtaatcccagctacttgggaggctgaggtacgagaattgcttgaactcaggaggtggaggttgcagtgagctgagatggcaccactgcactccagcccgggcgatacagcgagactctgtctcagaaaaacagaacaaaacaaaacaaaataaacaacaacaacaaaaaacaaagaatgagggatgtggctgggaatggtggctcacacctgtaatcccagcaccttgagaggatgaagtgggtggatcacctgagatcaagaatttgagaccagcctgggcaacatagcaagaccctgtctctacaaacgaaattcaaagaattagtcaggcttggtggtgcacacctgtagttccagctactggggaaactgagatgggagcatcacctgatcctgacaaggtcacaggttgcagtcgagccatgactgcaccactaatcaactccagaagcctgggggtgaacagaagttggaggaaccccttggtcgtcagcacaacacccacgacacaaaacacagaaaaaaccagcacagagcaacgcaagcgcagagccccggaagaacgagacacgaac

SEQ ID NO: 678357 - DNA, 989 bp, Homo sapiens
tccctgtcgccgcggagggggcgggggcaggacgcgcaactccggcggagctgtccgggtcgtgagccgggccccggcttggttggtggcgccccctcgcggtcccagtagtgcagaacgcatcggagtggactcgaggtcctccaagcccaggctcgggaaggaaggaccgaggtctgcgcaaagcgggagacctcggggagccctccaggacgggggccggggcactagccgccaaggggcgtcgctgaccgcgtatgtgacgcagccctttcttggcagcggcagtgacacgggggtcccccgagatggcggtcaggtctcgaacaatgggcaatcgcctgattcaaagcagaaaaccacccgggagaggcacgaaagcacggggaggcccaaaagcttggtaggtgacctcttgagttagggaatgcccccgcgtgaatggcaattccagtggccccccagcggcccgagggaagttgatgtgagaccctcgactctttatgggcatcccaccccagtgtgtggccataagcctcacggcccgagaggagtcgccattaggcagctagtgagtattccagccttgcccgaagaacgggtattttagagaaaccgtaggaacgagtatacttctgagcgggaatcacgcgggtagcccgaggttgtaacctttagatcgttgcacgtccccagggtgaccaccatcattgggtgcagtccgtgtgacgtgtccggtctgcgagtggagttcctacctaatcacgcattcccctgtatattttcccgttgaagtgagagattgttgtccaccccaggcttgaagacgggatgcctccagtgacgtctcgcccgcagagatggtgttggacggggctccgaaggtatctatgtgcccaagcaattagcacacttgggactgccacacttggcggaagaggaaggcttgcaggagaggttacaccgtgggtaccagcggcacgctaggc

SEQ ID NO: 678358 - DNA, 774 bp, Homo sapiens
  misc_feature (545)..(545): n is a, c, g, or t
ataagagactattatgcaacatctctatgccaacaaattggataacctaaaaatgtataaattcctagacacatagaatctaacatgaatcatgaagaaatagaaaatggaactaaccaatagcaagtaaagagattaaaacagtaataaagtcccccatcaaaggaaagcccagcacctgatgacttcactgtactcaaactcttaaaaaaaaaatggaagaggaggagggaatactttcaaactcattttatgagaccagcattactctgataccaaagccagagaaggacactataagaaaaaaaaaaaaaaggattttgggccatggtccttggggcactatccttggccaaattattaacaaccggaatttaatctacactttaaaggggtcctttcaccacggtcacggcaatttacccctgggatggcaggtggtgcccattttcagtcacaaggtgggtaccccaatttacagatgggggggcacaacactctttaaaaacttcgcggaaaaggttggcggatcagaccccacaaanacggtcgccaggtaggttccccccacaagggtcttatgaagagcccgtacactcattgaggggcaaagatactgcgccacaattacacggggcggggcaaaacacacttacgacgacaacacgagggcaatgacgaggcaggttgatttgtaattctctctgtcctccttgtctgcttatatttcactataccctctccccgccagcaaaacaaacagaaagaatagaa

SEQ ID NO: 678359 - DNA, 431 bp, Homo sapiens
  misc_feature (17)..(17): n is a, c, g, or t
  misc_feature (93)..(93): n is a, c, g, or t
  misc_feature (198)..(198): n is a, c, g, or t
cccccctaaaaccccgntgtagggacagcccccccataacaaagaattaccccgcctcaaaacatccccacagtgccggggcctgagaaaccncggatttaaggaagtcacccttgagtcaagcagccctgtttgtaaatattgtcctaattgccctgagaagatccttattcattagatttacagttttccccttgnctaggggtttgaagtacttacgaaaatcagatatgttaaatttatgatgatggtttgaaaaacaacgtctgaagaaattttatcaaataactggtccaaaatacgtatttaaatttaatctgcaaaatgtatacactgagtattaaagaaacaggaaatgtgtgtttttagtcttcacatcaaaattgctctattaatgaacaaataaaagattaagttacaaaaaaaaaaaa

SEQ ID NO: 678360 - DNA, 766 bp, Homo sapiens
  misc_feature (1)..(1): n is a, c, g, or t
nctaggtggatcattgtggctttgctttgaatcatcctaatcagttcttttgtgagagccaaagtattctaaatggtggtaaagacataaagaaggaacctatccaaccggaaactcctcaacccaaaccaagtgtccagaaaaccaaggatgcatcatctgctctggcctctttaaattcctctctggaaatggatatggaaggactagaagattactttagtgaagattcttaggcagttttctaacccattttcctcaatagcctgtttcctgtttttaagattttgcctttgttgttgataaagggtttcactctgtcaccaaggcttagtgcagtgacacaattacagctgattgcagccttgaccttcccagctcaggtgatcctgctacctcagcctcccaagtagttgggaccacaggtgtgtaccccatatccaactaatttttttcaattttttttttgtagaggtgagggtctccctatgttgcccaggcagatctcagactcctggactcaagcgatcctcacacctcagcctcccagagtgctgggactacagttgtgagccactgtgcctggactttctttttttacctttttgtttaacttctctcttcattgcatcccaatccatctaccggcatgcacacttattaggaaagcaggcttgagggtacaacagagactttcactatattttactttgacagaaggaaagacgaagagtttctattaaaatctgtcatttgagtgaagctc

SEQ ID NO: 678361 - DNA, 515 bp, Homo sapiens
cacgaggtgttcgcctttggctcggtggccgtcaccgcagcaaacgtagtcacggcggtggtcacaacgacggttcctatggcagtcacggaggcggccatggcggtagacatggctcccgccactgagcggcgatgaaggctcttggcgctgctgcggacagtacgtggcgtcacaaagtggccacctcttccggcaaactctctgccgtcaactcaacatctaggagcaaacaatgaaactcaatgtgcttgctgccgttgccatgacgatcctcgcgaccccggcgctggccggtgccggtcactgcgatgccgatctcaaggagatcgatggcgcgatggcgaaagcgaagctgagcgatgccgacatggcaacggtcaaagcggcgcgcgccaagggcgaggaactgcacaaggccggcaaggaagaggagtgcgaaaagtctatcgccgacgcgcagaagctgctcgggattcaggagcagcacaaggaataatcatcatcctggagct

SEQ ID NO: 678362 - DNA, 415 bp, Homo sapiens
gttatctagagatccccccaggctctctaccgcgagggtggcagtgcctatccgacagcaggaactcagatgttggcggagtgacggaggtgccacttaggccggcccccgaaaaatgctggtatggttccttcagctgcctaggcagagggcacctgtacgggctagggtccagtcagaacacagaagccacacagtgatgtgaatatagttccatgaagaattatcaccaggagactgaggaaccgggaactgactcagggcggggacagagccctattggataagaagattgaggtacggcactcagggacggaacaagctagaacagaggtccccagggttggggctgagacacgggctagggagggtgtggctgaagcccattggacaggggagaggctcccgctgaaca

SEQ ID NO: 678363 - DNA, 1538 bp, Homo sapiens
  misc_feature (301)..(301): n is a, c, g, or t
  misc_feature (683)..(683): n is a, c, g, or t
gctgacagaagattagctccgatttggacgggcgacccggtccctaaacaacgctttcagccgatgtggccagtgcctccctgagtcacggcctcgatggccgcttgtgaggattggcctacaccggtgaatacttcgatgagggcagctactcgacgtctatcgctttgctgggagaccggcggagcgtgtcagaagggctcctgttactgggcgatggccactggactcttccgccaacagtctactaaaggctggactacgcttgtggaccatatcatacgatcatcagatctgtgcntgggccacgagatgatccagtgtcctccgagcttgccatgcgaaccgttcattgcgtccaactccttaccccacgcacaagctgtgttgccgcacgtgcacttttccgtgtctcgggccatttgccgcatacgatccgtttgtggagttgggaaccaacccaagacggctaggacagagatggcatggttggcaaagggacccctatatagcgaccaaaggcctccagaagtctaacctaggctctaaacctacgactcaattcagtatccgcgccagcagaatccctatacaaggcgagtccctgacgtgagcattcagcagggcgtggttacgaatgagtcccatccgatgtgcgtcagaggcctcgagagataagcccntgagcaccccaatgacagaagcgtttggagccactagtcagtccacgcccatttccaatcctgagaacttcgcgatagatacccacttgaggcagatttacctcacccgaattctcgtgggctattccatctcgtgcttcaaacgaaattgattgccacagctccgccctgcgaaatgcgtgaacagtctcgtgccattatggttacgcaagtattcgatttctcctagcaaatttggttcctatagccctaagcggaacaagaagtcgcgccaataccgaaacttagtgactcccattgcgcgaacccatgaattctccaggtgggggattggaacaaaggttgcgtgcaaaccccccggaacgcacaagggcatggctggaaaagccgaaccttgtgtgtaaagcccggcgtgaggaaaatagagcgcgaaacaccttgacggagatttccgacttcttttaacataccccgaaccactttccctttctccccaagccgaggatttcggaccgccgagcattaccaaccgtacccctttcaggactggggcgttgggttcaaccattaattgctctagagagacactttaggaacagtggggacgcagaaagggcactctttgggaggaaagaagggaccaagggtgggccctgcgcggggaacaagggagagcgcatctggtgtgtaagaccccctgtgccttcagagcaggaacagtcgtgtaggccacacgacaagtcctttgaaaaaagcatgtgtacccatgtagcgttccaacgaccctttggggaaaagaaagcctaaaatctttccgcagaaaggacacattcttccacggtggcgtgagacccc

SEQ ID NO: 678364 - DNA, 698 bp, Homo sapiens
gagggatcggaagccggcttggggtgtggagaggtgtactcgctctagggagattcttcaagcaatcactatgtcaacagacacaggtgtgacccttccttcatatgagtgaagatcagggatcataacatcgtcatttgcgagagaagactgaaagaggcaccattcgtacccgtgtggcaatagccgggtttacgcaagacaattgtctgcattatggagttatagtaatactgaaagagcatggggtaaatactaaaatggttccattcatctgatccacatgcgtgtgtgaagcccataggattttgtgtagtacggagtcaatgacatgttggatatggagtctattactcattgtatcggtggaattctgggtcaaaatctaagaccttagaagcaagagtatgctgtccttggtcttggttggagtgagcttgtcattataggttaagatgtctttattattaagatgttacctattattgttggaaataaatctaattagtaatgggttctagatggtaagatggcatttctgaagattgggctgccttttcttggaggcttggattggttggtgaccgaattactagtgactagtttgaactaataggtcattcaaggaagtcaagttaattaacatgtcacctagatgcgcttgatggtgttgaaatgtccaccttcttagattaaga

SEQ ID NO: 678365 - DNA, 337 bp, Homo sapiens
ctccataatgtgtgcccatgactaatacattttattgtaaatggcaacctaaataacaaaaagagagagactctctaaaagcaaatgatacttatttcagaatggggcagtgggaatacatatgccatagtaaactatgtacatatttgtaaaggaagacaacagcctttgtttgtgtgtttttttttttttttgggggaatttttaaggagggggggaaaagttttggggggggattctaaagcctcttttggggggggagtaaaaattctttaagccccctttgctggggaaaaggggggcccacattttaggggggggcgcggacacataatgg

SEQ ID NO: 678366 - DNA, 713 bp, Homo sapiens
atctataaatctttgtcaacattttttctccttagaaacagagacctaggccaggcgtggcggctcacgcctgtaatcccagcactttgggaggacaaggtgggaggatcacttgaggtcgggagtttgagaccagcctggccaacacggcgaaacccagtctcagctgggcgtggtggtgtgtgtacctgtagtcccatctacttgggaggctggggcaggagaatcgcttgaacccgggaggcagaggttccagtgagccaaggtctccccactgcaatccagcctgtgcgacagagtgaaactccatttaaaaagaacaaaaacaaaaaacaaaacaaaaaggaaacagagacctagaagtggtattacagcaaaggttttgaacattttaaggcttttgagcgccagattcagacactcagtagttttacatgagagtgctacaacatcctcactaagtagtatttgggttcatcataattttaaattattttggtgtgtcaatttgaacactagagtgatataaaaactaaaaacttgaattcaataattttacaattgtattccatcttaaaatattttatggtaaacttggataaagtatataaataatccaagggtgtaaagtagaaagtgaaagctcccttctcccagttccagccccctgatgttgccaatattaaacgttgtatatccttgcaaaaaaaaaa

SEQ ID NO: 678367 - DNA, 290 bp, Homo sapiens
atcccccgataggagagcccagaggtacaggtgccaggagccaggcaaaagggtggaaaaacaaaacgaacgataataaaaagaaaaagaaaggtcactccttcctctgcgcccgaggctggcccgtgcccctttgcgtggtgagcaccaggaaagtcgagtgtgcggtcgtggtcatctggccgttaccagtcccttttggaaggggcggtgtcgtttggtccgggtctcctcttagccctgtctgttctaattctctctgtactcctcttaatgctgctaagaccatg

SEQ ID NO: 678368 - DNA, 1510 bp, Homo sapiens
  misc_feature (136)..(136): n is a, c, g, or t
  misc_feature (760)..(760): n is a, c, g, or t
aacttggggtgggtagttctatctactctactagcttttctactatattgtttagtacccgcgcgatatgtggtctcggggggaggaggctcggtgtggtgcatccccccaccacaaccaccgctgttttccctcntgggcctaaatatagattgaattttttgttgtaaatatataatatgggtgggtgaactcccacacaaggagacagtagtggttgtatctccctatcgccctgccctcctcttgttattgtatgggaacgaccacaatatcctttttttgggtgggtgtaataacagcatcctccatctcttcttcctgcgtgctctatgatagaacgaggaagcgttttttatataaaaagggggctatggactactcccctcttggtgggtagaataataaattagtccgtgttattttttctttcgcgtgtgtggaccaaccaccccgctgtgggggggtgttcccatcaacgagtgcgcccgacaaatttattcctccacgggatcaacatcataacgcccccccccccctgtgtgtgttgtaattagtgttgttcgtccttgtcggatattgtaccgctggcggcccgtgtgttgctttttataagtagatctctctctccccccacttcgttataaaggaggcgccaccacaacgaggggtgttacacctcccgcggagactaatataagaaggagggttctcctcctccgctgatatctctgcgctgacgtattactcaccgtggggngtttcttcttctcctccgtcgccactcttgttataatgattggtgggagaacacaacgtagtgttgtgtagagagaattattatgaggggtttttggagatatttctacacaagagagatgataaatgtttttctcgggccacaaatggtgccccctcttgggtaagctactatatatatatatatcctccctcgccacagagagcaccattatagagggcgcgcgacgctttacactcactgagatatagaccgcctgtctgtgagacacactctgtgtgtgtgtgttgtgagagagagagtgactctgtgagatacgcccctcggacacacgtcgcgcgctctgagggggcgtctcacagagaatattgtggtgctctcacacacacactaggtgttctcacgcgcgtatacacacgggtgttatagagagaacaccacgcgctgtgtgcgagatatataccacgctcttccccgtgggccacatctccctcggtgaggggggtgacacgcttatgcacttataccgcccacacacctccactctgttatgtttgccctaaagccttgcctgcgcctcttcctcgttataagttttttcctcgtaaagcccaaagagaatggaccactttccaaggagagttggagaagtgaaagtttatatagagatgggaaacacctttgcctccctgtgtactgggttataaaccgaaaggaattaactgtaatttgtactttagaaacacgtta

SEQ ID NO: 678369 - DNA, 106 bp, Homo sapiens
ggtgactctgaggatcccctgagtgtcactgtgttttgtttttacttttttctttttgagacacagtctcgctctgtgcgcaggctggagtgcagtggcgcgatct

SEQ ID NO: 678370 - DNA, 124 bp, Homo sapiens
tctgggtagctgcactgcagtacactccagtacatcctggctaattcttgtgtcttaatacagacaagatttcaccatgttacccatgctgatcttgaactcctgggcttaagcgatcctcccg

SEQ ID NO: 678371 - DNA, 317 bp, Homo sapiens
  misc_feature (303)..(303): n is a, c, g, or t
gtctggtttgcctagtttagtattgtcattataaaattgtttctggctgggcacggtggctcatgccctataatccccaacactttgggaggccaagacaggcagatcacttgaggtcaggagttcgagaccagccctggccaacacagtctctactaaaaatagaaaaacagttgagcatggtggtgcaagcttataatcccagctacttgggaggctgaggcatgagaattgcttgaaccctggaggcagaggttgcagtgagccgagatcgtgccactgtactctagcctgggcaacagnagttggtccgtctc

SEQ ID NO: 678372 - DNA, 352 bp, Homo sapiens
  misc_feature (253)..(253): n is a, c, g, or t
  misc_feature (279)..(279): n is a, c, g, or t
ctgtttatggctcctgatgaacaacttctggcggtggaacgtcaaccaactttctgcttaacaacgcattgagtaaaatcgcgccaaaggttgctgtaccaatccctcccaacgtaaaaccgcccagcgtgagagcaaaatcacccgcgcccagcactaaggttactgcgaccataatcaaattaccgttctggcttaaatcgacacggttttgtacccatatccttgcgcctgcgacggcaatcagcccgancacaacaattgatgcaccaccaattnaccgcggccggaatggtatgaatcaagcgcaccaaattttcggtgaaaagcccaacaggcatgggcgagtgac

SEQ ID NO: 678373 - DNA, 136 bp, Homo sapiens
aggggtacaggtctgggcaaggcacttacattcatctctgaacaactcctaggagtgtgcactgaaattccatatcagatgacgagactgaggcccacggtattcacataactactccagcgcagaactgggtcag

SEQ ID NO: 678374 - DNA, 765 bp, Homo sapiens
tataaccgttttatgatttacttattaaaaaaatcttttactattattataagtattttttaaccaaaatcttgatcttaggaagacttaagacattgtgcattattttaaatattttcattccagtaactattaaaaataaattcacaatttagggtttcaaatgtcctaatcatatctagtttggtctcatttaatattttatcactcccatcatgtgcatacagaggttaaggtgatgtataaattttatatctctcaaacaccttgatgctaatcagctcttgatctaattgctaatctcatttattcagagatagcatgtagacattaaaaaccaatgccttacttttgaaaataaccctttggctaatttacccccatactatacagcgtgttatataaaggttcagccaacaccaattgggtcactactattatgccagtcttaaattatttttactcgtcaacaaggcttgaaaatttcccgggggttaaatcttcttgatggaagtaacgtaatcacacccctctatgcccttttaacttaaaaaactatcccttaaggccaagaatccctatacacgacactcgacagggacaaattgcgaggaaaagggccctctcctccattattaatatatggaagccgactgcttcttaatctaattccctatgatagtactatgttgaaacacaccccggtgtatctcttcccgctttcattataactctctatttcccgggggttttttatgtattttg

SEQ ID NO: 678375 - DNA, 692 bp, Homo sapiens
  misc_feature (1)..(1): n is a, c, g, or t
  misc_feature (6)..(6): n is a, c, g, or t
  misc_feature (26)..(26): n is a, c, g, or t
  misc_feature (135)..(135): n is a, c, g, or t
  misc_feature (193)..(193): n is a, c, g, or t
  misc_feature (264)..(264): n is a, c, g, or t
  misc_feature (327)..(327): n is a, c, g, or t
  misc_feature (384)..(384): n is a, c, g, or t
nggggnggtgtctttttttttttccntcacccttattctttgtctctggtctaggtggtggggtgtggcttaccccccttcctttttattttttgggtgttggtggtttttgtcattccaaccagagggggtggnaacaactaccgttgtggtgttttttcttctctccctctgtgcgggtttgggaaagggnaagggagtttttatttatccctcccccccccttgccaccttttttttttttttgggggcgggggagacccntggttacactttcccctctttcgcgattatgtggaaaaaaccggtaaccgttccggcgttgtngaggtttttttttttttctttccccctttttgtgggaattttgggacatggggaaanaaataaaaaccccccccccccgtttggggggggggggtctttttttttttttttttttttcccgggcccacgggaggggggaaggggggggattttttttttttttttttttgccttggggttgggggcccccccacacccaaaaaagctttttcttttttcctttttttttggttaaagggggggggggccccccctcccccggtttttgggtttttggggggggggtgggggggttccccgttttcctttttttttggttcccggggggggattttgggacccccccccccccttggggcttggga

SEQ ID NO: 678376 - DNA, 881 bp, Homo sapiens
tgtgcaccccgcacgctgtaactggcagcacggggaatgcgcgcgcttgtgtgcgaaaccgctgtagtgttttttcagagaccccagttgttggcacacggggggaaaccaaaacttggcttcggacgcaagttccggccatggagaattcgggggcctaaaattggccccggcaggcgtgtgtcatgttcgccccaatttatgccccccccgaggttttaattcttccaatgacgcgccccatgtgggaacaacatcccaagcagaaggaagacagagggcccccaagaaatattctaggcgtaactcctgaccccctttcgacctcaccgcgacgctttctaaccccaggttcttgccctgccaggccgataattctcccttccctcctccccagggaaattaaacaagattttctcccgcgtgcctgacaaaaatgcattctcctaggagtctttttatcaaaaaaatcagaattcttctctcttcccccattgattacaagatcattccttagacgacaattattttagaagaagaccgtgtttgcgcccccaattaagtataacatgttaccgcgggacccccttacaaagaggcgttttcgggggcttgacgcctcttctgggttcccccgagctgtagtgagctcctggacgcgcctccatgaagccccagcacgccccgggagtaacgaaagcacccaagtggtcagagacaaaaggtatgccgccgcgttgcaaacagtctaaatcacgagatatcctcgtcctacataaagagatgaatcagaggcaagcttgttgttcatcacaatataagagaaaagagaaaatattttctcctttccctaatgaggaagggcggcccccatgacacaa

SEQ ID NO: 678377 - DNA, 202 bp, Homo sapiens
actagaggatcccggtaagagcggctattacctgaacacctggaagcatgaagagaaagggcaaagcgctaaggtaggacacaatcgtgtatgaagtcgagcccctgaacatcaataatattgagtgagtttcccaaatgccatgtgactttcttaaccccacactgtgtcagctggattttatctcggcttaacagagaac

SEQ ID NO: 678378 - DNA, 951 bp, Homo sapiens
attggcacgagccaccacgtctgggagggaggtgggggggtcacgcctctgtccggtcagccgccccgtggcggcgatggacggtggggggttcagcccccgcaccggccagccgacccgtccgggacagggcggtcggcggggtcacggcccccgcccacacaagccgcaccgccacgtaccgtacacgagtgcccactgcccacatcagccccctacctaggacacatgcgggggccactctcgcccagcgcagcaacccatcttgacaactgtacccacaactactctcacttgagcaccgtggcccttgcggtataaagcgtcggctctcgctgggcacatagcacacatgtgcgcgccactcctgctctccccccctcacttcatccactcagcactgccatttcccctctatccatgccctctcatcgcacgcttcaccctcggcccacctctcttccaaatctacgtttctttttacctccggccacccacgtcgttccttgccccttctttcaatcccctgtctacattcctgtacgaccgttacccgccgcacatctctcctgattcctctcgaaatactacatgatgattgctgttccacctccccggcttcgcttgcatccatcgggcagagtccaattgatgtggctatgcgaatcagacccctccatttaacgttccagcactccactgtgacgtacgtcatcttatctccctaagtagtaacgcatcgcctgattgtacaatcacccaccgtggctacggggcccacggtactccacgtgccatatttcgatagcaatagtcgcttttgttcaggttatatcattctgtctatcgctgcccctagcgtaatgctccttgcagagtcgttgtctcattcctcctcatggtataacgcccgagtccatgtgaacttcttctctttctcattttcctctt

SEQ ID NO: 678379 - DNA, 114 bp, Homo sapiens
ggcagggttaagggctacccgggactgaggactcctgttttatcccatttcaagactttggctgggtgaggtggctaattcctataatcccagcatttgggaggccgaggtgga

SEQ ID NO: 678380 - DNA, 1290 bp, Homo sapiens
tttttggtgtctgtggttaccccgttgctcctcatcgctagtttggttgtttcccccctatattttttgtgggggcggcgcctcttcgtgtgttctcttcccctggggtggtttttttcttctttggggtgtgttgttctctcccgcgctcgggcgtttttgtctgggcgccctcccccctctctccgtggggtgtgttaaattatgtgttgtgcttaggtgtgtaggtgttcctcccactgttgtgctgcgcgcgtgtcttggcgcgctgcgggagggggggttggcgccgcgtctctctcgtttgggtggtgtttttcttgtggtattctcgctgtgcgcgcgcgtctgtagttaatatcttgcgtgggaggagagagatagaatgttgtttgttctctcgaatgtttctcccccgcggtgtgtggtttcttcttctcgtagatgtggcccccgcggggggctctctctgcgtgtgtgtgtgtgggccgccctctctgatagaggaggctctgtgtggagatgttctctctctctctgtgtgtgtgtgtgtcgcctctctctctcttctctctctctctctctgctgtgtgtgtctccctctgtgtagattatattttttcgcgctgtgcctcccttcgcgcgtggtgctctctctccccgcgacttctgcgtctcactgcggctggtttctctctcccgcgccgcgctgccgcgcccgtcgtgggagagcacatcatcaggtagagagatcttcttcgggtgtgcatccttcacgtgattagagtgatgatgtgttgtttgtctctctctgcctcgctctctctccgcgcgcagtgtgtgttgtgtgatatacacacccgcgcgcgcgagagagtgttgtctcgcgcgcgctgtctctctttattttgtgtggcgccgccacgctgagagagaagcgcgctccccccctctcttttgtgtgtgtgtgttaagagagggcaccccacacattgtgtgtgtgtgtgggcgcccctctctctctgtgtgtgtgggggggcgcctctctctctgtgtgtgtctcttctccaccccgcggtgtttaatatatatttctcctcccccgttgttaagaaattcgccccccctgtggggccccccgaggcttgtgtgttttgttcacaccccgcgtttttttttagaacccccaaatattagcgcgggagagaaaaccaccaccccaagggggtcaccccctccccccctttccccccccccttttttttttcccacaaaaatattgttttttta

SEQ ID NO: 678381 - DNA, 810 bp, Homo sapiens
cacaggtcccttttgcaggtctatttgacatagtaatctagtgtgttggggaggggtagccaagcaggctgcagtgtctgcaatgcagagggcttggggaggtttgggtactctctgctgccactactgggatgatattcagaagagagaggacctcatactgtgactggacccaggaccctccctggaagagagctcagcccagctgtgtgtgtgtgtgtgtgtgagtgtgtgtgtgtgtgtttgtgtgctgtgctcatgtgcacctgggtgtaaaatgactgttatctggttgtgttactcagggtgggctggggactcaccagaagaatcccccccagcctgcccaagacaggtttttcccttgtaccatcttcagagaggtcaggggaagagggtccaggtgggttaaggggggtcgctatggataaccactaagaccagactgctgccaggaggagtgggggataatgaggtggccccagggtcctggcacctggctttggttttccgtcttctttcctcaggacgcccctgaggcctgggacctgtgcctggcttcgaggagcatctgtggctgggtgatccagctgctggtgtgatcatgggcttccctcctctcagcagggcaggcgctcctgccccagagactgggcaactggctgtttctatgacgtatttatttttacttgtgtttcatgtcacttttttaaaaaaaagcaaacagaacaattgtaagtcagtataactgcctatcagttttctttatttctctttttgtaaaataaaatttaaactcaagaaggcaaa

SEQ ID NO: 678382 - DNA, 263 bp, Homo sapiens
gtatgtgatcgcccaacactcactatgcttcgtaatttctccaagatctcctcatcagacattttaggcttcttcttctgcttctcagttattccgggtcaaagcatctggtggagtggtgttattttcacgtaagtgaaatgggacgatgtagccacgtcccgagtttggagtgacaggaagtggttcaatcacagaccgtgtgtatacagatttggtgtgctctgggcgtggacgcaatcactagggttggggactacata

SEQ ID NO: 678383 - DNA, 159 bp, Homo sapiens
gaataccttctgcataatgaattaactaggaataactttgcaaggaggagccaagctaaggaccccgaaaccaggcggagtacctgaggacagctaaagaggacaaccgtctatttaggcaataggtgggaggttataggtagaggcgcaacctaccgg

SEQ ID NO: 678384 - DNA, 102 bp, Homo sapiens
  misc_feature (6)..(6): n is a, c, g, or t
  misc_feature (23)..(23): n is a, c, g, or t
  misc_feature (42)..(42): n is a, c, g, or t
  misc_feature (60)..(60): n is a, c, g, or t
tttccnactactgacttttattnaaaagagtactattagatngaaatagttttcacactnttatattaaaagacccattttacttaccctaaggctaagatc

SEQ ID NO: 678385 - DNA, 430 bp, Homo sapiens
  misc_feature (10)..(10): n is a, c, g, or t
  misc_feature (19)..(19): n is a, c, g, or t
atataaaagnctaaaaatnaaaaactatttacctctgggcctgtttttcttttgggattagataaagcctttctacccatatcaccaaatactcattaaaggctaacacagaaagctttttccaagttaataatttctaaaattaaatatcagggccaggtgtggtggctgacacctgtaatcccagcactttgggaggccgaagtgggtggattacctgaggtcaggagctcgagacaagtcaacatggtgaaacctcatctctgctaaaaatacaaaaactagccaggcatggtgatgcacacctgtaatcccagctactcgggaggctgaggcaggagaattgcttgaacccaggaggcggaggttgcagtgagctgagattgcaccactgcactccagcctgggcgacagagtgagactctgtctc

SEQ ID NO: 678386 - DNA, 241 bp, Homo sapiens
  misc_feature (58)..(58): n is a, c, g, or t
acggtgaattctcggttcacaatgattggaagagacgcagcatctgaaggatcaaaanagcgacagtctgctataaacgcttgagcggcacaaggcagttatacctgtgtgtaacttttctcgacacctctctgtgttaaaaaccacaaaagtcacgaaggatctgtgaaggcccgcgtttcacggtctcggattcgtactgagaaatccagatacaagcgaagcttttggccttactggt

SEQ ID NO: 678387 - DNA, 167 bp, Homo sapiens
taattcaggatcatccaaacttggattaaatagaaagagttggcctttaaaatgtttgcaaattgcctttttttttttaaaaactggaaagaaaaaatattctgttgtgtcctcatacagtgcttaggatgtctttcacagagcttaattaaaaagatgaaacctga

SEQ ID NO: 678388 - DNA, 561 bp, Homo sapiens
attcaccaaccagacactgagcacgaagcacacgtgtcagacacagtctgtgccctccagcacttactcaggctagagctgttcctctggcggggtacactcaactcagtcagcagagaggccgctggtggactgagccactcgggcagctggagctgggtgtgggcctggattcctgaagaggggctctgggacagtgccattcccgtcagcagttcatacagtagagacccaaagctccaccagtcacaggcttccgtcagctcggaaataccacccacctctggggcgctgtagagattgtccacgggctccccgcagcactgggggtccacctctgaacactgggccaaatatgtgagccggatgtgaactccagtgtgtgggaggaaaaaggaggtgacagattgaggacaggtgatacaggggagggggttgcagggcttcccccaacagtcatgcggtaggagccaatgggccttctgggcagaaactcggcagggtcacagcaccctccacagaggcacacgcactctgatggccacagaggccacagggtac

SEQ ID NO: 678389 - DNA, 482 bp, Homo sapiens
ggaggtcggggtggacggatcacgagatcaggagttggaggccagcctggccaacatagtgaaagcccgtctctagtaaaaatacaaaatttagtcagacatggtgggcaggagagagcatatgcaggggaacatccatttataaaaccatcagacctcatgagacttattcactaccatgagaacagcatgggggaaactgcctccatgattcagttatctccacctggccccacccttgacacatgggaattgttacaattcaagatgagatttgggtgcggacagagccaaaccatataattcttccccggcccctcccaaatctcatgtcctcatatttcaaaagcaatcatgccttcccctaagtcccccaaactcttatttcagcattaactcaaaattccatagtccaaagtctcatctgagacaaggcaagtcccttccacctatgagcctgtaaaatcaaaagcaagttagtt

SEQ ID NO: 678390 - DNA, 277 bp, Homo sapiens
  misc_feature (78)..(78): n is a, c, g, or t
  misc_feature (95)..(95): n is a, c, g, or t
gtggaagcgagttgaaaggaagtatttccattctgttactgttttgtagcactttgtccatttattgatttttaaagnagatatttagataccanccctgccctcccccgcccaaaaagaaaaatgttattgtcctcctaatctatatgcctacacctaagaagctgacagatgagctcctaaaacatgaggatgaataaatgtaagacctgtaatatctcctcattcccacagagatttgggtttaaaaaaaatggctaatatttgtaggcctgaa

SEQ ID NO: 678391 - DNA, 255 bp, Homo sapiens
  misc_feature (15)..(15): n is a, c, g, or t
  misc_feature (96)..(96): n is a, c, g, or t
  misc_feature (130)..(130): n is a, c, g, or t
  misc_feature (145)..(145): n is a, c, g, or t
  misc_feature (166)..(166): n is a, c, g, or t
  misc_feature (180)..(180): n is a, c, g, or t
  misc_feature (241)..(241): n is a, c, g, or t
ggcgccatcgcatgngctttggggctggggctccggggaggttccggtagggcgttggagaggccgctctttttgcaaggcccgagacggcggccntgcgcaggccgccctattccgcgccctcaggtcnagtatcagcctgagntggatacccccgcttggcccnggatgccccgctgncccggagcatcctccggcgctgccctcccagagccacgcagaggctgaggtggcgcggggncggccccggcttcc

SEQ ID NO: 678392 - DNA, 111 bp, Homo sapiens
ttgtctggtcaggaaagggtccccacaggagagagcgtcgacgctctctctgtgcgggtgcagtaatcatcaatccagtccatgtgcgtccgtggcgctacctactcacta

SEQ ID NO: 678393 - DNA, 135 bp, Homo sapiens
tgggctgaatttttaaattttttttaaaaacttgaaacaaaaccttgtaatttgtgtaaatgacaagtgtaaaatcctcccataaaatgctaaaaaaatgccctgtttcaaataaaaccaaaaaatgcagcctta

SEQ ID NO: 678394 - DNA, 954 bp, Homo sapiens
agggacatgcgactataatgatctatgaagcctacagattgtcctatttgtctcgcctgcttatacaaaatctgttccaaagtctgccacatgccacgtttgacctattggatcattctatacactattttccgtatattctattccacctcttagaagtctactgtatatcttgatatgctataagctacaacactggattctctatagacctattcatgagatcctggtggtaattaactagtttggggtcgtcatttctcgtatacgcctccaatggaacagtattcggtacgtagctaaccaaagataccagactaattactgaggagtaggataaacgccagtatgcttccttgggtggataagaggtacactacttttggggtatgtgaagacgacctagatctgacagtcacccacgagccgtgtggtcattccatgtatattgattacgttattgtcaggtcaatccaatagttgtgacatacaattcattcgtcaggtggactatgacgatggtggaatactgcgctattatcagtttagttataatgcagctgtattgtgaacagcttaaccaatttcaagtgtaattgtttaattattaccacttagtattcaacttattttttccaccaaggttacaaaattttaattttctagcagaaataacattcgtgaatcaaagcacacctgttatgttcagtcaggttgaacttattgaaacacgtgtcatcaatgttcagttcaaaaagcctgaaagtttagatctagaagctggtaaaaaatgacaattatcaaatcacattaaggggaaccaattgtttgtcttccacttaatccatgtagcacttatttaaaataagcacaccaagttacactgggcacgcgaatattacttgcaaaatttttataactgaagggggtgggcaaacccttgaggatgaatgc

SEQ ID NO: 678395 - DNA, 1214 bp, Homo sapiens
tcctacgggtactagagtcctgcatactctctactacccagagcctccgttagggggtagggaaaggactttgccataggtacgctgaggccaccatactgctctcttactaggccaagggcgtaaaaagatagtcctacccatatagctagagagcaaaccccagaaagcctaattggctagcgccgtaccgcgggcctatggtaccgctatatgaaggcgggtctagcggctagcgagaggagggcgtggcgggaggctaagctagttgtacgtaggttagctacggcaggcacgtagtagcagtacccggaccgcggctgaggggacaactgctccgctgcgcgccgcgggaggaggaacctgccctggtcctattaggtgtccgggcccggccgggccatggattcaatgcctgagcccgcgtcccgctgtcttctagctatactatacccttgctagctagctagctagctagctagctagctagccggccccggagctagggcccgagccaggccggagctgaggagaacgactagggtatacgcctgcccagcaaatagcgaagggactatgcggttacatcgaagtcactgagaccatttagcaagaggctcctggattatagcctgcacaaggaggaggaccggcagccaatcgatttagccaagggccatgtcagagacctttgagcacattacacaaacctggtacaccaagggggtcaaggtaggtgatggacattcctctatgaagctgaggaacgagactatctgcagcaggtggtagaccttcaagaacagtgtagatgtacctggtggcacagaattagacgagggaacacgaagacatgggtacagaaaccaccaagaggaacacctggctgatttcacttggacaaccagttactactggaacagacccattgctgtcagaaccttggtctgggacaaaatgtgatacaactattgtccttgcagtggaaaagtctgagagaaaacactgacacaagcaatagccgacgaggtagacctaaacacgaacgtacagcagaggtgatagtaaggcaacatccacaagagataacgtctcaagagtcctctactcgacctcatattataacactgaactttgtcgcctacaacacagctaatgcagtggacgcaccacgactatattgaaagaagaaagattagcctccccacgaaaaa

SEQ ID NO: 678396 - DNA, 132 bp, Homo sapiens
gcacgtcctgtagcatactcgggacgtcgttcgggtcgtcacgacgaccctggcggatctgctcgactggactcgactcagtgccgccggccctaccgactacggccctcgcctgttgcggggattcctcta

SEQ ID NO: 678397 - DNA, 263 bp, Homo sapiens
atggcacagagcgaacgtgacatttgagctctcctttctactctggggaaacccacattcctcaccagtggggacttggcagggaaggccaccactcctgccccgttgctcagcagcaccctctaggggtggggctctgaagcctgtgcgtccttcagaggcaccatggggaccagagggtgtccggcagcagggccctttccagaagccaaggaacagtaggagagaatgtgcaggcagagggagcctgtgcggaaggggta

SEQ ID NO: 678398 - DNA, 127 bp, Homo sapiens
tgaggacccaccgtaatatgtaccatctcatgtatgtgcttcactgtatgcatttcccagatattgtgtgttttatttttttaaaacaaatggaaggttttggcaaacctgcattgaacaagtctgt

SEQ ID NO: 678399 - DNA, 133 bp, Homo sapiens
actccgcccacctcacgcctcctaaagtgctgggattacagctgtgagccaccctgaccggacacttttgtatgatttctaatgtatttgtaatttaactaacaaattgcctactctgctatgttaatgtatt

SEQ ID NO: 678400 - DNA, 870 bp, Homo sapiens
  misc_feature (112)..(112): n is a, c, g, or t
agtcccgtgtccccgtgcctagcttgtgtcttcctgccgggtacttttggtgggcgcctccccccgtgccatggtgacctgcaactttcgcttcccttaagcggtcgcgccnacacaattttccccgggcggccccccctttgctcttgggaaacccactctcttggccgacgtaaaatgcgtaattcttggggtgcccccctatgacccctcctccatggcgctcttaccccccgtgggtccccgcgtgcaattagttccttgcctttccccggggccagtgtttaatcgccctggtggtcctcgctcccggggaagcccccaaggcgggaccccttttacagcgccactcccaatggcggtggcgctccccaaacagcgcccttcaagtatggcgggtaaacacctcccccttcccagagcatatagctccctcagggcccctggggcgaaatagtattttcttatgcgcattatttcctattgctattcgccaccacgagcccaggggtcgtgttctttggaaaccccactcgcatgtgtggagcctgccaatgtaatccacctacagttgcactagctccgacccccacaagtattttggcaacaccacccccacaccccagcttgtcttggagacgatttccaacccctgctgtatgttctcctccattaaaatctcgagttttctttaagccgtcccttatattttcaccacacaaatcgcctaaaacaccaccctacatttgcaagagataccaagaaaccccacaacagcgacggattgtcggataaaacatcatttttcataccccccaagtgttacctcgggcaaaataaaaaaaaggtctttctaccccaacatacaaa

SEQ ID NO: 678401 - DNA, 155 bp, Homo sapiens
gcggatcgcgcttctgagccgtgctctctaagtgtacgaagagacctcgcggcaagtacataatgtacagtctatgagtaacagtcagtaggtacagatatgtgatctcctctatgtgtctctatctagagaggagtggaatgcctcaatcttaa

SEQ ID NO: 678402 - DNA, 295 bp, Homo sapiens
  misc_feature (56)..(56): n is a, c, g, or t
ggatagtctgtacgcctgcaggtaccggtctgtaatttcccgggacctactactantaaattcgcggccgcgtcgaccccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaatgtctgtaaagctcttcccatgtcgactcgaccgcgaat

SEQ ID NO: 678403 - DNA, 201 bp, Homo sapiens
ttttttttaagggggccccccccccgggggccggggattttcctaaagggcctttttcgggggggccaaaggtttccgggtccccccccgataaaaaaaggtttagggggggaggccgggcccgggccccaggaaatggtccgggaatgttttctttttttttttttccccccccccctttttaattccccccccccttta

SEQ ID NO: 678404 - DNA, 4268 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 678405 - DNA, 4249 bp, Homo sapiens
  misc_feature (6)..(6): n is a, c, g, or t
  misc_feature (9)..(9): n is a, c, g, or t
atcctnttnaatccaagcagtcggtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 678406 - DNA, 4132 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttaca

SEQ ID NO: 678407 - DNA, 241 bp, Homo sapiens
  misc_feature (12)..(12): n is a, c, g, or t
  misc_feature (36)..(36): n is a, c, g, or t
  misc_feature (54)..(54): n is a, c, g, or t
  misc_feature (56)..(56): n is a, c, g, or t
  misc_feature (93)..(93): n is a, c, g, or t
  misc_feature (209)..(209): n is a, c, g, or t
gatttcggcacnaggtgaagggacccggcggctgantgcccgttcagaccatgnantctgaggtgaccttgctgctgagtgccctggcggggnctgcccaggaagcagatacaggccgagctgagccccgcccatgaccgtcgcccactgccaggtgggacgaggccatcactgccatctgggagaccccggctaaaggccaaccctgnctcttcgacgcccccaagttccgaaggttcac

SEQ ID NO: 678408 - DNA, 4000 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaatttta

SEQ ID NO: 678409 - DNA, 212 bp, Homo sapiens
tacgagggctgacatggtgtatgtcacacagtcggctggtcggttgatgcgagtgatatttgacattgtcctgaagcgaggttgggcacagtttagagacaagaccctgaacctctgcaagatgatcgacacgcgcatgtggcagtccatgtgtcctctgcgccagttccagaaactccctgaggatgtactgcagaagattgagaagaaga

SEQ ID NO: 678410 - DNA, 3340 bp, Homo sapiens
gccaagggttaatgacctatatgattccagcagctgactgtattgtcctttatatgtgaagttgacactactgatttgtcaataccaaattttgggttaaagtgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 678411 - DNA, 2971 bp, Homo sapiens
gaataaattgggaaccctgggcttaagggttttcaattcgcaacgggaacaccctttgggcaaggctaaaccttcctgtgaacaacccttcaacctcgcacatggtgttttctttttcttttttctcttttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 678412 - DNA, 681 bp, Homo sapiens
accccagtcaccccggagtcagccaccctctcggaaaagcgacgtgcgcgccaatgcagtgtggtctctgatgggtccaaggacttgacgtgacggtggggtgcttgccactttgatgctagccctgagtcaccaccacctgcgtcccggacggtgtcactgagatccgaggcctgctggccaaggtctgcggctgagagccccccacaggcggccccctgctcaactggggccccgctcgggagagtccccagctaaggctgccccgaggctcctcggccgactgcctcaccctccagcatctcctgcctggaaaggctgtggagcttgggcccccaagccagcgacaggagatggagagcaggtgtccaggcgcatgagcacccgacctccaaggagcacgaggacagtgcaggggtgcacactgaggtctaggccagtgggtcgctgactgctgaacaatggaacaggcctgttcccttccggacccaggcaggctcagctcgtggggaggggacccgtggtctgtgccttgtggggtggagcggtgtgcacgggatgtgtggaaccggccaagggcaacgggagccagcgtgaagtccgttaagtgggggacaaggccaaaaggtatcttgagaccctggtaactcatctgtgggatgatctcggaatgacgggctg

SEQ ID NO: 678413 - DNA, 173 bp, Homo sapiens
agaggatccccttgctggcgcagagcattgacacttttcccgagccacaaagccaggcttccctgggctcggcagggacatgcgctccagtacccgcctcctgcctaccctgcctgccaagggtggcttccagtgttcccactgatcccctgactacctagtttccacacgca

SEQ ID NO: 678414 - DNA, 2236 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattga

SEQ ID NO: 678415 - DNA, 2669 bp, Homo sapiens
gcagggatggtctacctgctaacatcatgtgatattgaatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaatgattctgtaattccagtgtcactaatttatattgttctttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagctacccagtatccatgctgccatatcccttcattgtaaaaagtacctaaacattcgtgaaatgattttttttagctgaaaaatgctggcaagaagaattttaaagcttaaaataggtggtaaatttgaagtatgagtgtgttcacgagaaacataggcttttcaaaaaaatttttattcaaggcaaagcaaggaacatcttgagatatgtctcaagaatataaagatgtattattttaagccaaggagctgaaatatatctcagtttataaattcaggtatattctttttgtctccatggcaaccataacttttgaaccaaaaaaaattgtttttacatctttatgctgaaaatgtgtttagattaggaatatggtcgggctgaatttgctgttgctccctaaccaaatccacctcttgttttccttgtgagtccatggctaaatcaaagctgcccctgagaagagacttaatccaagcctgattgtactagtggcatcacttagaagtaggctttccctcttcctagtagatctcaatgttttataattccttaaaacagctgaaaattgggacaacatactttacgcaatgaacagtagttaaataggaaataaactagttccatgtaagtatacacctagagttttaattacctttataatgtttcttaaaagtgaaacttagatacaattgtgattggatacttagatactaagtgaaacttagtgtaacaattttgatctgttaaattggattttacatgtacatttgaatgccagaatttctaaataaatcccctggttaggaaattttaaaagtcaaagcttgttttcttcaaccactaccttctacattggttgacttagaccgtaagctttttaagtttctcattgtaatttaccttctcatgcagattgctgatgttttattaaaccttatttttacaaaaatgaaaaaaaaaaaaagaaaattgggcggcggcccaaaaatttaaaatgtgggggggccagtatgaagggtaggcagagaaggggaaggggggtcacaaaagaggggggggaaaaagggggggtggaaaagag

SEQ ID NO: 678416 - DNA, 854 bp, Homo sapiens
  misc_feature (11)..(11): n is a, c, g, or t
  misc_feature (49)..(49): n is a, c, g, or t
  misc_feature (67)..(67): n is a, c, g, or t
  misc_feature (88)..(88): n is a, c, g, or t
  misc_feature (127)..(127): n is a, c, g, or t
  misc_feature (133)..(133): n is a, c, g, or t
  misc_feature (158)..(158): n is a, c, g, or t
  misc_feature (164)..(164): n is a, c, g, or t
  misc_feature (188)..(188): n is a, c, g, or t
  misc_feature (208)..(208): n is a, c, g, or t
  misc_feature (274)..(274): n is a, c, g, or t
  misc_feature (285)..(285): n is a, c, g, or t
  misc_feature (287)..(288): n is a, c, g, or t
  misc_feature (303)..(303): n is a, c, g, or t
  misc_feature (308)..(308): n is a, c, g, or t
  misc_feature (312)..(313): n is a, c, g, or t
  misc_feature (317)..(317): n is a, c, g, or t
  misc_feature (329)..(329): n is a, c, g, or t
  misc_feature (336)..(336): n is a, c, g, or t
  misc_feature (340)..(341): n is a, c, g, or t
  misc_feature (351)..(351): n is a, c, g, or t
  misc_feature (368)..(368): n is a, c, g, or t
  misc_feature (372)..(373): n is a, c, g, or t
  misc_feature (378)..(378): n is a, c, g, or t
  misc_feature (383)..(383): n is a, c, g, or t
  misc_feature (393)..(394): n is a, c, g, or t
  misc_feature (400)..(400): n is a, c, g, or t
  misc_feature (404)..(404): n is a, c, g, or t
  misc_feature (407)..(407): n is a, c, g, or t
  misc_feature (410)..(411): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (423)..(424): n is a, c, g, or t
  misc_feature (427)..(427): n is a, c, g, or t
  misc_feature (429)..(430): n is a, c, g, or t
  misc_feature (436)..(437): n is a, c, g, or t
  misc_feature (442)..(442): n is a, c, g, or t
  misc_feature (447)..(447): n is a, c, g, or t
  misc_feature (452)..(453): n is a, c, g, or t
  misc_feature (457)..(457): n is a, c, g, or t
  misc_feature (460)..(460): n is a, c, g, or t
  misc_feature (465)..(465): n is a, c, g, or t
  misc_feature (472)..(472): n is a, c, g, or t
  misc_feature (479)..(479): n is a, c, g, or t
  misc_feature (511)..(511): n is a, c, g, or t
  misc_feature (529)..(529): n is a, c, g, or t
  misc_feature (532)..(532): n is a, c, g, or t
  misc_feature (543)..(544): n is a, c, g, or t
  misc_feature (558)..(558): n is a, c, g, or t
  misc_feature (576)..(576): n is a, c, g, or t
  misc_feature (579)..(579): n is a, c, g, or t
  misc_feature (583)..(583): n is a, c, g, or t
  misc_feature (598)..(598): n is a, c, g, or t
  misc_feature (661)..(661): n is a, c, g, or t
  misc_feature (667)..(667): n is a, c, g, or t
  misc_feature (713)..(713): n is a, c, g, or t
  misc_feature (750)..(751): n is a, c, g, or t
  misc_feature (773)..(773): n is a, c, g, or t
  misc_feature (782)..(782): n is a, c, g, or t
  misc_feature (785)..(785): n is a, c, g, or t
  misc_feature (821)..(821): n is a, c, g, or t
gagtgagggcncaagtccgccctgctccgccacttaggccgccccagangcttccctcggggctgcnaccgggtcgggcgcggctgcngcggctcgcgggccttccccgcaccggcgcggcccaacngccacngaaccttctggaagcggcggctgcntgggcncccacgccgccagaatcgtacgcncgcgcgagctctctgcagcnttggcggcctgggaggcggggctcggggtggggccggcgcgggggcggggtcggcgcggggaggcngcgttcgattngnncccggcgcgcaggcnccgcntcannagcnccatcgctccanctctgcnctcnncctttatggngcggcccgggctcattnattnngcgcngggcntgcaagaaanntgcgcncttntgnagnngcncgcngnatnngcngnngaagcnnccagnatgtngggcnnagangtngagangccgtcngcaatcnagatatgcaggataatgcggccagatgatgcnaaagtggccggcaatgtncanggggggaaatnntgaagatgatagangaggcaggcgccatcatnagnaccnggcattgcaacagcnagaaaggggagcgctgtgtggccgccctggctcgtgtcgagcgcaccgacttcctgtctcccntgtgcntcggtgaggtggcgcatgtcagcgcggagatcacctacacctccangcactctgtggaggtgcaggtcaacgtgatgtccgannacatcctcacaggtgccaaaangctgaccantanggccaccctgtggtatgtgcccctgtcgctgaagantgtggacaaggtcctcgaggtgcctcctgttgt

SEQ ID NO: 678417 - DNA, 2562 bp, Homo sapiens
  misc_feature (11)..(11): n is a, c, g, or t
agccattgtgnatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgaaaaaaaaaaacaaaaaaaaaaaaaaaaaaagagcaaaaaaacaacaaaaaaacaacaagagggcggggggggcacaaacgaaacaacccggagggggcgacaaaaacaagcaccacaacctcgtagaataaacgggggctccccaagaaaaagaggaacaaaaaaagacggcgggccgccagacaacccgccggaggacgacaaccagacaggacgataagtggaagaccaccatgagggggacatgagaaccacaacaaaaagcggcgagcacacaagcgaatgacaaccacacacgcgacaacgcgcagtaaaaatgcgcagat

SEQ ID NO: 678418 - DNA, 117 bp, Homo sapiens
gcggccgcctactactactactactgctcgaattcaagcttctaacgatgtacggggacatgaaaaaaatcaaatttttgatttattataaatgaatgttgtccctgaaccaaaaaa

SEQ ID NO: 678419 - DNA, 294 bp, Homo sapiens
tcagccacatggtgaattgctttgagctaacagtgtggctgcaagctccgagactgcttcagtgaggagggctagctgcccagtagaaagcaaccgacatttttttttttaaacggagttgggatcttgtagcccaggcgggagttgcaagggcacaatctcagctcactacaacctccagctcccgggttcaagcaactctcctggctcggtgtcccgagtagctggaatcacagggatgtgccacattgcctagctcactgttgttatttgcagtagaacgggggtttcacc

SEQ ID NO: 678420 - DNA, 555 bp, Homo sapiens
  misc_feature (16)..(16): n is a, c, g, or t
  misc_feature (32)..(32): n is a, c, g, or t
  misc_feature (59)..(59): n is a, c, g, or t
  misc_feature (73)..(73): n is a, c, g, or t
  misc_feature (84)..(84): n is a, c, g, or t
  misc_feature (131)..(131): n is a, c, g, or t
  misc_feature (139)..(139): n is a, c, g, or t
  misc_feature (182)..(182): n is a, c, g, or t
  misc_feature (184)..(184): n is a, c, g, or t
  misc_feature (338)..(338): n is a, c, g, or t
  misc_feature (453)..(453): n is a, c, g, or t
gtgaaattttcaaccnagggttgcccaatagnactgcagtttattggagggggttttgngaccaggcagtttntaacagtagcnaaatggttggaaaacaagacagtttcctgttattcaacttcaagaantcatggangattgttccagcagtccttgaaaatgaaaagttagcttctgtntntctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtntttactaaaaatacaaaaattagccaggcttagtggcgggcatctgtagtcccagctactcaggaggctgaggcaggagaatcacttgaaccctggaggtggaggttgcagtganccgagatcatgccactgcactgcactccagcctgggtgacaaagcaagactgtgtctcaaaataaataaataaaataaaataaaatgacgtacagagattct

SEQ ID NO: 678421 - DNA, 419 bp, Homo sapiens
  misc_feature (11)..(11): n is a, c, g, or t
  misc_feature (25)..(25): n is a, c, g, or t
  misc_feature (343)..(343): n is a, c, g, or t
  misc_feature (350)..(350): n is a, c, g, or t
  misc_feature (372)..(372): n is a, c, g, or t
  misc_feature (407)..(407): n is a, c, g, or t
tgtccatgtgnaaaagcctttttgncctgaaacccttagcctgccttaggcctttagcctaattgaaaatgccatgttacctattacccagtatttgccccttattttaaaaattacctacctaataacaaataacatcattgagtacgtagtatggattgggttctagggcaaataccttacatgaatcatctcaaggaatagaaccagactcctgttttgccctcttcccaggagctcctgtgggacagacaggcccatactcccctgctgtacaatcatagggcatgctgagcatcagttggctgttacttctttcaaatctgcttttggggagtggggnacatagnttttaaattatttttaaagganagatataagagagtatatggaataaaaccataagnaatgtttattaa

SEQ ID NO: 678422 - DNA, 298 bp, Homo sapiens
gtggtcagaaagcgaattagttcatttaatggcttccagctctggctgatgacgtccccactgacagagaaagggaggctggtagggaactgggtccttctgggtagacctctgggatctccgccaggacgaaaggctctggggaacgagcatttgaagaacagtgactggggtccatggttgtccagaactgcccaaaaggaattcacgcactctgaatctgaagagtcgataccgccagatgtcatggggagatcgtctgggggggtgacaactgggcctgcagctgctgcccagg

SEQ ID NO: 678423 - DNA, 154 bp, Homo sapiens
gtggctgctctagaggtatcccctattcatccgccctcgctattcatcggcgccttcgctattcatcggcaccttcgctcttcatcggcacctcgcttttcatcggctccccaccccatccatacagtctccgtcatgactgaaactctcggct

SEQ ID NO: 678424 - DNA, 1106 bp, Homo sapiens
tatgtgcttgtttccagggacctcttggctgtcctcagatctccgctcctaagccttaatccgaatcgtaatcgcctatgtgggggtctttaactttatctaatcccattgggtggttgcttggtcttgtgcatgaatttgcctggttatatgtgctgcctaagcgctgttggtaagcaagggcaaaaaagtggccaactttatttatgctcgatatcctcggctatgttcatgtcgatctataggcagcgccacaataaagggttaagtgaacgccgggaggccgggaagatcgtgtggcggatgaaagtgcttcttcgaatacagggagtgtaggagagtctggcaaggagaatgcctattggttagctcggcgtcacataggtgctggtaagacaggcactctgtccacggaccagtgctgtgacaccatcaaacacactctgaacgttaaagcggacttaaggcagacaccttgttgactagtgtctctcgaatgtgttctcttagaccacatatcgttccttagtgaagcacgctacttatgccaaggggataacaagcgactatgtctgtgtatgtatgggactatagatgtaagtacgtatatatttaacaaaccctgtccattgatagttaagttaaggctgagcatcataaagggtgatcacaatgaaatgtgtaactgcaaattgtcatgagtaatatgtaactttagtaaaaataatattagtaaaataacaggaatttaaacctgtgtactaaagtagatccataaaacctgtctcgtcacacgtactagtatgtagactgtattgctcttagtaagtggttctacagaaacactgtctgtggctgaagtcttccgtcgaattgcttttatgacaactgtacagtctcttattaagtcctttaaagctgacgtcattagccatcatgtagcttaaggagtcatgaaatctgccagttaagactgcactctttaagccaggtgctggtagcatgtgcgctatagtcccagctaacttgggaggtggaggtgggaggaattataaatagagactttcctgaagactctaaaaatatactcccacggtgtttttata

SEQ ID NO: 678425 - DNA, 198 bp, Homo sapiens
agtgaggtgctgataatagcgaagtgctgataatagcgagggtgctgataatacgaggtgctgataatatgcgaggtggagatacatagcgaggtgccgatgaatagcgaggtgccgataatagcgaggtgccgataaatagcgaggtgccgataaatagctgaggtgcgatgaatagcgatgggtgccgatgaatag

SEQ ID NO: 678426 - DNA, 1079 bp, Homo sapiens
ggtataagcctctcctggggccactgtgtggctgtgcggagatgatgcccagcacagaagtacacaggtccatgtcccccagtattaggacccaaggcctgtgtcccggggaacaatcactggatctcagattctgatactggttgatcgtagctatacccttgtctgctaggattggacgtctcccgcaaagaggcggggcccagtcctaagcgagcttccaaggtcccacatgaggatgggctagctgggacggagtttggaagcgccgctgacaattgtaggcgcgggaggaagatgtgatgcggttgacgttcgtacacacgtgaatgtcaaaactagtgaacatgcagctcgcaggaaacaggggggagtgttgtgacctgggaagatccgcgactggtcaagacatgggacctcgtccatacagtgcaggcggaagaatcacagacatgattgctgtcactactggcttggcccatggagcttctgcagaacctacctatggccttctgcacgttgtgggctcacctttcgcggcttggagaccaatacgggaattccacgacgtcacgccaagggcttgcttggtagggtacctcctcacgaaagtatgcatggtccccttgtgaacttctagtggtgttcgtaagcaactggccgttgaaacctgacacctgcaggacctaaatacagttcttgaaccaaaggtggagttcttgttccccctttggagctcgcaaagaagatagccttgcctggatccgtgctaccgaagggattaaccccaaggacctcgcgagcctaattggtcatttacctaagccatagaggattgcctaggtgtacccttcttgcgtcagggagcgttaccccggcgagcatgggctgtgacaagccgaaggggcctttggggatcttacacactgtttcagtgaggccaaggccttgggaccaaaggcccaaagtccggtggccgaagtgtgcactggaaacattggcttgatgcagcccaaggagaactggtcctttgatatgttcctgggatccctgttatcctacaagttaatgaaacagga

SEQ ID NO: 678427 - DNA, 901 bp, Homo sapiens
  misc_feature (901)..(901): n is a, c, g, or t
tggtattacacatttccatcccgggtctaatggtcatcggacttttatttggaagtactcggaccctccaccctcttattttatacagattgggagggcaattttgtgtccaaaaacctacagacaagtacttggagagatttccaatatatatatcgcgacttactgataatttttccatattcagaaggaaaacggggaatataacggttgggtgggggggtactcgggtaccaatttatagctaataagctacgggtggagagaatggtaccatatgcttgacaaatttggtgtggcatctggaagggaattcaccccatgatatcctcttaagaagtatcttaccttggtgtcctaaccccctttgggaggacagtggtggaccccctattttctcatcccgaagaaatattatctaaaccacctttcggggcgctggtaacaagcacatcctttaaatacctatgtccctcttgggctggtttggtacgacagagacctttttggattggaccgctgtgggccttgttttggtctcacaatttgtggaacgcagatttctggttaagtccccttgggtaggacatggcgtcggcaacgggagtaaaataacccaggttgtggtggacattggcccattttctgagggccttatggacacagtgggcggcaaccgggtcgcggcgaacttttaatcactggcaacaaggggagtgagttctccccggaccatctgcggggcaacacatcaatggagtgggcgggtggaaacctggtgaacggagccaagcctgcccccagtgggtcacacacacagttgtaggcctacaaccggtggcaaccgggggaccagccgcgctgctctggaaagaacacatcccccagtgggcagccaacn

SEQ ID NO: 678428 - DNA, 308 bp, Homo sapiens
accaccgactgcaagctcagctactcaggaggctgaggcaggagaactgcttgactctgtgaggcggaggtagcagtgagagctagatggcaccacttcactccagcctgggcaacagagcgagactcgcatctccaaaaaagaaagcttcgcggaatacccaagtgaagcacagttctatatatctacgcaaaacatcagaggtgattgcacagcagatgaattgagtggatatcaagatcagtgcaacacatctgaattccgcgaagcgtgatttcatggagagcagactaagagctgtattcaag

SEQ ID NO: 678429 - DNA, 999 bp, Homo sapiens
catctaggacggccttagtgccgtcagtatggcccataaaaagacgcacgcctacagtcgaatcgtaaacctccattccggcaggatcactgtcgcatatctcgagcgttgctttcaagagcaccggaccaatccgctcgatgaatggccctgtgatatgcaagcaacaatagcagcatatactctaccgaggtcgcatcataacttggtcgtccaaagcgatcgacttcatcgaaccatgtgtaccttagacgaaaagtcgaggaacaatgaggatctggcttccgtgatagtcatgtgtgccggctggctaatagtaagatccgtagccttcatggtatgagagcatattccctggactgaagacctaacgtcgttcatggtccaatgcagcgccctatggagcgaagattgttgctgactatgttcacttgggcgatgccgatgacaaaaatgctgccatggtaggtcattgagggaactagcatgcgttataagtctatgctgtgctttgcaatgactgacttatcacgactgtgtgagctattcttgaaaggcctgtctgactcatgcctgcgggaagctactgacctttgattcatttcattacttctgcaagaatagctgtatgcctcttgacctctgggtagagtcatgcggataaatggcttaacaataaggtaagaaatagccagtattagtcatagcttgacagccttcttgtcttaatcacaggataggtattcaggactccagctccgttgtagcaaccggtttgagaggactgtatctacgcgtgggaccgaaagaattacgcggggtaagggtgtccaccgccactgttgaataaccttagtaaacggatttgtgtgccagaattgaggttcacgaaaccatctttggggatgagaaacctttgcgggtagacaggatctacatgcaaacccagcaaaagtcatacctcaaacgtggagaaggacactaatcataaacgaagcc

SEQ ID NO: 678430 - DNA, 981 bp, Homo sapiens
gctgtggagcggacgctgtgtcccctttctgctgtcaggaatctctcatcagagctgctgatggaatcggtgcccggagaccctgccccggcccggtccacagttctccccatgagaagccggactctattgggagcgggatcctgggcggagcctgtagccgagcctcgagagccagatccctgaaaccgatgaaccatcacatgccatggggacgcccctggagagcagccatgctccgaggagcgaggccgaccgccgcgaccagagcagcccatgagcggacacggtcaatctgtacccatgcacagtggccacgtgttgaatgcggttatgcatgactggcaacacatgcgatggactccctgctggcaacgggatcacccaagggcctatacagtcctgcgtaccagatctacgcgacaatccctcagcgggacccaactctacctattcggcgtcgatggagccagggaaatgaatgcatgccctgacaagcacgtgtggtcatacaagcttggtgccatacgtccgggaggtgtcaacagtatgacccacggacaggcccacgaaatatccatcaagtggacgtcgactgacttcgtccaaggtcttggcgtacctcaacgtatccgtgcagcacagtgaggccatgccgagcccaaatttagctcaaaactgaaaattggcccagatggcctaagaaggccgatatgggaaactgtacgcgtgggtctcccgcaaacaagcaccagaccgggcaaacggaacacaacaccatggggcaagggcaccctgacaatgggaggacgcatcccctgcaggaagcgccgtcgttgcgacatccaacgcgacagaaacaagcgggaccaccagacagcgcacgagcgaccgaagacggcaaccgacgcaaagaagacgccaggggagacatcaccaaatgaccggagaagggcagccaccaggagcggccaccgccat

SEQ ID NO: 678431 - DNA, 1139 bp, Homo sapiens
cagggtacttgcaggtgcaagagttgcacctggtctaggaagctgcagagaaaagaactctgtgggagacagacactgcccctgtgagtcgcagcagccaccctccgaccatgtccccggtgacggggggcggacttcgatggtgcaacttgccgcggactgcctgggcttagccagcgatgctactggcgctccctgtggagcccggaattgcacggctgcaggcccggctggggggctatcgtctatgtcttcttggaggcgccagacgaatcggggtctcgtttaggctggaagagcccagtgttggtggcttcaggtggctgctgccgccgccgccgccgccgccgactgctagtgcggtttccgcgcgctggtgcgaacgagaagagacacgcgaggcggggagacctccaaggcagcgagggcatcggacatgtgtcagcacatctggggcgcacatccgtcgagcccgaggggagatttgccggaacaattcaaactgctggatatttgatcttgggggtgactgtccctggccggcttgtcgaggtgggagtgcgagtgtgcactcgactcggaagtgtgtgcgagtgtgtatgtagtgtgtgccagagtcgggctccccccttaccccacgttaacccgtcgagtgatgcacttggcactgacaatcagacggaatggcacatagtctgtggaggtgcttttaactgtcttcaagacaagtatcatccgtctgcatattcaggtccaacagaagacccacacagaaattccatgagtgctggggcgcataacaggcacgtggccagggaagactatgtccagaccacatacatgggggacggggagaccacaaatagaaccgatgccccggtagccaacggcgcaccagcaccaaaacacacggcacagcgaaacgcagcctagggagcacacgagaaactacacacgggccacacagagacacggggacaggatccacgtgcaacgaaacccacaccgcgaacagcaacaaaaggagcagaaaaaacaggggacacagatgcgagcaaccgcagccacaagaccaagcacagaccgaagcgacgcaagccgccagaccaccacacaacaccactagcacccacagcacc

SEQ ID NO: 678432 - DNA, 320 bp, Homo sapiens
gagcatagtcttctgaaactatctttattgacaacttccatttaagaaataccgactactcaccaacaaaatgtttacatatgcacgcacatggagggatcatgtctaggatactcaaaccaagacatgagcacatcatgtacaaattcattgtaaacttacaaaataagtttcaaaatttctgcaagccctcactatacaaactcagaatcctctttattttagagacagggctctggctctggcacccagactggagtacagaggcacaatctcagcccactgcaacctccgtctcctgggctcagacgaacggagcg

SEQ ID NO: 678433 - DNA, 788 bp, Homo sapiens
tgtctcaaaaactagcagcctgccttatgtggaacttacattctacgcagcctatgaccgagaacacgttacctagtgatagaaagacagacatattggctatcgaggaaagggtacacgccaccttctagactgggctggctcagggcccggcctccctctgaccgacgactatggcaacggtacagggaagacgcccaaacccccttgttggcagcagcctgacgcgcaggacgcactaactagagctaagaagagaggacactgagccccgtgggcccacagggcaccccatgccgcttctaccgaccacaccgcaacgcgcgacccaagactgcaggccccgcccagaagcggcagggcagctagcccccggcagcaccacacagaacctggagcccatggaacgcggcgcaacgcccagaggggctaggcggccccctggcaaacgcaccaacccaccaacgggaccgcacgccccaggccctaacgacgggaacgaaccgcacactcgcctaacgcaagaccactgctaggcgacctgcatctccgagccgcggcggaccccgctccagacgatgtccccctagagcattttggtataacgcggcagccgctattcagcaaatcccccactgttgcgcagcgccacatcgtgtccccccttagtctccccttagtacaccccaattgagtagcccgtaaccccgatcccctgcacaacaacaccacccactaacacatacccacatctaaagagccacaccaagttaccacctgtgcgcacc

SEQ ID NO: 678434 - DNA, 787 bp, Homo sapiens
ctttccaaaaaacacatcatttgaatcaacacaacacccacagctaattattagcatcatccctctactattttttaaccaaatcaacaacaaactatttagctgttccccaaccttttcctccgacccctaacaaccccctcctaatactaactaccatgaatcctggaccctcacaactcatggaaagccaacgccacttatccagtgaaccactatcacgacaaaaactctacctctctatactaatcatccctacaacatcgtccattaattataacattcacagccacagaactactcatatttgtatatcttcttcgaaagcacaattatacccacccttggaatatcatcaaccgactgaggcaaacagaacagaacgcactgaacgcaggccacatacttgcctatttctagcagacctaggtaggactcccttcccaactaaatacattcgcactaactatacacaagtccaaaaccaaccctaggatcaactaaacattctaactaactcaccctcacatggccaagaaacatagtcacagagctacactgagacccaaacaaaattaaatagtgcagtaggcttaccaaccatcagcttttcatacgttcacagataacctcttttcacgggagatcccactatatgaatcccgtaatggagccacgtcagaagagcccacactacgcaggggatcaataagtacattggacgacggagtactggaagactagggggtatggtataaataaggcgtacaaaacattctgaaaaaca

SEQ ID NO: 678435 - DNA, 416 bp, Homo sapiens
taatgaccctaggaaattagggaagccaagtgatcgtaagccataaatgaagttcataagaataaatctgggaaagagtaactatctatatcacttcaagatagagaagaactatgtaaaggtgagtgttttgtagactggcggttcagtgacagcaaatgtgttacctttgggtttccctggttatgtgcttggtgatgaagagtgaggctggcccagggaaagttttgtgacactagaggactgcttgacctataccaatcttactgcttttaaaatagaaacaagtgggggctatcctaaatgaccagcagcagaatgtttaaataaactaaggcaaaattgctgatacataaagtattatgcagccatccccaaatttgatttcccaaatcaaatataagaaccgattttaa

SEQ ID NO: 678436 - DNA, 102 bp, Homo sapiens
  misc_feature (27)..(27): n is a, c, g, or t
  misc_feature (59)..(59): n is a, c, g, or t
  misc_feature (88)..(88): n is a, c, g, or t
  misc_feature (95)..(95): n is a, c, g, or t
gatctcgaaccctgtctagaaggaatntatttgttgctaaatgttcactttttatagtnatgtcctgtattctaaacagtaaaggggntttattnctatcac

SEQ ID NO: 678437 - DNA, 470 bp, Homo sapiens
tcggaataatattggatggagcacgggtgatatctacagagatctcaagtgaatgccccgtgactgactgaccgaatgaatgaatataaaaaactaagtgagtgtattttaaacacagattttagatcaggcatggaggcttgtgcctacaatcacaatgacagagtcagactgtgtcttaaacaaaacaaaacagattttggcagagagaagcgatctcacaccaagggatggtgagaccctggagaagaggccaagccaaactaacagcatgtgactgtgctttttgagagtccctcagaccagtggcagctaccatggcacagctgtcgtacggtgttaaggctctggcttacccactgccaacagaaatgggcgaagaaagaggcaggaaggacatgggtagtgcagtagtgagtacacacagtgagaactggatctagatggaaaagcaattccgtactccccag

SEQ ID NO: 678438 - DNA, 507 bp, Homo sapiens
ttatcacttcttcacttcacttctacaagataatgtcttgagattatccagacatcaactggctacaatcttctatctcctcctgaacagatacaatatgatctcgaagttctttaatatgctcctgacactgtactgagacacaagtctcggaggcaccgtctgtgtctagtagccgaatcttcatcatcaatgtttatctcttcagttattacatctggtcccagcttggccatgtacaacatgctgatactattcaaagtattataaatcttcatatcagctttgtagccaaagcttcagcacctttctcgacaagtcttctctatttcccagactggttctgcatgacattaccttcctctatgaccatgtgagcacatttcctgaaattcttcccgctatctcccggcttcctctcgtacttgcctcattttgtcacacttctcctttgttatctggttctctgctctcaggtctccatcttcgcctattgtggctcggggc

SEQ ID NO: 678439 - DNA, 416 bp, Homo sapiens
tgagctgcacagatgcaaacaccttccaaacacagtcacgaggccttaggaacgtctccagagcttccgtcatcatccgggtctcctcgtcagctcctgcctggtgagggctctgccagaggacagccctgagtgccgccatcaaggctgaggaggccgcccccacgtgccacccacgaagctgcctgcaggccgggaggcttctcttttggcttcagccacatgtgaaggagaacctgtcaagctccggctgatgaagtcttcagaagggctcagagtcaagcggcagaactcctggtgccatctgcttaattacaggcgcgggttttcctcggtgttttgatctataaatacgaaaaataagaacagcaccggtgctgaatctatgtcatcccatgaatggatgaactggttga

SEQ ID NO: 678440 - DNA, 1228 bp, Homo sapiens
gtggttgctggagtagccgctcggtggccgttacaacttgctttcagtctctccgagccatcggatttccttcactcatcgcaggcaccctacatacattgcatcggagcgagcggcccacacgaggtcgttgggagacggattcaagctgaggggtgacatgaacgtcctggatagctcctgtcccctaggtagtccagagctgattcacactctgatactcaatttagcagacgctaactctatatgcaagaatgactggtggggcaggtagagtcatgggctggggaccgtggccctctgtttcactgttcatacttgccacaatagccgcgctcgtacaagcgccggggatgcttgggagcacggggtaaccaatcactactacaattacttaaaagcaaccaacctgggttcaaccccctactataccatgccccttcattcttctttgcgctcccatggtcgaagagtttgggttgcacatctggggatgttcgcttggacttccggttgggatgccatttggggcaccggggcgttgcataacacttgcacctgggagggattaaaggaaacacaggcctaggaattggagtctggaacattcaaaaatcacaaaggtccttcaaaatcgaaacaggcggggccgaaacccaatacctttgtgaggcacttgtacttttcaacatggttatgtgttgcactcataatggttgttatacaattttagcgaggtcccttacaaggcgtggcgaactaggtataatcaccaacgaggttttcccttgggagcattgccgatggggggcccgtgctaaagggggagaattcctcctccgttgctttgtaaggagttgggcacagggaccccataaggttggtgcatccccccaatggggttgttccttggggaggcctcatcggcggaagaacctatttacttgggcgccgtgtcccccttataccccattctccgggctgtgggaattcctgttggccccacaagagggctgtgtccgtttgggaggtggaccaatcacttattttccccaagacaaaggaccccactcagggggaaagaagagtcttgtacttgggacaacatggggggacccaaaggttcactcaagggacttggaacacacattgtgggatatcacaccctttatctctcaatccaaagaacaaacaccttaggaagggttcaacaaaacaccgttggaac

SEQ ID NO: 678441 - DNA, 293 bp, Homo sapiens
cctttgcaaactcattctcaactccttagactcagtcaagtcccccagttacccccttccatgggactatatatcattccttcagagcccttaacccagttatttcctatggatttggccagtcctttgaataatggtcctagtttccttggatggaaagttccccaaggtcagtggccctttctatttgggttccccaatgggttcccagggcccagaaacaatgcctagcataaagcagctgttttgtaaatacttgttcaatgaatgaattaatggccaaagaacctcca

SEQ ID NO: 678442 - DNA, 326 bp, Homo sapiens
ataatgggtggggggtggtagacgggggtcggggtagaggagactgtgtgtaggagatgatcgagagtaccgcgtatctggaacttagcctacggagtatctcagagccggcttggctccgaacctatccggggattccagtggtagcacgggcatgacacccacagcatcctcgacagcctcgtggctcgtatgggcagtaactcccggctctgcatggtctctctgagtctcttcaggaccctcctgaacctcagctgtgaggatgtcctgctgcagctggttctcaggtatctggttccatgtaaccacgttatgctgagcca

SEQ ID NO: 678443 - DNA, 442 bp, Homo sapiens
cttagcctaactaagcatctatagacactagaatcagccaaatcatagctgaaatagagccaggccatacacataactataaatgatcaataagaccttctgctactggccattcatgtgggcatcacaaagacctgggatatatatcccattaacacttctagatattatccagagagaacttcccaaactagcaagacaagccaacatatcaaattcaggaaatatagagaaacgccacaaagatacttctcgagaagagcaaacccaaagccacataatctatcaggattcaccaaaggttgaaatgaaggacaaaacatgtaacggggcagccagagggaaaaggtcaggttacccacaatctgccgccgtggaggtacctggttagctggctttggcagagaacgcaaatcaggcaccaaactattcaacatctctg

SEQ ID NO: 678444 - DNA, 604 bp, Homo sapiens
gaaaaactacactgtcttgttagcagcatatgtaaatattagatctttctgagtttctcttctcagatctgccaatttcttggggcaaatgtatcctgcagtagcctcaatttaccctttgaaatgagggattaaaggttttagacattctttgggttatctgaaacacaattctttttggatcagtaatgttttatatatgtccactttatgatgtctaaaattttattccccctatgtattagtcttcctgtggctgctataacaaattaccacagacttggctggtttacaaacacaggcaggaacttctattcttctcaacaatttctggagacccagcaaagtctgccaactcaacgatacttgaggcccactctggacggctctagcgagacgagactgatacctttgccatctttcagccttctgacttactggtcagcaattccttggcactatctctctgtactgtccttcaccactgtccttctctttcgagatacttgcatcagaactcttccctctacctgtgtattataacggatacatatgcatcgccactctaagaacccacttggatgaacaggatagatattctcca

SEQ ID NO: 678445 - DNA, 372 bp, Homo sapiens
actacatacttccggggcaatttacaaaagaaagaggtttaatggacttacatttccatatgactagggaggcctcacaatcgtggcagaaggcaaggaggagaaagtcatgtcttacatggatggcagcaggcaaagagagagattgggcagggaaactctgccttataaagccatcagtctcatgagacttattcacgtgagatttattcactatcatgagaacgccatgggaaagacctgccgccatgattcagttacctcccactgggtccctcccacaacatgtgggaattcaacatgagatttgggtggggacaaagccaaaccatatcagtcatcttcacctatatatatacacatgcaggttct

SEQ ID NO: 678446 - DNA, 296 bp, Homo sapiens
  misc_feature (2)..(2): n is a, c, g, or t
  misc_feature (8)..(8): n is a, c, g, or t
antccgtnacagtagaatactggtacatgagaagggagaggccatcactcaactgacgttcgcattgccctcctgggtcgtcttctctcacgttgcctagctttttgttttcctttagtggatgcattgcacagcaatgtgttttctggccaagatgctacataaatcaatgcaagttcccgaaaagtcttgttgcatttcttgtagagcaatatgagaatctgagagtgccttttctcttaacatgtggtacggacttaatcgcggtggatctctctagtacgtcgatcctgaca

SEQ ID NO: 678447 - DNA, 90 bp, Homo sapiens
aagacagcagcatatatctctgcagcgttaaaacttcaaggacaggaacctacgagcagtacttcgggccgggcaccaggctcacggtca

SEQ ID NO: 678448 - DNA, 1017 bp, Homo sapiens
gcaggtctcttgggcctgtgtgctagacgattagagctcatggagctactgtgtcataccatgaggtgaggtcaaccagaccgtatgacgcagggccatcactgtcactagtgacgtgtgagtactgagtgtgtgagtgtgtgcatggtgggtgatcagatcccagtagctcctgagaaaggatgtctcgagaggaactgacatctctcgaaccattactccgtctagtccccattatggactctcaggcatagactggtgcggacgacagttgggactgagtctttgttattgtagcctgcacgcccgactggctgaacctcatggatgagctatcgccacatgatagcacacgcttagtaagaatccctctatgtcctataaagaaagatcgactctacagttagcctcctgactgtcggacaggcgttccagacacggctcgtgaagagtacatgtgatgttcgtgagacgcacgtggaggtgggcttcgtggggtggggcactggcgcaatcaactcgcgtgtgcaatcaaggcaagccactgggaaggtctagcacatgtattagggagtcagataggttaaacatccatgtagtcgaggtatggaggtatatagcctccgaggaagagacgatttcgaagcgtagggacctcccgagttaggactggtgagggatccatcggttggcagcacgcgcaaaggaaccgctgtgtcacgcctacgcttgcgtcttttgcgtctgtcgagtcccactgttggccgacgcccgtactttcccatggaataattccccaatacaagacctggagaagtgccgaggggggccactggccgtggggcacgacacctagcagggtccccaaacgccgggcagctgtcatggacatccttacttcaacggagcaatcgacgccatgtgccaccggcacctgacaaggggctgggcagggggggccgatctcccaaaaaaccgagtcccctgaaaaaaagccacgggaaaaaaagctggccc

SEQ ID NO: 678449 - DNA, 106 bp, Homo sapiens
gaggatcctgaaggtcgcaggaccctttgggctagtaagaccagaggtataaggccgaatagggtcaagaacttgatagtaaggagaacgatttactagttaccaa

SEQ ID NO: 678450 - DNA, 155 bp, Homo sapiens
  misc_feature (54)..(54): n is a, c, g, or t
  misc_feature (131)..(131): n is a, c, g, or t
ggctaccccaactgttgcatcagtaccccccatttatcatcaacgggtacaaancgagttcggccttgtctgtggagacggattacacctttcccattgctgaaaaggtcaaggccttcttggctgatccnatctgcctttgtggctgctgcccc

SEQ ID NO: 678451 - DNA, 602 bp, Homo sapiens
ggatatttggagcgctttgaggcctatggtggaataggaaatatctttatgtaaaaactacacggaagcattctgagaaacttctttgtgatgtgtgcattcaactcacagagttgaacctttcttttgattgagtagttctgaaacactctctttgtagaatctgcaagtggatatttggagggctttgaggcctattttggaaaacgaaaatatcttcacataaaatctacacagaatcattctgagaaactttttttgtgatgtgtgcattcatctcacagagttgtaccttttttttgattgagcagtattgaaacactggtgttggaaaatctgcaagttcatattttgaacgctttgacgcctattgtggaaaagggaataacttaagaccacacagaagcatttctgagaaaattctttggggtggtgtgcattcaacctacagatgggaaataaactttttgatgagcaagtttgaagctccttttttgaagtatctgcaggtgtatgtttggaaccatttgatgccctatgggggaaaaggaatgcccttcccatgctagacagaagttttggccccttggatggggggttcg

SEQ ID NO: 678452 - DNA, 179 bp, Homo sapiens
gctacattttagtcctctacttcatggctggaggaggcatacaggataacaaagaaaaaaaaaattagaaaaaaataagaaagtggttcccttttatcgaggaagaccacaggggtgctgtagggcagcacattgtgctgggcaccaggccagttagtgcaccaggaaagaagaagcac

SEQ ID NO: 678453 - DNA, 523 bp, Homo sapiens
  misc_feature (89)..(89): n is a, c, g, or t
ttttgtgcccccgtcgccgcgggaccccccccccctgtttttgccccctataaaaccccggggcgtcctacccccgggtttttttgtgnggcgggggggtatatttttttccccgggggcactgtttccccttgggccctttttggggcccttataacacagtttttttcaaaaaaccgggtggggccgggcccggatttcccgggttttttttaccccccgggccccccttgggggtttaggtttttgggggtttccaaaaaccgggggggccccggggggcgggccaaaaaatttttccccccctgggggggccggggtttttttggggccccccccccgggtcccggtggggggcccccccggggttcttttttttgggggggaaaacccccttttttccccccccccgggccccccggggggcccccctttttttttccccccggggttttttttttgggggggtgggttttggggcccaccccctggggtcccctttaaggggcccctttttttttta

SEQ ID NO: 678454 - DNA, 390 bp, Homo sapiens
atccagaccatccaggcctttccagaccactcaggcagatccaggccatccatgcctttccggaccacccaggcccttcccgaccatccaggcctatccagaccatccatgcctttccggaccacccaggctaatccaggctgatccaggccacccatgcctttccggaccactcaggcagatccaggccatccatgcctttccagaccacccaggctgatccaggctgatccaggccacccatgcctttccagacaaaccagacccttgcagaccatctgcccgatccaggccatccaggccgaatgtctcatccctggttgatataatatgtacgaagaaaaaggaggaagggagacctacagattcaataagacttaaaagacctta

SEQ ID NO: 678455 - DNA, 1413 bp, Homo sapiens
ttttttatataggctctagagggggtagagggggtgctatagggtaaatacgaggccctatttcaaaaatttttaggggaattaattctaggacgcatgggcataacaactgttggttggcctccaccagaattatcaaagcattgaccgtcagtatacccccgagtcgtgtcagcggtgcaaaggtggattggagtattaacacagatccgggaaattgcaatcatgtaattaaacagcctatcaagtggtgggcgcaccagcctccatcgcatttgccaagaaccgtctttgctgcaatgtcaatatattcatcccacaattggagggctcccacaactcagggcagatcactcactctgcattttgctccacacgctccacaggcagtatcagccagagttcgccctgtgtgtattactatagggcacatctccggtgaggagaaaagttcatgttcagaacagtatgtcggaacaacaatataagacatcccgcccagacagactagcgagatgatcactatcagtataagaggaatacatcacaaaataacacaaattgatgcagagtgaggcacaaacatgtagacataaccgaacactgcgtaatcaacagaggaacggaggacacatcgagataaacacaccaaatagacatcagtgtgcatcatgtagtcaacaaggagacaatgaccgattcagggccattggacacagagcggacgcaagaagagccacctacgggccatggccataggcggaggaaccggagaaagacgaaacagacaggggatcaacatattcaccgcggtcgaccgatcttggacccacggtccaggcccatcaaagcaagaataacgtgatgagagacggatgtacagagaagcgcggagcaccacaaagggccatgaggacacggagcagcaggggcacacgtgacgacagcgggcggatacgaccacgacagggagacgaaggccgcagcacaataatagatggaaagggtgaagcaatagacaaagctacgaagagcaaaagcagaaaggacgacagaagagatcaacaaggggaggcacagacaaagacggaacgaacatacagggagaccgggacacacgtaggaggacgtcaggaaggagaaggagcgcacgcagcgccgcccacagcgggcaggggcacccaccggcacgagcggacgagccagaacgagagcacgatgccaggggagcacataggggggcaaagcgcacgcgatcaggaccaggcatacacagaggagaaacgaaagagggaagacgggcagcgacgcggggcgacgcaacatcaggggaggacggagagaagcaacagactagaaagagggcaggaccgccgtagcagagaaagacgatgagcagggcggcccgcgcac

SEQ ID NO: 678456 - DNA, 875 bp, Homo sapiens
cgttgtggacccccccccggggcctgcgcggtccccctgcctgtttgcctgggtccttgccctcccctaattctccgcgcccccccgtttggctccaagccgcgtcctccataggggctgtcgaccccccgggcgtttctctccgcgtggcgccccagtcttatggccgccccccccgaggagtgctcccacagccttgtcggcacccctgtgggatctccccctgatgtcttcaccgccccctggggtttctccccccccctcctgtggagcgccccgtctgctcacgctatgggggtttctctctccccctcccgcgtggtgggtgctccttaaaaaaaacccctatcttccccccccttgtcccccccaatggtccctcttcttttctaatgccctcggtaaaccccggaaactctccctcctcccccgggcgacgcaccaaccccagtccttaaaaccgcccccattctcgcatcgagaaacaaatttttctcagagagcccacaaacgagtctttttcgcatgcacgcaacacagcctgtctcctcacaaacgcctatgacactctctccccactagaatgaacacccacttttcggcgcacaccggcgaggcacgaccatatctttctccctcgatttgacaactctccccctgcggggaatccccgcggcaaaagtccttgcattctcacccgacggatgaaatctccttgcttggcagaacccacccctcatccctgccactatcacagactcgcttttcttctcaccaagaacccgctctcctcctctctattggttctagccctccccagagatgcgccaaacagcccaaacccttaaaattaaacttccctccccaaacataac

SEQ ID NO: 678457 - DNA, 742 bp, Homo sapiens
  misc_feature (712)..(714): n is a, c, g, or t
  misc_feature (717)..(717): n is a, c, g, or t
  misc_feature (719)..(719): n is a, c, g, or t
  misc_feature (721)..(723): n is a, c, g, or t
  misc_feature (725)..(727): n is a, c, g, or t
  misc_feature (731)..(731): n is a, c, g, or t
  misc_feature (733)..(733): n is a, c, g, or t
  misc_feature (735)..(736): n is a, c, g, or t
gctttttttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacccttaagacctacttgtgatatttaaatgatgccataaaagacctattgatttgggaannnaanantnnncnnntggntnanncataag

SEQ ID NO: 678458 - DNA, 988 bp, Homo sapiens
  misc_feature (860)..(860): n is a, c, g, or t
  misc_feature (870)..(870): n is a, c, g, or t
  misc_feature (877)..(877): n is a, c, g, or t
  misc_feature (880)..(881): n is a, c, g, or t
  misc_feature (886)..(886): n is a, c, g, or t
  misc_feature (898)..(898): n is a, c, g, or t
gctttttttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacccttaagacctacttgtgatatttaaatgattgcaaaaaganactatgattnggacttnttnntaaanaaaatacagaanaaaaagaaaaaatagggagattatgagagaggaacagagaaaaggaatgagacagtagagagcatttgaaatgtaaaagcggacataaca

SEQ ID NO: 678459 - DNA, 1318 bp, Homo sapiens
  misc_feature (449)..(449): n is a, c, g, or t
  misc_feature (463)..(463): n is a, c, g, or t
  misc_feature (753)..(753): n is a, c, g, or t
gctttttttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggtttgacaaatgtgggggggttacacagaaagaggacacgtggctcaccggtctgcggaactatttgtggtagctcctgtgttacagaacaccagtgcactcagaggggtgtttaccccgtgggccttctcgcggttcacagagaagtgaagcgctcgtggtgttattggcctcacttctcccccaagtctaagcgtgtgtgtttactcccgaggagagaaaagtggcgactcctctgtggggtgagaanatctcggagaaaanattttctgtgtgggggtgtgacacaaaatttaacatctcgcgaagaggggggtctcgggatgtgaagaccccaggcgtgtgtttgtggcttgtgtgtctcagagataactctctcaaaggcccccagagaaaagagcatttgaaatctattaatctccctgtttggaaagcgggacacaatctcgacccactttgtgaacgactgtgtgggtttctccacaaaatttcttcaacgacggcgccttgtgtggactttccaagaggcaaaaacgcccccaaccaaaacacgngtctttaacaacacacccaacaggcggagattctctccagggggaacaacacttcttcgcgggagactgggggaaattcctaaataggtccctccctcgaacacaccacgggggacatctgtggtgctccaacgccaaggcggcttgagaattagaaaattacaagcggattccctcaaagagaatgcttctcaccccctggggggctcaacacagggaaacagggacaagttatttcggccatgtaaattgggacccttttttaaaaagagaacccctaaacccttggggctggggactcacttctccaacagctgcgccttcggccagtctaaaaaagagagaccccttatttttcggcgtctctgtgcggcgacaaaacaccaatcatcatcagctagcccaacagacaccaatcaaaagaacacagctcgccgagaggagacactctaattatagacgcgagggggcggccgcggcgagaaaaacaacgtggctcgcatctccaacacactgtccgcgccgacgggggggcagcacacaagcgtgatgtttggctgccggg

SEQ ID NO: 678460 - DNA, 659 bp, Homo sapiens
  misc_feature (25)..(25): n is a, c, g, or t
  misc_feature (108)..(108): n is a, c, g, or t
  misc_feature (150)..(150): n is a, c, g, or t
  misc_feature (157)..(157): n is a, c, g, or t
  misc_feature (191)..(192): n is a, c, g, or t
  misc_feature (199)..(199): n is a, c, g, or t
  misc_feature (209)..(209): n is a, c, g, or t
  misc_feature (236)..(236): n is a, c, g, or t
  misc_feature (238)..(238): n is a, c, g, or t
  misc_feature (253)..(253): n is a, c, g, or t
  misc_feature (272)..(273): n is a, c, g, or t
  misc_feature (291)..(291): n is a, c, g, or t
  misc_feature (301)..(304): n is a, c, g, or t
  misc_feature (308)..(308): n is a, c, g, or t
  misc_feature (310)..(311): n is a, c, g, or t
  misc_feature (318)..(319): n is a, c, g, or t
  misc_feature (324)..(324): n is a, c, g, or t
  misc_feature (326)..(326): n is a, c, g, or t
  misc_feature (330)..(331): n is a, c, g, or t
  misc_feature (339)..(339): n is a, c, g, or t
  misc_feature (342)..(342): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (383)..(383): n is a, c, g, or t
  misc_feature (394)..(394): n is a, c, g, or t
  misc_feature (397)..(398): n is a, c, g, or t
  misc_feature (401)..(401): n is a, c, g, or t
  misc_feature (404)..(404): n is a, c, g, or t
  misc_feature (411)..(411): n is a, c, g, or t
  misc_feature (419)..(420): n is a, c, g, or t
  misc_feature (422)..(422): n is a, c, g, or t
  misc_feature (426)..(426): n is a, c, g, or t
  misc_feature (429)..(429): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (475)..(475): n is a, c, g, or t
  misc_feature (636)..(636): n is a, c, g, or t
cccgcggcccccacgtacccaagtnaggaggctctcgcacagctccgcccgctccagcgacgctacgctgaacatcttccccgccgcggccaggcagcgcctaccgcntggccagacaccgccgccgctctgtcgggggatccgggggcncgcgcantgactcggcctcaggcccgcatgctcctcggatnnggccgcngactctcgcncagcgctggcagcggctccgcaccgtnanccccagcgcccctcnttctcctttcactcggganngcgcgcaacagcgccgancttcggaaannnncgcngnnccgcgtnnacgcncncggnngcacaaanagntaataaaaanagnagnagnaatggatggagcagaggaagangagacaatganaannctngcncccaggnagaaaagnncngcancgnagaagnagnagnagnagcagcagcagctgcagcagggcgcgcacangcaaacagttcgctgcgtgtcgaggcgagcacgcgctccgccctggaggctgcggcgacgggtcctcctccgccgtccggtcgcgccctcgcggaagctcggcagtgcgcgtgcgccgcacccgcactccaaattagaaaggggacgtctagtgggttgcncgggaggggtggcgggagcggtc

SEQ ID NO: 678461 - DNA, 804 bp, Homo sapiens
tcgcactctgttcttccgccgctccgtcgtcgcgtttctctgccggtcgcaatggaatgaagagatcgccgcgctggtcattgacaagtggactccggacatgtgcaacagtatggtattggctggggacgacgctccccgagccgtgtttccttccatcgtcgggcgccccagaacaccagtggcgtcatggtgggcatgggccagaatggactccgtacgatgggcgacgagggcccagagcaggcgtggcagtcctgaccctgaagctagcccagttgaggcatggtagtcggtcactcaacgtgggacgacattggagaagactcgtggcatccacaactgtcttacaagcgagctgcgccgtgggcccggaggagcacgcgcagttgtctgttgaacgtaggccctccctgaacccacagaggcgcaatcatgagagaatgatgactcagattgagtgttgtgaggaccattcaacagacccgggcctagtgtaacgtggccatccaggcctgtgctgtctcctcgtacgcctctgggcgccacccacgtggcattgtcatggactctggagactggtgtcacccacacggggcccatctacgagggctacgccctcccccaggccatcctgcgtctggacctggcgggccgggacctgaccgactacctcagttgaagatcctcactgatgtgagggtacagttcaaccaaccacgggcgatgcgggaaatcgtgcgcgacatcaaggagaagctgtgctacgtggcctgacttcgagctggcgatgggcacgcgatc

SEQ ID NO: 678462 - DNA, 344 bp, Homo sapiens
tgtttgggtgggggggggggggggcccacgggccgggaatccccggcccggggggtggtgggggggggaaaatgggcccgcccgcccccccccccccccccccttgggggggaaaccccccccggttttttttttttaaattttctttccgggggggggggcccttgggcccaaaagaaaccctgaaaaatttttgggttgggggttgggaagcccgggtcccccggtttggttcctggggggagggccccccggggtcccccccgaaaccccccctttttggggtttggggccctttttaaggggggcccggggggggccaataagggggggggggattccca

SEQ ID NO: 678463 - DNA, 122 bp, Homo sapiens
ctgagtgatctagaggatccctaaaagccggtggaattgtgatgatgatcacgcctcagaagggtaagatatcttaatgcatgtctcagtgctttgtgcaggtagctgaggaatctttcctg

SEQ ID NO: 678464 - DNA, 234 bp, Homo sapiens
gatacttccagcaggacacgtacggggcgactaccaggaaagcgctgctgtacctgtgtggtggagatgacgtgaagcccgacacggcgcggagcgtccagaaagggtgctcaccaggcttccagctaacaggtctagaaagaccagctggcgaataacagtccccggggccatcccggtgagggtgacgttagcattacccccaacctcattttagtggccgaagctggatca

SEQ ID NO: 678465 - DNA, 1299 bp, Homo sapiens
tttaggaacacacaaagtttgtgtcaccaccccaaaaaagtacactcacaggtctggtgtggttaaacacccgttgtccccgggggagaatttctccccccccggggggataaatttcgtgttgcggagaaacctccccaaggggctggtgtttatactccctcacagtggtagtctcactcagatgtccatgaaccccgtggtggggtgtgtggcgccccctattcagtggggtcggttcactctgggggaaaagcctggtttaaccacacagagcgtttttgtcgaccaaaagggggggcacaccccgcatcaaagcgtttttgaagctttcgcccttaagccacaaggagaaattggggtgtgttctgcttgcgacagacttttggggcccccccttggccccgtgtttctcctctctgggctgttgttttctcttggagaccccccccctttggtcgcggcgactcacgaactggtgtcaacaccccagggtgaatcgtattttatacccccccacagaagagttgtgaagcccacatattgttcgggggaatcttcgcccttttaggagaggtataccacaaaagggggcttgtcacacgcgctttatatatggcgctcgagagcgagacgaattgagccccgctcttctcgaacgcccgggtgtctccctttcgagacatatgatgtgttagagagacacacgatggcacccccacacatgtatagagagatgtctaccccacatttgcgtggttccgccaacagtgggcggtttgttccacacaaggcgtgttagatctcccctgttgttacaaatgggcccacggtctgtcacacaagtgctctcaaaagcgagacacgcgctttggagatacacacccgcattgacacacgaggagttttttgagaccgccctgttgtttcgagacaccgcacaaagcctggggccgccccacacgctgtcgcgggcgcctgggtgccttgagacctgttgtctgtaacgcaccgaagaacgcgccgagagagaattttcgagaggttctccctaatgttccgaataacacccacatccgcctgagaccccgctttggctcctttaagcgctggccccttgtccaccccctttccaccacccccttccacgccccgggtgtcccctttggcttttggcacgtgggccccactagcccagtttggtggttccctcatcatccccctacctgaaccccttttgcccctgccttttgaccttgtttgaaacctgaatcctaataaagaaataaaaactcccca

SEQ ID NO: 678466 - DNA, 2020 bp, Homo sapiens
ggcacgaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggccaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgaga

SEQ ID NO: 678467 - DNA, 181 bp, Homo sapiens
tagagaaagagggaaaaggggagacatccaactctcgcgtcagttatacacacataaacacacacagaaatagacgcttttaggctacacgtcagttgtcagcctactagctgcttcagtacattgctgaagtcctgacctctcatcgctctgcgcagaaactaatgaggctcggcagagg

SEQ ID NO: 678468 - DNA, 2431 bp, Homo sapiens
ggcacgaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggccaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgtgagttccgctgcctgtcctgcatccagccaggccacaggcaggggtgggatcacagcatctcaggtcctctagaggggaaatagggggaatgcctaggaaccctgtccttacccactgcctgggccatgaccagctgggcatcatctgtcctctctatggcagggaagctgagctgtgggagggtaaatattgatggcctaataacctgcaataggcgggtgggtgcgtgcttcctccctgccccagggcttctccctgaggctggtaggtgggcccctcgctttctgctcttttcctagtccctgtcacacagtaggcccagtgcaagtatttgaagggtgcaaagtgattaaggctctgcctggagaattaaggaccctgatccttgcgctctgcactgcaccccaggctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtcccgaga

SEQ ID NO: 678469 - DNA, 283 bp, Homo sapiens
aaatctaagatgacaaaactttattatacattaaaggtgatatagttgttaagaacatagtctttttgaatcaaaaacttttgaatgaataaaagctttgaaactatttgcgtttcagttttctataactcttcaggcgcaccaaaattaactagaggaaaaaacttcctttattctaatagatattacatcaaaaaacattgagtagtccattctgtgcctcagaacatgtgctctagttcagtaacacaaagaatgatactgtcttggtaagcttaagcaa

SEQ ID NO: 678470 - DNA, 478 bp, Homo sapiens
  misc_feature (198)..(198): n is a, c, g, or t
  misc_feature (218)..(218): n is a, c, g, or t
  misc_feature (223)..(223): n is a, c, g, or t
  misc_feature (227)..(227): n is a, c, g, or t
  misc_feature (231)..(231): n is a, c, g, or t
  misc_feature (233)..(236): n is a, c, g, or t
  misc_feature (240)..(240): n is a, c, g, or t
  misc_feature (268)..(268): n is a, c, g, or t
  misc_feature (272)..(272): n is a, c, g, or t
  misc_feature (283)..(283): n is a, c, g, or t
  misc_feature (289)..(289): n is a, c, g, or t
  misc_feature (308)..(308): n is a, c, g, or t
  misc_feature (310)..(310): n is a, c, g, or t
  misc_feature (317)..(317): n is a, c, g, or t
  misc_feature (325)..(325): n is a, c, g, or t
  misc_feature (328)..(328): n is a, c, g, or t
  misc_feature (344)..(344): n is a, c, g, or t
  misc_feature (353)..(353): n is a, c, g, or t
  misc_feature (378)..(378): n is a, c, g, or t
  misc_feature (391)..(392): n is a, c, g, or t
  misc_feature (395)..(397): n is a, c, g, or t
  misc_feature (403)..(403): n is a, c, g, or t
  misc_feature (410)..(410): n is a, c, g, or t
  misc_feature (412)..(412): n is a, c, g, or t
  misc_feature (428)..(428): n is a, c, g, or t
  misc_feature (437)..(437): n is a, c, g, or t
  misc_feature (476)..(476): n is a, c, g, or t
ttttttttttgtcagttcagttttattccaggcactgacatctgacgtctgcattatttcgaagcggctttcaaacttttttgccataactcacagtaaaaaaaaaatccattttatattcaactcaagtcataaattctttcattccttcaacatattgaacacctactatatgccaaatatattttatgtggaatncagtagtgaacggggtcaanggggngggnaggncnnnngganagaaaaagaaataaccaaaaattcttgncctntaaggctttanttactngtggaacagacaataggcnanataagtnagccagtngcngtggctcacacctggnatctggggngtttgggggggcaaggggggggggnggggggggggggnnggnnntttttnttttagngnagggggccttgggggnccaaagggntgggaccacaggcatgaggcaccgtgcccagcgcaaaangt

SEQ ID NO: 678471 - DNA, 423 bp, Homo sapiens
actctagatggatccccttcgactgtggatcgaggttggaaaaatttggagggctcagaagaagacaagaagatggttggacatggtggctcatgcctgcatcccagcaccttgggggccaaggtgtgagaactgcttgacgtcaggagttcaagaccagcctggccaacatggtgaaaccatgtctctactagaaattaaaaaaatatctggccatggaggtgcatgcctgtaatcccagctactcaggaggttgaggcataaaaattgcttgaacttgggaggcagaggttgcagtatgctgagatcatgccacttgaatcccgcctgggtgacagggcaagactccatctcaaaaaaaaaaaagttcttcgcgcaagaagcgcaaaaaattccccaggtgttgcgcctttggcaaattcc

SEQ ID NO: 678472 - DNA, 108 bp, Homo sapiens
tgtacggcgacgcccagctcaacgagcctgccggcccagtctgtccgtcattgaagctgccatacgccactcatggcggcagtctaccacgaaggggtaccgagtcat

SEQ ID NO: 678473 - DNA, 841 bp, Homo sapiens
atggtgcccgtgttgctgcggaaaggacgagccgggcgctgaagactatgctccaggaagcccaggtgttcgaggactgcttctacggttcttgtctgcggaatcagggaagagtgaaaagggtcagccacaagaattccaagaaggcaaagtccaccaaaaaagccaagccccaagtgccttgtggagccgtttgtgacaacaattaccttaaaggaacctgcagcatcattgactacagcacgtacaccctttctttagacctcaaactcggaattctcaaaaattcaggaatgccctcaagcccttcctcaggcgggggaggtcaccctcgacaactgaggcccctccgtctgtggaaagaatgaacctttccaccgtcttcactgcatcctgcaggtgcaaaaatttaaaattccacctccagggaggtcacgaaaaaaaaaaaaaaataagcacacacaaaaacattgttggggggcgcgcgtcggcggcccaggagaaatttttcaaaccccctctcgtgtggggcggccggcgccccaatatagtaatgaaccctggggcaaagaggggggcccaaagggaaatccgcgggcaacagataggggggggcttcccccccaacaaaaaaaaggcgcggggacaccgggggttctgggacccactcccaagggggtcgggggctccggggttcacaacggggcaagagctataatacgcgccgccgcaccagggaaaaccacgaacaccacacaccaagaacaaacgaagcgaccaacacacatcagcacaccagaccaagaacaaacacgacagaacaacacaagaagacagcaga

SEQ ID NO: 678474 - DNA, 397 bp, Homo sapiens
  misc_feature (20)..(20): n is a, c, g, or t
  misc_feature (39)..(39): n is a, c, g, or t
agcaaaatttcaggatacanaatcgatgtacaaaaatanatagcatttatttacaccaataacatccaagggaagggccaattcaagaatacattctcaattccataggcccaaaaaagaataaaatatctaagagtatagctaaccagggaggtgagagttctttacagtgataatcacaaaccactgcccaaagaagtcagagatgacacaaaacaacatgtttatggatagaagaatcaatatcgttaaaatggccatactatccaaagcaatttacagattcagtgctattcctgtcaaactaccaatgacatttttcatagaattggaaaaaactattctaaaattcatatggaaccaaaaaagagcccaaatagccaaagcaatcctaagc

SEQ ID NO: 678475 - DNA, 708 bp, Homo sapiens
gcgtgcaccgtgtgtgcgcgcggcgttgaaatgccctggacgtcggggcagcgggacagatcccaggttgcccaggagtctccaagtgcctcactcctcccgccgcaaacatgacagagaactccgacaaagttcccattgccctggtgggacctgatgacgtggaattctgcagccccccggcgtacgctacgctgactggtgaagccctccagccccgcgtcggttgctctaatggtgggagccgtggtcctcatttcgggagctgtgctgctgctcttatggggccagtcggggccttcgtacttctggaaggggagcgacagtcacatttacaatgtccattacaccatgagtatcaagtggtgacattacaacgatgggtcaatggagacatagacgctgggaacaacttgtgagagctttaataatgggaagtggagctgaagaagcaattgtcatgttaatgatttccagtaatggcatcacaggaattcgtttggctggaggagacgaagtgctatcattaagggcgcaagtgaaggctcgttattcctgaggtgggcgccggtgaccaaactagagcatctcctccaatactggaaggcgacgatcatgccagtcaccagtatgagagaacagttctcttatctggggtgggctgtagatcagcctgtgaaggacaacagcttcttgaggttctacggt

SEQ ID NO: 678476 - DNA, 139 bp, Homo sapiens
atgagctgcacacacaacgtcagtgagcgagcctcccatggaggcgcctccagggaagagaatcaggcgtggcccgagggcaccagctagcgatccccgaggagctcgcacatgacagaagcaccagttgtaacatgct

SEQ ID NO: 678477 - DNA, 857 bp, Homo sapiens
gaggacaatcatgtggctaaatcaacatgtcatcagctacagagttgctgtcctggatatgatagatagggtccctggatgcaatgggctgtccagcatgcctaccactctcaaacctttacgagaccctgtggagtcgttggatccaccagccactcagtctgtacagcggagccgcaccggagaaagctgatggcctgatgatggaggggcccggtaggtcttacattcatccttctcccctagtcaatcgaggcctgggcctccttgaccaagtctgaagtggctgtgactcacctgtgtacagtcaatgtcaacattggagcttgtctcaatagccctccggctatccatatggtaggcgcatgcgcgagtcctgactgatgagcttgaattagcgactggcattgaccctcagcttctatgtaccagaattccaacatccagatccaccactatcctaattgggatttgtaactgttgaatctgtgcccggctgctgatacatgccgatcaccatgcaagccaacggggttggtgcacctcgatcgataaggtcatctccagcatcagcaaacaaggatccagccgtatcattgggatcgaggacacccttttgagacccttcgggcttgctgtggctgcgtcagggctcaacacgaatgcttgatggttacggcccgtacaggcatttggcccgaccccatgaaggcgtccaaaacgatcccaatggagtagaaccgacctgggcccacaagacgctgacaaacctcggaagaaacaactgaacgcccatatgtaaccccggcggcctagaaccacagcgggacagcgggggccgcgagaccaatgagggc

SEQ ID NO: 678478 - DNA, 267 bp, Homo sapiens
agcgctggcaatactgtagtagttgtgggggcccaggacccaccctcgcttcttggcgtagtctgtcatcttttggggtgtgtggaagaagaggatccgggtggcctcagttgaaaagggattttctctgtaggccttctcagatgcacccagctgatctcatccctgagtagtgtcgagcagcgatgtcaatgaacgaaggtgtagctctcgcgcggggatgtaacccttggccaggaacactttgttgtagctgccctccatcag

SEQ ID NO: 678479 - DNA, 190 bp, Homo sapiens
  misc_feature (25)..(25): n is a, c, g, or t
tttttccccccccccctttccccgntggggtgggtttcccccagggggggcctcagttttttctccacgggggtggggggggccctttccctgccttgttcccccctggggggccgccccccccccccccttccgcccccttttcgggtttcctccccccccccgtgaatttaagctttcccccccgcca

SEQ ID NO: 678480 - DNA, 174 bp, Homo sapiens
cagctattccaaggggctgatgataggtccttaggtttcaggctggcctgagtcttggatggggataacacagccggtgtttgtagtgtctgtgcccttggcgaggggcattctagcctgcaggaaagcaacttatcttggaaggactagtaatttacggtgatcgtatgcttt

SEQ ID NO: 678481 - DNA, 176 bp, Homo sapiens
aggaaaaagggggggggggggggggggggggtgttttaaaaaagaaaaagaaaaacaaaaagtttttttttttcattctggttaggtagttgattaatcagttattcaatattttggggtccaaatacttttttccctacttttttttcagtagttaataaaatttttttttttcc

SEQ ID NO: 678482 - DNA, 154 bp, Homo sapiens
agatcatagacagcatgactactctacactggcaggtacaccgctgtccagcagggcaaccatggcagtgacagtgcttctggcggggaccatggccagaggcgccgctttgtggtggattgtcgcaccccgctgggcctcagcaggttcatgt

SEQ ID NO: 678483 - DNA, 608 bp, Homo sapiens
taaggttggagggggaatgctggaaattgtaaggggtttggaaacttttcatataagtaaggctagggtgagtggaggaattttttccatagggaggtgtatgagtgggtcgtagcggagaatcgggggtatgctggtccagaattcataaagaacagggaggttaagaagtagggtctgggtagacaaaatatgtggtgtaagagtctcagggagaagagtgcgtcatatgtgtgtcctagagaagatttggtatgtgggatgagaggtgtggtttcattgtataaatacatggttaggggtgtattcacgggctattagaacagaattagggggcgagaagggggccttagcgggggagtatatccgaattgtttagagacgcctgggaagaccataaggttacggagacgctccccactttcgggagcaaaggggcgcgacaacggggggagtatccagcggttgagggcaccccatggcacaaagtgtgggggagagaatcacacaccattataatatggggccccaaagggcgtcccattcgacggcggcaggcgacgtaaacaccaaagggggggtcaccagcggtgccgcgaagaactagg

SEQ ID NO: 678484 - DNA, 547 bp, Homo sapiens
acccctaaaggatcccctttatgcaaccgccggtcgtggtggcgggcgcctgtagtcccagctactcgggaggctgaggcatgagaatggcgtgaacccgggaggcggagcttgcagagagccgaaatcgcgccactgcactccagcctgggcgacagagcgagactccgtctcaaaaaagaaaaaaaaagaaaacaaaacacaaagaacgccaccagaggctggggctgctggctcacgcctgtaatcccagcacttcaggaagccaaggcgggaggatcgcttgggcctaggagttcgagaccagcctgggcaacatggcaagacccctccatctgtacaaaaaatactaaaactagctgggtgaggggacgcgcgcctgtagtcccagctattcaggaggctgaggtgggaggatcatcaagcccaggagtctgaggctgcaatgagccgtgattgcaccactggcactccagcctgggcgacagagggagaccctgtctctaaaaaaaaaacacagaaaaaaaaaccggactgaccggcgcat

SEQ ID NO: 678485 - DNA, 750 bp, Homo sapiens
tgcgctctcgtcgggagtccagccatgtcctgacgagagagagtgtagcctgatggcagctgaccgtgggaatgacgcctcttcgccgcctccgaaaaccgatggcagcgatgctgacccccagcatccctgctggcctccgacaggtggcctgcctgcctgcctgcctgctcttgcctgccactgctgctgctgcactagtgctcacctggcttttggatgtgctactgacaatggtgaagctgcatgatgcctggcctggcatgctgccccctgtgcccctggtggccctgtggcctatgcttgaccctgcgtggcggtcattgcagtgtggccttgctgtgtgctacaactttccgcaatgacctccaattgtgcttatgtgcatggggtgcattgtaactgacccgggttcattcccctgggccttccttgcccattggtcaacttcactgtgtggccaattggaagtgtgctgcctgtgtgattggtatagtagcagttctgccaagttgggtgactggactgtgggaatgattcacatggcccgaaacactggcaacactgggccaccgtcgactgaacccctgtgtgcttgaatatgtggttgtataggaaacacttgggtacaatggggaacttgttgggccaaagtggacacgactgtggtcgaacctatgttagccccccttctgcagttccccatggaacgccttttccctttggaattatcccctttggaaaggggcc

SEQ ID NO: 678486 - DNA, 1551 bp, Homo sapiens
  misc_feature (809)..(809): n is a, c, g, or t
  misc_feature (1052)..(1052): n is a, c, g, or t
aaagggtctatttcattatgggggggtagcgcattataacagttaaattaccttttaaattaatgtggtattagggtagacctggcagggacctggcagcatttgggtaacctaagataacccaactctaagaaacccagtctaaccaaaagaacctggtctaaataccttaacaataccaggcttctgggtggaagatctcatctccttgtgtgtgttgtggatctcatctcttctctgtgtgagggagaaacaaagcgcctgtgcgtgcgtggtctcaacaaggtggaaaatatatatattataaggcgcacaaatctcttctctgtgatatatctcacatatctccacaagaggtgttatctcttatcacagagcgtagtgagatatataagcgcctctcacaaatctctcccatggggtcgagagcgcccacaaacccctgtgtgtgtggggcctctacgcaagacatgtataagtgtgcctctatctcgcacgatcttctattaccgccgagagagcaccgagagaagagaggtgtgttctaagacgctctcttctctcaaaaaccgcgcagtgcgccctctcgcagagagctgctcgtggagagctatatcttagcgcactatcatctctccaccacatatcatagacgcctctcagagaagtgctgtgcggagatgcaacctctattctgctgcgcgacagacaacacgaatgctgcgacaccacgcgcgagggcggcgaggaacatctccgccaaacagccggtggagaatcataactactataacgcgctgtggtgccangatgctgcgccaccaacacaacagccgaagatgtgtgggccacgagctgtggggacaccacctgccgtgaagacggttgtttctacccacaagaatgcaccaacgaggggtgcttctcaacagcgggttgaacaacaagggttgttgttgcttccacacaagacgcaatgctccctcttcttcctccacacgaaaacaaaacgcctattctacatgcacggtgggagcaatcctcaaacaaancactgttctgtgggatgaagacatcccccctgcttccccaccacaacatagataattatatcgcctgtgaggtgcttgcccccgccagactgatatccgaactgctcgttgggcacaccccaataattcactaacggccgtcggcggtagtcactaacccgcctgctctggcgtaaaacaacgctacctccccccccaccgacagattcccccaccgttgggtgattaaacgtcccccgccaaaaactgttgtggctccacaaagccaacgtgcatcacgacattcactccaccccccgctgtatagatcacacaaccaagccactctatcttacgagcacaaccacctgctgagcggcccccaccgctgcgtccccacaaacgagcgcgagtcaccaaaccacacgtgggagtactaaagaccgcactcgacacgcaacaacgctaccctcgcccgccacccgccccccgtcgtcgcaaataataaacagcagccact

SEQ ID NO: 678487 - DNA, 1312 bp, Homo sapiens
actgagaagaactgggccaacagtatgaacgccatcctacggtgagtgtggccacggtcgcttccaggtggacactggtatattgtgcttggtctggcgctgatggctgacggatgtggaggctctgttggtggtggggcttcggtgctgcccagcggctgagaacagacatgtgccgtgtccgacatccaaacaaaggcatgctaggacctcgagtcgtactaccgtgggacatgatggtgggagccattacctctggggaggtctggctgaccgggctgggtcggaggcagtgtctgctcatactcgcgtctcagctcaacgagcgtctgtacgccctatcttactacatacttaatcgtaccaggggttgacgggacactatggacctacttactggccagccatactatgcgtggcggttaggcgatatgtgatggcgtacctaatcccacgaattggatcgtatcataccgtgatatatcatcgcgcagatatctcttagggccacaagagaggaaaaccgatgggcgcgagccagtatactgcgagcctgtgcatctggcaagtgttaatatgggtactggcatatagggcttgcaggccggtatgttaacagcctagatcgttgcctaaactggtagacgcctagtggatccccaattacacagtacgcccccgcaagcttaactatgggattagagcaagatatatacacaaaggcactgcaggctagactaggcacataaagccctagattgtacacctatataaagacctacgggacacgcgggtaacttagcaggttacacataccgttacactatggcgtgcccttatgaacaccatgtcctagggttggattatgtggccaccaactatggtggagaggacttacttaggaactcaacctgtaccaaggaccctctggaagggacaggcaccaccccaccgggcttgagaccatgtgacccacgtaagtgacccggcaaacgtggcgagcaacacacgcacacaattggcaccttgacagacggcccccccatgcggggacgttggacagatatgagcccatgggaacaaaggaccacacagggaggaatcaccaaaatcggacaacatacacccgcaacttaccaacgatgagccgagaaagtgtctcacacacaaaggtgggtcaacaagagtatcaccgatgaggcaacacaccacgatacggctgtggagtatcacccactccacacggatataaagacagcccatgatgccaacattcgacgatgagcaacgcgagacttcactacattcacag

SEQ ID NO: 678488 - DNA, 175 bp, Homo sapiens
ctctacaggatcccccggcgcgccacaggttctcccatatagttttcttgagatacagccattcctgttttgtttacgattgtctgtgccggctctcatgcaacatacgcggatattgtgtctgtgtctgaagctactcactctctagcccttcacagagaaagtgtgccaccct

SEQ ID NO: 678489 - DNA, 297 bp, Homo sapiens
gagtgcagtggcatgatctgctcactgcaacctctgccacccaagttcaagctatcctcccacctctgccttccgagtagctgagactacatgcctgcaccaccatgcccagctaatttttatttttattttttaaatagagaaggggtttcgctgtattggccaggctggtcttgaactcctgacctcaagtgatctgcctatgtcggcctcccaaagtgctgggattacaggcatgagtcaccacgccctgccttagggttcagttctgtcacttactagttgtgcatagttgtg

SEQ ID NO: 678490 - DNA, 870 bp, Homo sapiens
ctgggcgtatgatcggcccagacggtgctatcctcgtgggatcacacgggggataggtccgtgggcgcgcttgctctctgtgggtgatggcgctccgcttggtcacgctggcccacggacttcgagtgggggggcccgctggttctgcgcgggatcttcggcttactttgggcaagtggggaataattttatgggcaccggcctttacatttctggtatatggcggtccgccccgccttggggtagacgcccgagtgcgtcagggcggtaaaccgtggggcggcgtccggaggtcaaccgggtcgaggaggcccccctgggctagcgcggtggtgcagatggcccacgctccccgaattgccccttgggcataattgccccaaagggttaacttcttttaattccccgagagtcaactgttctccgcaaatttcccccgcatggctatatttttgacaatatctcccgtttcgaccccgtagcaagccccccccgctgggaccgggcacgaaataaagtagggcaattctttaaaattagtgcaatctctggatgcggcgcccaaaactaaataaatcttccaagtctcccagaaagcaacccctggacgctggtctaccaataacccgagtcccctttagagaccaatcttccccctgcaaggtgctcgcatcagtgccccctgtatgttggcggcatctcaccccccaatgggtataaatcggtccagacacgacatggggcgacatagatcagatccagaacgacaggattcgtatgcttccgaccccggcgtacttcttaacagcccgccaaaacgtcttttctcaaacaaaatttttcttcaaaaaaatcttaaatcacacaaac

SEQ ID NO: 678491 - DNA, 388 bp, Homo sapiens
  misc_feature (378)..(378): n is a, c, g, or t
gttcagtctttaataatgtgagaataaacagaataaattaaaagcacaccatattcttctcagcttcctcaggggctttgtccaaacagcttgaacaactgcaaaataatattcaggaaccatgatagtgtttggtacatagaggacactggaaatggttttcttaactgaacaagtgactagaataaaggaattaatgaacgacatcagagctgaaatcccaaaccataaatcataaaaggatcagacagcaaagagtactcgctgatttattgagatcctgatgagtttgaagtaactagaaacttgatcaaacagtgacaagacccaagatttgttttactctaaagtgagaaatttcctccctagatatttttntttttctttt

SEQ ID NO: 678492 - DNA, 327 bp, Homo sapiens
gacatgatatgccttggggatttcccaaatggagaggaaccattcccactgtctagtacccataaaagacactcacctttccgtacatagacgtcaaatttcaaaggctgttcttcctaggcaatcaggaacatggttggggttggcagaagtgggcccaaatggggagagacgaaaatccacctctggccaaaatggtcaggtagctgcttagagggcttttgaaactctcccagctcatggcagctgagtcacaatcaatgcattcacagtcaggaaaccaaaatttgttaccaaaacaccagaagtttggtctcattgctcact

SEQ ID NO: 678493 - DNA, 220 bp, Homo sapiens
ccctagcgataaaaagtaccaaaatcattccagaagaaatagataccagcctgagcaacatggcaaaatcccatctctacaaaacatcaaaaaaaaaaaatttattcgggcttgggggtgcacacctgtattcccagcttgccgggaggcctgaaatggggggatcacctgcagcccaggacggtcaaggtatgcatcgagccatctgtctccccactgc

SEQ ID NO: 678494 - DNA, 172 bp, Homo sapiens
ctgactcagtgatttatgtcttccttgggctgctaggcctccttgccttggcgggtactttgaaccagatacctccctcttctagtcttccaggcccgatttcccgccaaccactcttctgttttcgggtctctctagtttggtcttatcaagaggtgtatggacagggaat

SEQ ID NO: 678495 - DNA, 736 bp, Homo sapiens
ccatctcctagtcggccctcctgttactcggccgagggcatctttgcattgttcctcatccgcctccttgctcgccgtcggccgcctccgccgcgcgcctcctccgccgccgcggcacgtgggcagctttatcgccagagtccctgaactctcgctttctttttaatcccctgcatcggatcaccggcgtgccccaccatgtcagacgcagccgtagacaccagctccgaaatcaccaccaaggacttaaaggagaagaacggaagttgtggaacgaggcagaacaactggcaagagacgcccctgctaacgggaatgctaatgaggaaacatggcggagcaggaggctgacaactgaggtagacgaacgaacgaggcacagaacggtggggacggacagaggagcgacggacaggaaacaaacggctgactgcgctgacgcgacacagcgcatgcgacgcacttcacacgcatgagcgcaacgcctgagctcagcctaccgggcacagcggcgcagccttgacacgatgactgcaggatggacgactgctcggatacccaagaagcaggaagaccgacgaggatggactagcacagcaaaaaaggaacaagttaaaacctaaacaacacacaaacagaggccgccgtgacctatttcaccctccatttcccatctcagaattctaaacgtggtcaccttcgagtaaagaggcccgcccgcccaccggggccagtg

SEQ ID NO: 678496 - DNA, 746 bp, Homo sapiens
cctttttttttttctgttatatttatcaattttattggaaatattccaaggatcccaaccccatttaaaaataaaaatggtaaagcactccattcaataaaagcacataagtccccctcaataattagtatgacaattcacgatacagctcttactcggggagcagtttattgtaccctttattccaaaaggcacaaagtcatctgaggcctcagatattaaccccacggcatgttaatgacacaccactgaggtgcaggctcaagtgtaatatattaaagcttataacagcacgttccccaagaatttatagatctcttgtctataagataataattctaaaaaatactggcaccttaagaccaatacaggcttacacaaagggacctgaaattgtctcgcaagggcagtttggttcctggatagaagtacacactttgggaaagtctattcccagcaaaagaaacactagacccagctgggccaaagaacacaaaatacaacaggtgatttctaacacgctaaaagagtcacttttccatcagttccaaagaaaagcagctccgggtcattcagaaggctcctatgatcccaccagtctgcagtcattagaaatatatgcttaacaggcacaggctgcgccggatgggtccagacacagtgaccagaagaggccagtttgcgtgcaaggggtgtgagccccgatgctggggctgtcaccgggggtgaatggaccccgccgggta

SEQ ID NO: 678497 - DNA, 458 bp, Homo sapiens
ctgtctttgtcaggggatgagtgcaaggggctattgatcagcccttagctggcatcactccctcttaaacttttcactggatactcttttgaactattttttcccccaccatatacatgtattttttaaacgttaatgtgctaatttctactaaagcaatgtggatttttctgaaagctttaatgttttaataagctttttattgaaatgttaatgtacatacagaagagtgcccgaatcataagtgtgcatctagatgaactgtagcacaccaggctgccacgccctggaccaagcagtagccttgacctgtggcctctcccaggcactgctgccccaacccacaaaatagctactttcccagttcctgatgtagatttgttctgcctggttttgacttctataaaatacagcacattctatttagcctgggcaacagagcgagactgcgtatcaaa

SEQ ID NO: 678498 - DNA, 1222 bp, Homo sapiens
gctggcggcataattcacctggtgcaacgcttacaacgcgcaccaaggggacacaaaggtggcgtacaccttcgactgctgggtccgcaaagccgtatcttcacccctggagcgagcacctgtggcctgaggtattgtgtgcctgatgtgtggtcaccggagtgttcccctcgatggctttcgaagtggatagaccagcagtgatcttgtaacggcgggtgcagggctgacggccaggcccgctcgtactcatgcatgaaccgtatcacgtgcgtgcagctgggctactggacggccagaccaccaccggctgggggggttcgaaactactagtctactttgtacacatcaagggtgggggccatgtgtaccgtcattcagtccctgcgagtgagcgccgctgtcagtcgccaaccgtcgctggggttctcgtgagctggcgctgtgcgagaagccaagcgtgcctgagcggtgtcgctcgagtcagtggaacgcggcattgcgctgcgtttgtgaagaaccggggtcggcactccgcactggacgcataggggatgcgagaatgctaggctcgggggactcgagccgaggacaatcgcgtggggaagaccttgtcgatgggaggtcggtggtagagtttgtatcgcagccctctcgaggccacaaccatttagtgaggttcaggaccttaaggcgttggcttggcggttggccccgttggcaaggcgggggcagactccacattgacagggactccggtcgccaatgggtgctcaagagctgtcatggacgtcgtcgccctcggaaggggacgctggcatggtcaagacgttcgcgccgctccattgcggtggggaacccttcgttggccatgaatggccacggagaacggtattgcggggaatagagcgttaacggcgcgccggggtcattggggttggagcactcgaggaatgaagaccgcataagggatcgacaaagagccccgcggccggttcagaagggggtcggtgaatgctggcaggaaccaaagggcctgggtaggcgggaatgggaagccacattccaatttgccgtcctgtccacggagagaaaggaaagcttcggcgatgggacgggaacgagatgccttctcaggtcacggaagcgagggaaaccgacggcgggcacaagcggggcgccaagggtggatgtccttgggtcagagagcacagaggcacat

SEQ ID NO: 678499 - DNA, 401 bp, Homo sapiens
  misc_feature (25)..(25): n is a, c, g, or t
  misc_feature (57)..(57): n is a, c, g, or t
  misc_feature (100)..(100): n is a, c, g, or t
  misc_feature (131)..(131): n is a, c, g, or t
gaatgactcgctctagattggggtngaatggaaacaattgggtacttccgtgtcggnagttctcctttgaactagcgtgcgcctagattggaagagtggncacataataaggggggacagactaattgggnttaaatatattattatgattatgtaatgttttatataaatgtgataccagatcttggatagtgaagttgattttaagaaaattatacttgggaggtcttataacaaacataaaagacttaaataagagagcatagctcattttgtgattatcgtagtcaaagatttatttaaagagaacctctgcagtacaaagatgaatttagcttccaatataaaatgtgtaatgtctatattaatcatttcaaatcatagttttccctcctgaaccc

SEQ ID NO: 678500 - DNA, 387 bp, Homo sapiens
ctcatcttacaaaggccagccagggagagcccaggcggagaagctgggatctgccttcccttaggctcactggtcttagggaagtgacgaacgtctgttctccttggggcagtcagtcaggggcagtcttcggctgttagggcccagaccttgttgacaagctccgaagtccttgtaagcccaagcacaatttatagttcaaagattggctttcaaaggcccccactgactctgtcttgcctctccagaagggatgggggaatttgggagcctctcattgcctcccactttctgtgtgcctgggcctgttggaacaagcctagaatgtaccacaggacatttcccagatctttccggctgatgagaaaacaggaaaggaaaaggaga

SEQ ID NO: 678501 - DNA, 190 bp, Homo sapiens
  misc_feature (139)..(139): n is a, c, g, or t
atatggcgaggcagctcttcactcaagagcaagaacccaggctccaggacagaggataaactggcttcattccaggcctcgctctggaaaaaggggtgacgggtagcctaggcctatgaggaaccagtcctgtcatcanatctttggcaaggcaaagctgttctttttccaactttattccagaatgttc

SEQ ID NO: 678502 - DNA, 942 bp, Homo sapiens
  misc_feature (236)..(236): n is a, c, g, or t
  misc_feature (253)..(253): n is a, c, g, or t
  misc_feature (294)..(295): n is a, c, g, or t
  misc_feature (375)..(375): n is a, c, g, or t
tcacattccttattctgagacttgggccccggctgtttgtgtatgactcccatgaactccagagccaggggttgtgccttatgtcccatctgtgggactcattctgccatagagctggagcaagggtaacctatctaagctccctaacttgggccagaaaccaccagctgagcttttaactttctcccattctatgacacaaatgaatagagggtacggaggagggtgcacataanccttaccctacctctgncaaaaagtgggggctgtactggggactgctcggatgatctnncttagtgctacttctttcagctgtccctgtagcgacaggtctaagatctgactgcctcctcctttctctggcctcttccnccttccctcttctcttcagctaggctagctggttatggagtagaatggcaactaattctaatttttattgtagttcaaatattaggggtccttggttcttaaagccagaattacggctagcaccgtagtcattctcaagctagagggaccactttgtaggaccaacaatgtactgttacatgggttcccccttcgaaaattaacagacttcttaccaacgatcattaagataaaagcatggcaactaagtgtcagactattaggaactggagaagggggatcaactaaataagcgaagagagtcgtttcttcatgccaaaaaacaaacaaagaaccatactggcgggaacaactcgaaagtagaccttctggaggggccccagatgttgacgcgtacccgagcgtagtaggccgccaagagggctcccctatagagggagcccgcaagtgagagagcagggggacgggaccgacgttccaacacaccgtccgggtaaccgggggaaaaacgggcgacgctgggcaatccctgggcgaaggtgcaacctcaactccgtggggtggcca

SEQ ID NO: 678503 - DNA, 120 bp, Homo sapiens
tgtgatggcagtgcatggaggagctggtgagcctcatcacacagtgatcctgcccctgtgacatggagacagaagtgtcctgctatcaaatatccgaaacacatgccttgtgatgcttct

SEQ ID NO: 678504 - DNA, 251 bp, Homo sapiens
ttttaagtaagtaaactaactattggcatattaaaaaaattgtgcgtacaaataaataaaatcatttgaacaaaaaaaaaaatggcagtctgattaaaatgcatgacagccagcaggacaccatgggagagcgtctctctctctctctctctctctctctctctctctctctctctctctctctctctctctctctctctctctctctctctctctctctctctctctctctctctctctctctctctctc

SEQ ID NO: 678505 - DNA, 1309 bp, Homo sapiens
ttttttttaaggtgggtttacattatttaatttttaattacagattacattacacattgtgctagaaactcaaagccaaaaactattaagtgggcaggtactacagaaactaaaggtgaaacaaaacaaaacaagcaaacaatgtgaaaaacaatagctataaacttctcagagggccacaaagaataagaatttagagggcaatcaccgtggtgtgaagaagaggaaagagggagttttaaagtctccataaagaagagtatttcataagtgcaaaatcttaagtgccgaggttttttgagtaaaaaaaaaaaagagggggcgccgcggccgcgcggaatcctaagaaacctctagagattcctaagaaacccggcgaagagggcagcggatcacaaagaaaaattaaacccctcgcggaggggggccccagagtctaaagcgcgcgtatcacacccgagactatattatcgtgtgggtccccaaagagggggggggctcccccataaaatagggagagaagaggcgcgaaaatatatataaaaggagaaaagaggcaacagacggggcgcgccggcgccgagatttataacaccaccagggccagcgggcaaccaccgggggggacacaaacacgtggtgcaataaacctctgtggggagcaacactccttatgggagagaaaagggagaacacccttaaagcttatccggtgagagggcgggtgtgaccactatatcttttgtgcggaaccacaaactatttacactataaaaaggaagaactttaaaaaagggcctcaataaaaggcgctacacaattatgtacaaacaaattttctaaaacagggtcgtgtactaaacagtgggtggtttataacagtcataaaatgtgggaatataataggtcatgtactagtcttgagaaaaacgagttatgggggctaaaagggggagagataattgaagatctagatcgaaaaacaattatttgttatataccccagaggagcacaactgccggggaggacaaaaaacagacgacggcagaacacaccaccacaacaaaccaaaggaagacaagaccaaagagcaaccacaacagaagccaaaacgaaaatgaacagaaacaaaccaaacaaaaagacccaaaccaacagaatgaacaccccaacaaacgcgaggcaacgaatacaaagaatagacgagagagagaagaagcacaacaaaaaacacacgcgaagaacagaacaaaacaaaaacaaaaacgacacaaacaccaaaacagacaacaagcaaaaacaacacat

SEQ ID NO: 678506 - DNA, 551 bp, Homo sapiens
  misc_feature (337)..(337): n is a, c, g, or t
  misc_feature (395)..(395): n is a, c, g, or t
  misc_feature (411)..(411): n is a, c, g, or t
aaggtagcctggtgacctttagccccctggatggacacgcaggatgaccctcaggccataatcatcgtgggacatccttacggggcacaagaagaggggttttcatctgtgagagctcagtgccatggcctattttgtaagtggagccagtgatggcgaagttctttgccagaactgaccctggagtacgcctgtaggcatcatagtgagaagctccgttcgtaatggtgtctgttgggtacaaggaagaagtttgatagagtctcgtgggataagaaggacttgtgtcgttgggtcctccgtgggtggataaacagtagagtcgccgttcgtgggntgcgctgagagacgaaagtagtattccacgcgcagggttacagccctgacatgcaggnctcctctaaccacggncataggacgagttccgacggtgtaggtaagccatgtttgcaaatgctggatggaatctgtgcaaggcgtccgagttggtcacgaacgaagcgggaggaactagcattggtgatgatggaaaggtagtactgaggaacgtc

SEQ ID NO: 678507 - DNA, 968 bp, Homo sapiens
caggagccgcggggggtgcggcgtgggactgcgggtctgggctcctagaacatagggagccggctgccgtggctcctttctcctccaggaagagtcattcttgggattgtgctgtagaggcaggaggaaggcggaaggtagggagggagggctggtccccctctgagggggctctagtgcctgagcctgacctgtcctcattcgacagctgaaactgttaagcgctggcccaggtccccgcagcccagccaggcgtgtactgtctgggctcccctcacagggaaatgtgtgacggaaacatttgtggcagccaagtggactaagatctatggcccatgaaaccaaggtgagagagtgcaagaagcctgctgtctgcctctgccagcagggagtcctaagcgcagaatccagaggctcgtagctgtcctcaggtgtagctactgtttcagaactgttgctgcctgccgtacgttggtcatgtcgggccagccgagctccgtgggtgagagtgtgcgtgtgcgcgtgtctgtgtgtaatgtgcgtccggtgtgtgcatgtctgtgtgtgtgcccgtctgtgcgtctgtgtgcgcgtctgtgcctgtgtgttgtccgggcgtgtgtgcgtttgggtgtgggtctgtgcgcgtgtgtgtggcgcgtctgggtgtattgtgtgcacgcggggtctgaggtgggcacgtcgtggtctatgcagcggttgggtttggggcgcgcggggtctggtgtgtgacgcgcgggcagttaccacgggcaatagggttggggaagagggctaaggcaggttaaagttgtggagggatggacaaaggggggaactggcatcggatataggaccagcgattgcacgcaggtgacgaacggattgaaacagtgattagtacaaaaatgtgtatgcaatgggggtaccctggagaaaacgacgtacaaagagaacacgcagtgtaa

SEQ ID NO: 678508 - DNA, 191 bp, Homo sapiens
aatcaaacatttgaaagagcatgaaagacagaacatttctcaatgatcgaattgaatttaacacatattattgagtcccttgctggtctttactcttggacacctcccctcccccacctgcctcctcttttaaacacctgctctttctttgggtcttggctcaggtgtcacctcctgtgttaagcctcgtg

SEQ ID NO: 678509 - DNA, 926 bp, Homo sapiens
gacacagtgtggaggcgtgtaacaacaaccggggcatgtgttcacccaaaaaaatgggtcgcacagaaggatgtgcgtatacattcgcccccgccccatacgctgtgcagccgcctatgtcgtccaccccccgcacagggaggggcacacaggcgcaagaaaaacagacagggggaaaacaacgcgcaccacaaaaggggattaagacccccggcgggcacaaacccacggggtggcaatgcggtctgtgcctcttgccggaattactgtcacacacacgccaccggcgcagtaagacgctgttcacagggtaggcccccctccgattgcgcgctacctcttcgaggagccaaaacacgggggagaacagcaacttcaggcacagacccccctgcgggaaaaaacatgtggcacacggaagccggccccccacggagaagcagtgcgcgcccccaagaatcgcgccaacaccagcgccgcgtcgggggcacccacattataagaataacggagcgtcttgttacccaccccgcacgaggtgatacacccgagcaatttctcgaacatgcggcaggagaacaaaatatgcgcccacaggcgtgaagcactctcgcggctccgcaaccgagcggttataaatttcttcctcgacctctaataggaggacgtaatcactaccttactgcgtaccctgtaaataacctagaacgacctccgcatatctatatgtaggccgacaaaaaaaacaattagacaagaacttgtcttttatataaatacaaaacgactaccgccgcctattcacaccaaaataggttctcccacctaacctgtaggccaccacgaggtaaatctacgcgtcccactaattccaccctcacaatgattcacctttacacccaaacaaatgggctccacaacaaaac

SEQ ID NO: 678510 - DNA, 368 bp, Homo sapiens
  misc_feature (2)..(2): n is a, c, g, or t
gncttctgcagcgcatcgagcagctgtccagtcgggtggtgcgcgtgttgggctgcaacccgggtcccatgaccctgcaaggcaccaacacgtacctggtggggaccggcagcaggagaatcctcattgacactggtgagccatcagttccagaatatatcagctgtttaaagcaagccttggttgagtttgacacagcaatccaggaaatcctggtgacacactggcattctgatcattctggaggcattgtagacatttgtaaaaacatcaataatgacaccacctactgcattaaaaaacttcgaccggaatcccccagaggagaaagaaattattagggaaattggagaaccagccattttatt

SEQ ID NO: 678511 - DNA, 115 bp, Homo sapiens
taagatggagtcatcgtactatcgcccaggctgagtgcagtggtgtgatcttggctcaatgcaacctccacctccaggagtgcagtggtgtgatcttggccattcaacgcctccg

SEQ ID NO: 678512 - DNA, 124 bp, Homo sapiens
ttcgagatgctaagtgtcttatagttcaatcaaggagatgatttttacctagaatctgagcatcgtaattctacttgttaagaatgatattagtttatatgtaaacataatgtcaatagcaaag

SEQ ID NO: 678513 - DNA, 113 bp, Homo sapiens
gttcacatcaggaggagcgatatcgagtgtggagaggaacccggacgcaccatttcacataagaggcagcagatggagtgctgaggaggaacccggacgccacatttcacatg

SEQ ID NO: 678514 - DNA, 156 bp, Homo sapiens
cgaccccctccccaaccccagggactcagctggagttggaggctgggataggagctctgggtgaagggcagcatctactccacacccttcatagagctccaggagactactacatgtcagtgcggccgtcgttgttcttgtctccgtccttactag

SEQ ID NO: 678515 - DNA, 138 bp, Homo sapiens
aaagaaccaaaaaaggcacctatattccaaggacctccgaattggcatcttcagctctgacttcaatccagacttataaataccttcaccattacaatcttcctaggagcaacatatgaggcactctccccggaactc

SEQ ID NO: 678516 - DNA, 991 bp, Homo sapiens
  misc_feature (386)..(386): n is a, c, g, or t
gcagcaggacatcaagttcttgccgttcaaggtggttgacaacgaaaactaaaccatacattcaacgttgatattaggagcgtgtggcaaacaaagacactttagctcctgcaagcaaatttctgccatggttctcactaaaatgacaacgacaaccgctgagcgcttatttgcggcaaagaaggttacccatgccagttgttactgtaccagcctattcttatctgatgctccaacgccaagtcaatcaacagacgctggaactatcgctggcctaaatgttatgcacggatcatcacatcgagtcctacgcgccagcctgcctactctgcttcactggccctggactcactaggcgacggggcgacacgcacacactccctggnctgtttcgacctgtggactgcgccggaacctctttcagactgtgctcttctatcctccaacccaatatgaccacacttggctgctcgttccccatagctacatcgggcccacctaaattgcgcagacataccttcaacttctgcggctgcggacacaggacctttctgaacacaagtcgctgagttcccatcgcatacccagctttctcactctctcacatctcgtctaatcacactcacagcatgataagaacgaagtccacatcacggaattgtttccacggcgacctccgactcgactatccatgccttgatgcccatctacacagtctcgcgctcttcgcgcacgggtaggataactcggggcccgagactcaggtcggacccctccggtgtcctgtacctcaccgcccacatcccaacgcccacacgcgaccacatgtaactcatctgggagtctacctttcctccacatgaacgcgcccgcaacacgaacacctctaccctgaaacaaacccccattctaacttccgtcggcgccatatgcattcgtctgaaagggaagcgctctagccacatcgcggacgtcaccggcgtctccccgc

SEQ ID NO: 678517 - DNA, 210 bp, Homo sapiens
ggctcggtaccgcatcttcgtcccatcagaaacgacatcatcaaaaagtacaaatagaaatgctgagagggcgtggagaaaagagaaccctcctacactgttggtgggtgatagagccacaatagcaaacagtatggcagttcctcaaaaaaactaaaactggagttgccagatgatctagctgtcccacctctgatgggagcaagatgg

SEQ ID NO: 678518 - DNA, 108 bp, Homo sapiens
tcgacggaagcacagtcatattgcttcgcctgcagagattaacgtttgtttcatacctacaaatacaacatctattcttcagaccgatggatcaagaacgtagttctg

SEQ ID NO: 678519 - DNA, 340 bp, Homo sapiens
atccatggcagacagaaagcagatatatggttgtaagaagcttatagaacggagtggggagagatagctaaaaaggagtatccttctagggtgatgaatatgttctggaactacttattggggatgattgcactacatggtgaatgtactcaatgtcactaatggtcacatttcacatacacttttaccataatttttataaagctttattagctacattatgttatgatacttatatgtcataacaatagcattctgtacgcttcactaggataacacacacttcggatttatatgcttcttggaagagatatttttcactgttatttgcctgaattaa

SEQ ID NO: 678520 - DNA, 294 bp, Homo sapiens
aaggatcttaaggtcgtataacatgagggtgttgtagtgtgaatgagggtctatgttgttactgtggtgggtgagtgagcccactgtgttgtggtaaatatgtagaggggagtataggggctgtgactagtactgttgaggtccctgtaaagtaggaagagtgatactttgatcagggaggaacgtggttaactagcaccagaagagtactccccagatagggttaatacgaagggggggtaaagtgcgaggtttagcgagggcttgcttagacagtcactcacaaaacgctat

SEQ ID NO: 678521 - DNA, 328 bp, Homo sapiens
  misc_feature (26)..(26): n is a, c, g, or t
  misc_feature (238)..(238): n is a, c, g, or t
  misc_feature (293)..(293): n is a, c, g, or t
  misc_feature (297)..(297): n is a, c, g, or t
  misc_feature (314)..(314): n is a, c, g, or t
aaccaaaaggaccctggtgtccttgnccgcatgattaagaaactgggcacccacagtgatggtcaggtagatttttcaaaatttctttatttgattggtggcccagctatggcttgccctgactccttcctcaagggtgtcccttcccagaaacggacctgaggaccccttggccctggcctttaaaacccccccctttccttccagcctttttgttattatttccccagcccccccntcccctgagccccctaaccccctcatgcaggccccccctgccaatagtaataaancaangtccctttttttaaacntgaaaaaaaaaaaa

SEQ ID NO: 678522 - DNA, 2434 bp, Homo sapiens
gtgaaccctggaggcagagcttgcagtgagccgagatcgcaccactgcactctagcctgggagacagcgagactccgtctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttctctgcatcacctttggatttctacacccagtgtttcattcattcagccttcaacagatacttttaacacattctgtgtgccaggactctgtgataaacaaaacagccatggaggaaagtaaatacctgacccagtattaggagagattagaaaggcctccaagtctgagagatggataggaattagctcagcaaggagagatgaggaaggttatggctgaggaactggcatctatgaaagccagattcagctttcccttcagagcctggctttggcatctatgaaagccaggctctgaagggaaagttgaatcttgctagagtggagaattgaggaagagatgagatgttaaggcaagccgagtctatgaggtttgggccactgtatggttgtaaagaaccctggatctgggattaggagtcctgagttctagatatgtttctgctaccaatatgttagtcatcattctagtaacacttcacatcttttaggtgtgccatgatgggcactggggtacaaaaatgtgtaagatgtatgtagtcccctccctcagagatctgtcagtttaatgaggcaagcaggctaattaagaacccctgtagtaaaggaacagttacctctgctgtaagaagtcagaattgagctgtgtgttactttaagcactttctctgggctttgatgatctcacctgtcaaatggtaaataaccactgtcctatgtagctggtaaactgatgagaagacagacaactttgtaatgattggcgtttgtttggcattttgtggatttcaaaacacttttgacatcattaattcattgaaccttaactgcaatcttatgacttaggaaatttccccacaatgtacagatgaggaaactgagagaggttgaggcttgttcatagtttcacagcttttgattaacaaaagttaggattataaatccaaatcccgtgctcttattttgaaaagtataaagatggcaacctttctttctatcccctacttagtggcaaattatccccttccccttttcacagtcaccagaaatgcagagaatgtctgctgtgtttgaaaagcagatctaagctgactggggagaaagaaaggagcttatttcaggtcttcttcaggctggactctaaacttttaagatcatgtgcgcccgtgctcccatcagctcctgctgttccatctcatgccatttacagagtgccatttactgagccactacttcattggctactcatagcaacttgtggggtagacaaagtgcactttacagatgggcaaactgaggtccagagtccctgaattgtacatgtcagaaccaggattgaatctagaagtcttgggctcctgacaccaaacaggtgctcttaacttgcagaatgtaggttcctttgattcagttcggttcaaacaattcttgaatataacccatgtgccagagactttgctatgcaagagagcctctagttaggctcaaaccgtcttggtctagtgccttacttaagaacagggacttgtattatttacttctctgtccccaggcaggaccttgatccaaaaatgctttgctgttgtttttggccttaatctgccagaaactagagggagcagatggccacagcaatgtgggttatgaggatgtgatatcaggcagggttgaaggatgaattgagagccctgcacccaactacttctgtgtctgtgcctaggcccttgtcagggtagtctctatctgagagtgtagctggtcagcctggtcccatttctcatttccagtcacctccccctcttgccatcccatataatggggttagtctcctggacagatctcatacagaggctgctgggatctgctgtccaaatgaccctttggacctatttcccagccatgttccaagatgatggtgaggagtctagccccacagccagtatgctatctctattcagataactcccagctcacaggcctcccaccaggctctcacccactctgatgttttcactcctgactcctaagaagcagattggcaatttagtgtgagtctgtcagacagcctagagagtaatcaatactgagagaaatggacatatttcctgtttattcaaaatcctgatgaaaattttaaggagcactatttgggaagggatgactgggaaccttgcaagaacaaacagcttaaaattcatgaacagaaatagcaacgtttattcatgatgtttcaaattc

SEQ ID NO: 678523 - DNA, 885 bp, Homo sapiens
gtgacacgataggctgtgctgcttgccctgttgatggcaggcttgtgccctgcagccaggtactgccctgctgtgctactcctgcaaagcccaggtgagcaacgaggactgcctgcaggtggagaactgcacccagctgggggagcagtgctggaccgcgcgcatccgtgagtggggggacgacgagccgccaggcctaggtctctgcctactgaagctagttatactctttctggcctagtctgtcgcgcagtctgtgtgctgttttccgttccacctgtccccgacccgtcccgtcacctgcaccgcccaagcaattcatcccagcattctgtccctccagtccatcctcctccatctgtccactcgctccacttcattctgttgcccttgccccattccttccattcttataccactatccgtcgcagcgcccatactggtccgcgtcgcccatcccgtgaggcgtcaacttacgtccactcacccgcattgtctgaacgctcgagacgggatggtcccatcgtgcctcaggagatctgcgagtagggctgagaccgagggccgtagaacctaggcccctcgcactggcttgcgaatcctgtagggccgaggcccaggggtgacatctaagaagcacttagggcacgggtggcgacaggagagacggcctggtggccagtgtcagggcacggtgtagcacaacaagggcgagaccccagtccccggatccccgatgttccccaaggcgcagcttggccctcctgaagcggtcatcaggcaaaggctgcagtttggaactgcgtggatgacttcacaggaactactacgtgggcacaacgaaatcgagtgctgtaacccggagtgtgcactgcaggggggcca

SEQ ID NO: 678524 - DNA, 279 bp, Homo sapiens
acacgcagtgcacgctgcatacctgcaagctgactcttagagtattccccctctcgtgcaccatttcatttcacggtttcgacgggcaggccagtctaatgaaactgacactccagcacagttggtagatggacgacgaggatcaccatcgacgctgtaccagcatcactactgcaggtgtgtcgcccatcagcctggcagggttcagtatctatagcgcccgtccccagctccgggctgtccatcctcgcattgcttctataatggatagctgaacaa

SEQ ID NO: 678525 - DNA, 750 bp, Homo sapiens
  misc_feature (22)..(22): n is a, c, g, or t
  misc_feature (93)..(93): n is a, c, g, or t
  misc_feature (95)..(95): n is a, c, g, or t
  misc_feature (127)..(127): n is a, c, g, or t
  misc_feature (162)..(162): n is a, c, g, or t
  misc_feature (183)..(183): n is a, c, g, or t
  misc_feature (192)..(193): n is a, c, g, or t
  misc_feature (212)..(212): n is a, c, g, or t
  misc_feature (216)..(216): n is a, c, g, or t
  misc_feature (289)..(289): n is a, c, g, or t
  misc_feature (293)..(293): n is a, c, g, or t
  misc_feature (296)..(296): n is a, c, g, or t
  misc_feature (302)..(302): n is a, c, g, or t
  misc_feature (306)..(306): n is a, c, g, or t
  misc_feature (329)..(329): n is a, c, g, or t
  misc_feature (331)..(331): n is a, c, g, or t
  misc_feature (342)..(342): n is a, c, g, or t
  misc_feature (365)..(365): n is a, c, g, or t
agcggctttctgcccacactangacgactggcgcttgccagcgtgttggagagaccgctaccggtgaaccagcgcgggtttttcggacttggngngtcgtgcagatctgctggatctaggtccaggnagtctcagtgatggtctgagcctggccgcgccagngctggggtgtcccagaaggangccaggaanncgaaatgcattcatggaancaanccagccctggccttcaagttccgccatggagtcatagttgcagctgactccagggctacagcgggtgcttacnttgnctnccagangggngaagaaggtgatagagatcaacncnataccgtgctnggcaccagggctgggggcgcagnggattgcagcttctggggaacggctgtgtgggctcggcaactgtcgacatctcagtgcagcttgcgtagagataaaggagacgcagtctctgtagctagcgtgcctccaagctgcttgccaacatggtgtatcagtacacaaggcaatggggcatgtcgcatgggcaccgatgatctgtggctgggataagagaggccctggcctctactacgtggacagtgaagggaaccggatgtcaggggccacctatctctgtaggttctggctctgtgtatgcctatggggtcatggatcggggctattcctatgacctggaagtggagcaggcctatgaacgggccgtcgagccatttaacaaggcactacagagatgctatcagaagg

SEQ ID NO: 678526 - DNA, 141 bp, Homo sapiens
aaaaaaaaagttttctgggccgggggtggtgggtcccccctgtaatcccacccccctgggaggctcaggtgggaggatcattttaggccaggagttttaaacccgcctgggccccataattgaagttcctttccagggaga

SEQ ID NO: 678527 - DNA, 1221 bp, Homo sapiens
  misc_feature (743)..(743): n is a, c, g, or t
  misc_feature (1015)..(1015): n is a, c, g, or t
  misc_feature (1031)..(1031): n is a, c, g, or t
  misc_feature (1090)..(1090): n is a, c, g, or t
  misc_feature (1134)..(1134): n is a, c, g, or t
cacagatgctataaaatgagggacactatatagtatcgctgtgtggtgttactaccagcgcaggataatcttgggctcccggacttccatcttggagtctcgttgactgtgagacgacatacctcgtataggcatgacttggagaaaatcacgtatcatggacctgacatacgtactgcgcatgctcgtgcggtggctcctatcagtactcagcgtaggtcatctatgtacacattatggcttttattggtaacgcctcaaaatatttgcgaaactacgaccgcgtgcttgacatatgatagctatctgtgcattgaagtggacgtgttgcatagaacatctctcacctctgtggatatttcgcagctgggagaataaagaacccgtgaacttgtatacctttcactacccacgggaggtgcccttggaggatcctggcctctctgtagtttccgaccgacattcttgatccagtcagtactgactctcttgtaaattgtgctaaaaggcaggatgtgtctggcatcaagattgagcccggtctccagcattttggtgtgcgtttgaaaaaagagcttaagtacgccaagtccgaaaaccttgtctgagcgattccagcgttagcacccaaacaaggggcccgtgtgaggaggaaaatgcgcattttctttcactggttagttttgcgcctcttgagagacccaaacaatgcgagttgtgttaagcgtctaacatcgtagttnacacggatacgttgcgccttgtgtcccctcttatacgtgaacctcttatttgtctgtggaaggtgaggcgtacaagtttccacccaacatctagcacccaagataggaatttttttggcttcacgttcccttaacgaaacaggtctggtggtttccttaattaaccaatctcttctttgagacgcccctttggttttgggccttgagactaaaaacccagtggcgcactccccacagcccacaagccttagagagagaggacgaaccgaganacaccactccctgtgngaggacagtaacgagattcctcatttggcggttgggggacaaaaacgactctccttctnatcagggttcacactataaaatccgcccctatggggaccacacnaattcctcctctttgggtggcggccacagcgcggcgcctctgaggagagcactctttctgtgtgaaaagagcaccaaactctgtcgg

SEQ ID NO: 678528 - DNA, 188 bp, Homo sapiens
ttccccgggggtttttaaaccccccccccccccccccccccctaaaactctttttgcccgggactttaaggtccttaacctccggccctaattttttttgggggagccttttaaaatttttttggggggcccagcctggttttttttgggccataaaaattcccggttttaaaggcctttttttttta

SEQ ID NO: 678529 - DNA, 209 bp, Homo sapiens
atcgcggcgtgtgagatggagattaccagtgcgggggaacgattttccacgtgggggaaagatcagcggcaacttgctttaaaaatataaatgggtgagtagcataattcaaaatcgagaaaaaaatcatcatatacatacatgttgaaatggaactttacaatattattttgggaaacctccagaaggtctgacaaagacctaatggt

SEQ ID NO: 678530 - DNA, 427 bp, Homo sapiens
gcggcggcgatatgctgcgattccagaagctggcatcgcggcggcgtgcagcgtgcggcggctacacctgggcttggactgttgccttgtaacaagatgaactctagaattctagcaacctaactgctgcattctcaatattaaactgctgcatgaaccaaggtgaggagtattacctggtgttgctatccataagacaagtccttacctgtgcccaaggttattacgtctcatcgtagcagtggcccgtgcactatgtcgatactttaacactagttttatgactagtaggcggccatcacgatatggatgccttctaaacaattgctgtgttgtaaaataaatcaggactggtagacaagtgattaatctggaacaattggaaccttggatgagaccttttcgttgaattctgaagagtaatgat

SEQ ID NO: 678531 - DNA, 1584 bp, Homo sapiens
acttcctgctccccccagcagcactggcactcgctgctgctgaacccctctgcagcccctctgccccacctgtcccgccgcgcggctccaccaacccagccctcagcacggcacccttctgcacggcctcacgctggcacctgcggcgctctgcacgcgcacctgcccccacgcgcgcctgcacgcgcacgcgcacacgcacgcgcacgcgcacgcgcacacgcacgcgcacgcgcacacgcacgcgcactgcacctctctgccaccctgcaccctctgcccctactccgttccctgcgcacgcgcacccactgcgcgcacccacacccccccgcgccgcgcacgcgcacgcgccctgacgcccacgccccctgcgcgcgccccccctgcgctcccgcacgcacgctatcacctctgcccctgcccaactgcgcaacgccccccgcacgccccccagccccccccacgccccgcaccgcggccccccgcccacgccacacagcacgcatgaggcccctgcggcacccaacatccaccatgcgccgcgcacacccgccgcgcccatgcccttcagcaccgcgcaccacgcaacacgccacccgccccatgcgccatccccccacgcgcgccccaccgcccaccaacgcgcatctcccgcaacgccccccgcccgcccccgcggccctccacacgggcggccccccacgcgggacaggcggccttaccacccccccgcgtaacccacctaccctagacccacggcaacccggccttccgcccatgggcgcacaccgcacaccatgcgcgccaacgccacccggcgcgtcatggcccaccccgcaacgcgcacgcgccccgcgccagccccctagggcctaggcttctccaaccccttccctatgccgcgcgttgaaacccctcggcctgcacccgcttcccaaccatcccccacgctagcgcccccccgtcaaggcaacatcctaccaagccactgccttccccccaccccctcccacctcgcgcaagccgctacgagcgcggcgcacgcaaccggcggcccaccatgcgcatccaccccggccctgggaccctccccaacacagcctcaccctggcccttccccgcggcgcccccccccaagcggcccccagcccagcccaacgccccccacttaccattccccccccccgccccaccgcccgggcccccctggctggcccctgggacagggctagaaccccccagccacacgcaccgggcgctggctgcggcaccaggggcgccctcggccccctgcgccccgcactggccctcaccgggggggcccaaggcaagccaccccgtgatggccccccgtggccccccaaccccccgcgaaacgccccggcgacccattcgcccgcgacacaaccggcccccacccattaacccacagaccgcggcacccggcccccattcgccgccccagtcgcccgcgaccaacacacctctcctacccgcaacccctcgccgccccaccccacgggcgcgcctaactaaccccctaccccacgccgccccccacaacacctgccgaccccatta

SEQ ID NO: 678532 - DNA, 492 bp, Homo sapiens
gaccgggtcatcgatgccagcatatcccacttataagtgagatatggtatttggtttacctttcctgtattaattcacttaagataatggcttccagctgcattcattttgcttcaaaggacatgaattcattctttttttatggctgcatagtattctatggtgaatatgttccacattttctttatccagtctaccattgatgggcgtctaggttgattccaccatgtcttttctattgtgaatactactgtgataaacatacgagtgcattgtccttttggtggaacaatgcattttcctttgggattgctgggttgaatgatagttctaagttctttgagaaatctccaaactgctttccacagtggctgaactaatttacattctcaccaacagtgtataagcattcccttttctccgcaacatctgttattttttgactttttagtaatagctattccgactgatggaaggtggcatcgataaaca

SEQ ID NO: 678533 - DNA, 935 bp, Homo sapiens
gccggtagaaatcagtggacttggcggcagaggcagtgcggatccggcgtctccactgatcttttcccaaggctgtacagacatggcggcggtttcggaaggcggctaagtcccggcagcgggaacacagagagccgaagccaggcttgtttttcgaaaaccatctgggcctgcttgccgcaaccaccgccctgattcacaaacttcgtgcagtatgactacccgtaaaaaacaagaatacctcaaagctcttgcgcacgagggctctttgaaaacaactccaagatgatttctactaacacaaatgactcggtgttaacacctcccaggcactggcggtcccttcttcatcaggcggacgactacggaagaaagttaaccccaagaaacaaataagggctgatgagaaacctcaggaagtcaacatatatacgaccttgaacgagggttgccagcaaggcttaagaacactgcgaagggactaaatatcagagctccattctggcgtgattccaggggcaagccaaccagaacaagcatgtgtcttttttgtgaccacccaaacaaggggcaagttgcccagtttggatgtacgcaactcccttggaaaacgagcccggagctagtccgacagagtcttacatagggccaggatagagacctgcgaagagaacagtgacggggttcccaatcagatggcataaagcgagtagttaaagaaggcaacggggttaactgcttacaccaggggttgcagaggaagaatggtgttattgtcagaaatcaacggcaggttttgggtaacccgaagtagggggaaagaaggggacccgtataaataaggggagaggtggtgtataaaggtgttgttcaatgggtgtgggaaacaaccagggggggggcacaagcgcaggtgttgattccaaaaaagctgg

SEQ ID NO: 678534 - DNA, 166 bp, Homo sapiens
ccatggtcacttgcgtgttcccactgcacttttcatgctgcattacttattagctccacccagaagccctggccttagccactgccagtctcgcgcggccctgtggcagtcccgagttgagtgcagctgggtttgcttcataccatgggcttgatttcttggactc

SEQ ID NO: 678535 - DNA, 242 bp, Homo sapiens
  misc_feature (198)..(198): n is a, c, g, or t
  misc_feature (207)..(207): n is a, c, g, or t
  misc_feature (210)..(210): n is a, c, g, or t
gtttccaccgcctcccggggtcgtgctgtcgcccggccggcgcgccccggtctcctccgacatccccatcccggtccgcatttgtgcccctgccagccttctcatccctgcgccccagattttctctctcttatcccccaaacacacctgcccttgtccccgaggccgtccaggcattgccctgggatccaggcccgnggggcagantgnctgctctggggaggtgaaacaagtgtgggcct

SEQ ID NO: 678536 - DNA, 149 bp, Homo sapiens
tcagctcggtccggcacgagcgcacaagtgcacttcccaggacatttaacaaaccccgtacgcatttatatagaggagacaagtcgtaacatggtaagtgtactgggaagtgcacttggggcgctcgtgccacttggggcgctcgtgcc

SEQ ID NO: 678537 - DNA, 415 bp, Homo sapiens
ctgctccgcccctctctgggagcactgatttattgtgaacagtccagggcagggctggtacctcattcgcgtgtgttcagagggccgaagacactgcacacactatgacatgattagattgaatttaaatcctgccacccaccaaggagacctggggatatttaatgtttgagggccacactaaacgatcactgcagagaaccacctcttttctttactgtagattaagtatgataagcgtgctctgctattacttattggaaaaaccactgagaaaagctaatcttcatgctttaatgtgatttgacatgcaaacgggaagttttgccaggggctaataaaggttgtgaattccaaattgctagccgaatatggctttgctggtaagcccactggacagagaggggcggagcag

SEQ ID NO: 678538 - DNA, 582 bp, Homo sapiens
caacctgctgaaggaggcagccagcttgctggaggcgggcgaggagcggcctgggggagcaaagccaggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggcctgaggagccgtggggctgaggaagccctgggaaggccggcggcggggcccacggctgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcattgaaggagctgctg

SEQ ID NO: 678539 - DNA, 98 bp, Homo sapiens
cccttttgggggcccccggaaaaaatttggaaataggaaaaggtggggtttttttcccccccttatattccgggggggttgtaaaaaataaatttttg

SEQ ID NO: 678540 - DNA, 473 bp, Homo sapiens
ctttaccacctattgccctatactatctatctatacttcctataccctacctactatacctacagctcctggaataaagactattgcaactgtctcgacagcctctctctcatccctctttctactagcctcgcccaaccttgaattgcatcctttccctggtcggaatatcagctaccccacccctcgtgccgtcaccctcaatcccatgtattaagtattccctaccccttctctacctgatacaagtgcagcagtacagaaccaggcatttccggtactacagggtccctgaatattacatgaccaactactgcagcaccgtggggcctagccagccctcggcaaaagagggaaggcatttcttctctttggaaactgtagcacgggctgtgaccaggatgtttaaacacacacacacgcgcacaaacgacacatgctacatgtggtcaggcagaacagggaggcagcag

SEQ ID NO: 678541 - DNA, 1187 bp, Homo sapiens
atttctgggggctgccccaaagggcagacaggttaatggggcagcagtcggggaaaatcaggggtgggactgggccacacgctccaggtcggtccttcttctgtaagtggcaataggagtttcgaggagcccttggcagcattgatgagcgtcatctgccaggcactcagcaagtggctctataagtgtcccggaaggcagccctcacaagcgccgtggtgcacagcagccagagtggccgtggttcacacggggcaggggggacacattccaaggaccgtggtcgtctcacagtcccggggcgcccaagtgcggtggtggagtcctccgggggaccacgtgtggatgagtggggttacaccaggaccgtgcagaagggattcctcgccgtggtgaaccagggtgttagtgactctcgaaaggcagtgctgtgaacgaagtgcgcacagctcagtgaaggcttcttgtgccgatggattgcggccggtgcatacatcagggagattagtagagggcgcctccacaatggggacaattgagcttggcgggaagcgttgggcgggaataccggcccttgtacttggtgaggcaggatactgtgggaataactttctccttcactgggaaggtgaaatccgtgcagggacaaatggtcatggatcctggcgacatccatcggggcaccaatgtcccaaagagctgaagtgacgggggtctctggccaccggtgggtgctggctgtctcccaatgcggggaacctggagaaacaagccgagcggatcactggatacacgggggggttatacccagcagcccgccttgtggcgggggcgcagaggtaataagacgtgcggcctaaagaattaacactgccctatagccactttcttaccacaggggagactaaaccctttatatcccatataatgtttattcgagaacccttgaggcttactaatcaccatatcccgggggagacagaagggtaaattgggggccccctcatcaggccataagtgagagcgcccgtgaataaacagaagctcgcgcagttacttccaattgtaggatcagcaaaaagaggggacaacacgtacctagtgactcagcacaaaaaagaggggcgagcgaccattatgtatgttgtgcagccagatgctatcttattatattgttatcagtgttc

SEQ ID NO: 678542 - DNA, 141 bp, Homo sapiens
gaatggagattgtgagcatgttggaaaaaaacgcaacacttctcaaattcggctaccactttacccagcaaggaccccgccctgccgggccccacatgttctttgcataatggaggtaatgcaggaaaatgcttagagcag

SEQ ID NO: 678543 - DNA, 131 bp, Homo sapiens
tgtaccctaaatggtcgatctagacggatccccaagtgggtaacatcacttccgggcagttacctggacatccacacgggaagtaatattctaattatctcagcaaagcactacacaattcgcccttttgc

SEQ ID NO: 678544 - DNA, 106 bp, Homo sapiens
tggtctcctccactcatgatccacacacgcatctgtctaccatccatccatcggtccagctctggcctcacctgaccctctcaagccacatgccctctcaagctat

SEQ ID NO: 678545 - DNA, 401 bp, Homo sapiens
aaatgtttaattcgagtagtcccgtgcctttgcagaattctcatgcctctttttttatatgcatatattaaaaggaaagccataggcctgagccgaggagaggatgaattcaagtttccttacctgcgtatctactttcaaacatgcgccctccctgttacaggtggtcagttgtgcctttatgtactaacgggcacatgcgagattgttctgctttttttccttgtgtctcagttttagtcattttccattttttgccaagtttctttcatccagtgtggtagaaaaggcacaattccaatgtatcatttagaattgaatgtcattaacctggctttgttctttgaaaaaaacaaattctttaaaaagattaaaaggataaaaaaaaaattcaaacaata

SEQ ID NO: 678546 - DNA, 377 bp, Homo sapiens
gtttttttttgtggtttccctgcgccccccccccgggggttcattttttttgggcaaagttttttttgggcccgggccccctttttcatttttttggcccccccccccctgggggggcagggggggggggaacccccggccctgggtttttttttgtttcccttctggggcccccagggggggcgccaaagggggggggggttcccccccccccccccctggggagaacgggggttttttttttttccccccccccttttccccccccccccgggggggggcccttttgggggggggcggggggcccccgttgggccccccctgggaggtgaggaccccccccccaattttttttttattttattttggggttccca

SEQ ID NO: 678547 - DNA, 442 bp, Homo sapiens
aataattaattaaagaaagacaagttctgtatagcgactatctaagcagacagccagccactcagaaagtttataccattaagagcagctgaagaatggcttgaacttccacttcctcacaaggaaagaaacaatttcctttctatatcctgtttcttaacaccataaggtcataagctgacagctgattcaccactaggcccatataaggttataaatagccagcaagcataacagcctaggacaccttggcccatagtaagtcatagtagttagttatacctgtcatagatatactgcttgtctgttctgatcctcttcacatccaccttgtccctgtaggcttgtttcaagtagccaccctctaaaggagtaaaagtaatcgtttgtcctggcagtttgatgttaatccctggttagtgcctcaataatctcttttctc

SEQ ID NO: 678548 - DNA, 391 bp, Homo sapiens
taaatataaaatctgaggctgttggggctttgacttaaattcccatcaggcctctctccagcaggtaatcccttctctcctttccagcgtgggctcccctgttggggaggtgtgaacctcaaggcgccttagccccaaacaccactttttctgctttccttaactcctttctccagctcccccctttttttaataaacgttggcagttgtgatgttctctgttctcggcataaccgttaatctctcattttcactgtgatagcctataaaacctcgcagctcccgagcgttgtggcattattttgtccaatatgtgacgcagggcccgaccctgtgagaagccgcagaggccagccagccgccggggcgcgcctcctctcccttgtgcccc

SEQ ID NO: 678549 - DNA, 326 bp, Homo sapiens
  misc_feature (85)..(85): n is a, c, g, or t
cccccctcccttgggggggttggggggggcccccccccccccggaggggggggtgggggccccccaaatttttaccccccccccnttttttgggtattttttttaaaaaacgcggggaaacccccggggggtttttcctgggggggggaggggccccccccctggggtcccttttccttttcccggggggggggggggggccccccccccccgggggtttttttttttttggggggcccccccgggggggggggggggccccttccccccccacccccccggtttttttttttttgccccccaaaaccgggggtttttttttttta

SEQ ID NO: 678550 - DNA, 206 bp, Homo sapiens
taggttacgcaaggcacccgactgacatccggcctgtttttttttgaatgacaaaaactaccccccatatcatttatataccaaatctctccctcaataaaagaaagccttctcctcattttatcaatattatccataatagggggctgtgggggtggataaaacaaccccctgctccacaaatttttattgttgtttgaaaccac

SEQ ID NO: 678551 - DNA, 1137 bp, Homo sapiens
cgctcgggagccctgcccatggcgaattgtggatgattgcggtgtgagccttcactatggagtgtcatcgtgtggcggagtcttccagtgccatcaaggtgtttccagcaatgcccctgttggaattctggcacctggttgagaggtagtgccaatgactgtgaggatccgagccccccagattggagtgtagcttcgcagtgtggggtgggcctgaatctccaccatcgactgtggcctggtgcggcttcggggcaatggagtgatccctggaactctatcaccagtggagcattgaccggtggctgtgctggctgcccgacagatggcccactggccatggtggagctcagcaatgatggggggcatcctgtatggccctcattgagggcgttggcatcctcctcacatcgctaacacagacacagacagttccgaaatgcgccaccattcctggaggaccccagccagactgacccctaaggatggaaccccggccccaggctaacccagctatcagcagtacccactgaggaagacaatgacaccatgcggagctacataaacaggtaccctcacacgatggtactacctacgaagggcagggctggatacccagtaagacctgggaccatccagagagggtactactcagagctccctaagttccaaagggtggagagtgtaggaccaccagtgccctgacaacagtggggccccaaaaaccaccacaagggacaccgagcccaagaaacaaaatgtagaaggtataacaccagacagctagtgaggacccgacataagataacaggccggtcggactgccaagacaggagacaagagggggcgcggacagagcaccgaacgagggccaagagaaggaagccacgcaacgtggaccagcgggccacaaagagcgcacaaaaaaccggggcagggacagggcaaccagcccccacggacaccccgacagacagacgggcagagacccgggggcggcagaggacagacacaaaagaaagaggagagacacgagcagcatgacgaccgacgcacgcgtggagaagcaaccaccggcgaagcgacagcgaagcgagacgacacacacgaagcaactgacacaaacgcagcgaagga

SEQ ID NO: 678552 - DNA, 1272 bp, Homo sapiens
acagtcgagccacatcgctcagacaccatggggaaggtgaaggtactggagtcaacgtgattatgtgtcgtataagggctgcctggtcaccagtggctgactttataactctgtgtacatgtggatataagtatgccatcaatgacccctatcatttgaactcaacatacatggtttaaatgtaaccaactatgattccatccatgtgcaaattaccatggcaacctgtcaatggctgatgaactgggacagcttgtcatacacatggaaatcccatcaccatcttccagtgagcgcagatccctccaaaatcaagtggcggcgatgctggctgctgcacgtaccgtcgcaggcagtccactgcgcgcacattacaaaccaacccatggcatgaaggctaggggaccacaatatgcaacggcgcgggacgccacaaagcggtacatcatactactgcccccaacagcctgaatgccccacaaagtacgaaattcgggtgagaaacccacgaacgcaacggcattcgaacaccacagacacacaacgaacaacacagccaactcgcctccctgccacacaccccacacatgaccactaacaacccaccatagggaaacacagggacatcacccatgcacaacactacatgcaactcagacggaccgagacactccatcgaacccagaaattgcccctgcattgcccccacccagaccgaccccagcccacgaacaaatagctcgtcacatgtggcaccacatccgtggaacacattgtgtgcaggatacagtgcactgcctgtggtaccctactcgctaccatcaatcaagtcatccaactaggaccgatgcaaattgaatatctaccaagatcccaccctgaaccgaacagaacaagacgacggtaaaggcctccgcggtccccacaggcacacacgaaaaaacgagcccttacacgaccacagacaaaccgtcgaaaaatgaaacccacacagccgcacaaactccaccgaccccaagtccactcggcacccaacacaatgaaaaacaaaaacagaacaaacaacctaccctcgcacgtaccgaccgcacaacaagaccacacaaaggaaacaaacacaaccacgcaacacaagccaagggagcagacctacgaaaggaccacaggggaaaacgaaacagaaagaggagaaaaccaaaagactgattaagaacagaagaagcaaccagcaccagaacgaaggcccgcagaacaacccacgacacggacgaa

SEQ ID NO: 678553 - DNA, 192 bp, Homo sapiens
tctagaggatcccgccaattgatttgtggtgtatatatggtaattgagatgtcgggggaataggtatatgtgattaggagtagggttaggatgagtatgggggataggtgtatgaacatgagggtgtgtctcgtgtgaatgagggtttgtatgttgttaatgtggtgggtgagtgagccctattgtgttgtg

SEQ ID NO: 678554 - DNA, 281 bp, Homo sapiens
  misc_feature (23)..(23): n is a, c, g, or t
  misc_feature (85)..(85): n is a, c, g, or t
  misc_feature (142)..(142): n is a, c, g, or t
  misc_feature (242)..(242): n is a, c, g, or t
cctcgtcatgggtgaagctcctnatggtcctgaccctacagttcctgtcccatgaccagggccagttcaccaaggagctgcagcngttcgtcgtcagtggcagccccatgcgagcacccgaggaagtcacaggtgcccaggncggagtgcagtggcgtgatctcggctcgttacaaccaccacctcctagcagcctgccttggccttccaaagtgctgagattgcagcctctgcccagccgncaccccgtctgggaagtgaggagcgtctctgcctggccg

SEQ ID NO: 678555 - DNA, 1661 bp, Homo sapiens
ttctctttgttggttcctttgctgttgtcttctcttctctttcgttgttttctgctttctggctgtttttttgtcgctctcggtttcttctcgttctcgctctctgtcgtcgcttgtcttctcgtcgtttgtgctctcctctctctgtcttttgtgtttggtcgcgcgattttttttctcgtcgtcttcctcctgtggcgtttgctcctctcctgcgtgcttttggtctctgccctctttgtttcctgacctggctcgtacttgtcgccctctctcgtgatgtctctgctctggtctctcgtcttgttggctgcgtgttcgtgtgtgttgtgcctgcctctctcgtttcttcgcttctcgtctctgtcttgcgtgtgtgtttatctcgttttctttcttctttgtgcctttttctgttctcatccttctgttgcgtctgtcgtgtcttgtgttctggctgcggttttctctccttgctttctctttcttgttttctcctgtcgctcttctccttgcgcgtgttgctctcgtctcgttttctctgagcagcatgatgttgttgttgttgcttgtgtcgttttctcgttgctcgtcctgctcgccggcttgttttgcttctgttccttgtttcttgttcgtctcctctcttccctactctttcatcttcttatactctctgtacttctctttacactgcttgtctattctcctacttttctcgtactcgcttccttactaattaaactccatagatgtcttccctgtttttatgcttgatatcctccgttccaagagtccgccctcctgtgattgatctgcctcaatttcccatctgctcattgctttattggaacccctctccaacttatgtattagtatcatctctggtgatccctgatgtcccaagcccttcctctgtgatcatcatacggcctcctatgtgttctcgtcgtggtgaatctgggattaatccaagttttctatcatccacgtgattgttccatgtcctacttgaccccatcttagtggccttaagttttacggttgtagccatctttatacgttacaaatgtcttgttactattcttttagcagtgtcttggttactctggtctcctcgctatttcaccccgcggaataatgtgctcggaacctcactagcagtccggcccacggcccgttcccggcactcatagggactttagcttcgagtacctggtccgtcaacctgcctccggcctccgtggcgagccatctagcccactgcgtctccggtccgcccgtcgccgtccccatcccatgtcgcccatttgcccatggagcagactcaggaccgggcgacgagatgggagcgcccgctctcaggttcagggcccagatcgtgtgacagatagtgtagtccggtggacagagaccagtggccttgatctagatggaggtcgctggatacgtggtcgctctgctgtcacctactgtgtgttaccatgccattctcgccctgaccagcccagcaccacatgggaatcatgcgtgaagactgatcgcagcgttgcccgagagcggtgagtttgggtcgtgggtggggccgggccccccctacgggatgcccacggccgttcatcatcttgtccctcgtccccctacaatcatctccccgctcc

SEQ ID NO: 678556 - DNA, 104 bp, Homo sapiens
ctccagcttggcccccaagcatacaggttatggtgtgtctgagatgggttcagtttggacaaaaggaatcgagcctgactgcctccatgctccgtgtggatgta

SEQ ID NO: 678557 - DNA, 104 bp, Homo sapiens
gagcgagactccatctcaaacaaaaagcagaacaaaaacaaacattaatgttggcacagaaaagggccccccgtttaaacaaagggcgggcgtgggtaccgagc

SEQ ID NO: 678558 - DNA, 366 bp, Homo sapiens
  misc_feature (109)..(109): n is a, c, g, or t
  misc_feature (117)..(117): n is a, c, g, or t
  misc_feature (121)..(121): n is a, c, g, or t
  misc_feature (133)..(133): n is a, c, g, or t
  misc_feature (167)..(167): n is a, c, g, or t
  misc_feature (317)..(317): n is a, c, g, or t
  misc_feature (322)..(322): n is a, c, g, or t
atagagccgggtgagagagcgagcgcccgtcgggggctgtcgagggcgggttgcctcgcgctgacccttcccgccctccttctcgtcacacaccaggtccccgcggaancgcgatgntcgngccatggcggantgacggctcttgagagtctcatcgagatgggctncccaggggacgcgcggagaaggctctggcctcacagggaaccagggcatcgaggctgcgatggactggctgatggagcacgaagacgaccccgatgtggacgagcctttagagactccccttggacatatcctgtggacgggagcccacnttccntcagaacaaggcggccctttgaaaggatctgggttctgcttgcc

SEQ ID NO: 678559 - DNA, 892 bp, Homo sapiens
cgttatgttaaaatccgctgcctgtaggtcccccatttccccactaaagtggtccctcttctgtttctgcagcttcaggccctcaggaggtttcacgcgcaggtatttctcttggactgacctcctccgggacatcttaaccgtgataaaacgcccttgtgcaaacaataccaatggtgtcatttgacatggggccccctcccactagagcttcttgaaaggcgttggtcgccagctcgcgtctatcctcaacatcgtggtgaaaacgaccgtggggcgccctccccccctggagtgatactatttcctgtggccaaacaccccggagtcacgtatctgcaacgacgtggtgccaaagacatctatttccgtcaggtaatactaatacggacgccatgtggtatcccccggaagctatcttctgtctcctgcgtggcgccgcgagttttgtgattaccccgatactgcgtctgcggtgtgagcaaaatgatgtctttctgggattgcttgtcgtcgaaagaagagttgagtgctagtagagtcaccacgacgattataagattcgcccaaaaaaggttaattgttttccacaaccccctatgacaacattcttgttgaagtaagaaccgttactttcgtgtgagttgccagtgaaactatcaactattcattcccccggtagccccagtatgttctgcatgaggttagtaagtctgcgccacacagtcgaggtgccactactaccactcgattgggctggtccccctattatacaagactggtgcttggaaggtgagcgagtcatttctacggaaaagaagacatggacatttttccggcacaaaaaattttttcccgaccaaaaaaaaaaacttttcttcacaacaaaaca

SEQ ID NO: 678560 - DNA, 292 bp, Homo sapiens
  misc_feature (182)..(182): n is a, c, g, or t
gagtccgctgggtttacccagtcctccaagaaccccagtgaaagtcgtgcctcaaattagaatcgaacgtgagcctgaagacaacgattatctttggaggagcaagggaacagaaaccacgttgtaacctgtttgtccttctcaaaactgacacttctgttgttaactgttctaattttttnttgtctatgtattttaaaatcttttgtttggtcactggctgaataatagtcactctctctgcttctctcttgcataggtaaaaatcaagacaatagtgtcccttgccttt

SEQ ID NO: 678561 - DNA, 195 bp, Homo sapiens
atggtggcggagcgagtggtatgtcttaattctgggtgcagcaatttgtctacttagcctcccaaagtgttgggattacaggcacaagttatcacgccctgcccatttcttatattttacattctttgtatgttacgtatactcgctggtgactcgcctgcttgtcctagaacacccagcgaagctgagcgtggg

SEQ ID NO: 678562 - DNA, 413 bp, Homo sapiens
ggtgattagaggatcttgctgccacgaagtggagactcacttgatcggaggagtttgagctgacatggtgaaaacccatctctacaaaaaatacaaaaagtagccaggtgtgttggcatgcgcctgtagtcccagctactcaaaggctgaggtgggaggatcacttgggcgggagaggttgaggctgcagagagcagtgatcgcgccactgcactcctgcctgcgtgacagagtgagaccctttctcaaaaaaaaaaaaaaaaaaaaccaattttttaaaaatcccttttgggatctgggttggggttggggttgggttgggtccaaagagttcttgccacttttttaaaagaggactttgggccgggggcgggggttcaccctttaatcccaagcatttgggagggccaggg

SEQ ID NO: 678563 - DNA, 173 bp, Homo sapiens
gtgtgctgctgaggtcactctaaggatcccttattcgtgttgcacagcgcatggtatgtaggttagcataagatgcctccgtgagaggctgtggtcagcctggggtcagtaaccacaagaagcgtggctccggaaggtgctggatctgttagtgaaggttccaggagtgaagc

SEQ ID NO: 678564 - DNA, 188 bp, Homo sapiens
gatagaacttctgcaaaggggctattgatattgaacattcaaagccagctgtggtggctcatacctacaatcccagcactttgggaggccaaggtgggatcacctgaggtcagaagttcaagaccagcctggccggtatggtgaagccatgtctctactaaaaatacaaaattagccggacattgtgg

SEQ ID NO: 678565 - DNA, 411 bp, Homo sapiens
ccaagccagaaagccaggcaatcctaagctaaaagaacaaagctggaggcaatttacccaacttcaaactattacttagggctacaataaccaaaaccgcatggcactggtacaaaaacaggcacagagaccaatgggacagaatagagacgtctagaaataaagccgcacacctatgaccatctattctttgacaaagctgacaaaacaagcagtgaggaaaaagagtccctattcaataactggggatactggctaggctagccatatgcagaagattgaagctggactcctttcttataccatacacaaaaattaactgaagatggcttaaagacaaggtaaaacccaaaactataaaaatcctggaagaccggccgggcacagtggcccacgcctataatgccagca

SEQ ID NO: 678566 - DNA, 752 bp, Homo sapiens
tcgaaggtctaaagagattctttgttttggagaagacctcctgttaagccccaactctggtctgacatactggcacacctctttaagattgtgttgctatgatctgtgtcttaattgttcattagagtgagaatcgacctatgattccgtttgtgaatttgtaaaatttggaaaccaagccgccagcttatggtaaagtactgtactgtgagaagtattatgatatttaatgcatctcgtggcttaacacttgtgagagttacccgcttgaaaatgatggtgttgactacctcttgagatcacatctatccacccctggcacctaccccccagctggcttccaattagtatgtggttgctttttggtattaaccactataccgtactagagacccaagtgaaccctgatttttatatgtctttaataatggtgttttatctagtgtttttaaattatgcctgtgtagtatttagattacctccttgtcccttttgactcatgttgtttacacagtgaaaataaaaacacttgaactgtatgtttttaaaagcccaaaaaggggtagatgtttggaatgcgtttcactcgcatccagtcatctggagggactgaagccctgtttgcctttctgtaccctctgggttttatattctcatttcatgcctaatgtcttattctgtccattatggatatgttgaggtttaaaacaaattacttgattaaaaataaaacatataacgttggccattta

SEQ ID NO: 678567 - DNA, 468 bp, Homo sapiens
gcgagaagcagttggtgctgataacaggcctgcgcacctacggcgggcttctccggtggcgtggtggttgactaccctaacatgtgccatggctgagacattctagcctctgcttgttctctcgggccttcgacctttgtaccagaggggctgacgtgagaatcaggatgaatgcttgaccccagggagtctgtgttcaccaatgagaggttcccattaaggatgtctaggcggagaatggtgaggaagagtcgggcatgggtgctggagaagaaggagcggcaacaggcgccagggcagggacgtcagacctgacacccagtacaccggacgcaagcgcaagccccgttaataaggtcaccacgcggtatctggaaaggcacttgcatctgaacttttctatatggtccagctgacaaagtagtattttagaaaagttctagagttataaaaatgtttactgcggta

SEQ ID NO: 678568 - DNA, 602 bp, Homo sapiens
  misc_feature (1)..(1): n is a, c, g, or t
  misc_feature (110)..(110): n is a, c, g, or t
  misc_feature (198)..(198): n is a, c, g, or t
  misc_feature (228)..(228): n is a, c, g, or t
  misc_feature (236)..(236): n is a, c, g, or t
  misc_feature (238)..(238): n is a, c, g, or t
  misc_feature (245)..(245): n is a, c, g, or t
  misc_feature (250)..(251): n is a, c, g, or t
  misc_feature (272)..(272): n is a, c, g, or t
  misc_feature (309)..(309): n is a, c, g, or t
  misc_feature (344)..(344): n is a, c, g, or t
  misc_feature (361)..(361): n is a, c, g, or t
  misc_feature (374)..(374): n is a, c, g, or t
  misc_feature (378)..(378): n is a, c, g, or t
  misc_feature (402)..(402): n is a, c, g, or t
  misc_feature (412)..(413): n is a, c, g, or t
  misc_feature (415)..(415): n is a, c, g, or t
  misc_feature (451)..(451): n is a, c, g, or t
  misc_feature (473)..(473): n is a, c, g, or t
  misc_feature (506)..(506): n is a, c, g, or t
  misc_feature (580)..(580): n is a, c, g, or t
  misc_feature (601)..(601): n is a, c, g, or t
natccacattgagtcataacacagattgcaaagggcaaagtaaaaacggagagaactaattgggagctatatacagttgggcacaatggtgtcttgtacactagaaagtnttttacaaaataatcatcttagatcaacagaagaccaatcttcaatgtcgtcctgcaagatgggttactttaacatctcctcctaagnggggaacaaaataccagttagatttgtgcnactctganangcttttnggggnncgctttcgtgatttgtttttngtcctcacttttttttcttcaatttttttagatcatntgcttatttattggtaaaatgcggtttgggtggtngatggactcgccctggngttcccgggtggnattntgttcttgtcttttcggggggggntctgggggtnngnccttccctttttctggggttcagctttgcttggttngggtcttcttggggcgtctctngtgacccaagtgaaatgctatcacgaacaccantttctgataggttttttgcgggggcgtgagttggtctgtgcgtatggtctttgttttatatcccaggttttagngttcttgttttggtttgttgnt

SEQ ID NO: 678569 - DNA, 1307 bp, Homo sapiens
ggcaccctcctggcagtcgccgtgtgttcctctgtggtctccctgatggccagctctagctgtgtgatcctgaaggccctggtcactccagtgtcagcgcctggtgagcgcaaaatgcgcttgtcaagatcctcccaatctagcgtggtaggagccctgtcatcttcgatagggtgccttgaaaaccacgatgccatgggctgccataagctgcagagaatattctgcctgacaaggatgtgcacttgtgcactgcctggtggccttatggtcaccacggacgcgagtgctgtggccatcaaggccaacatgggatgatgtccgggaagctaggtgccctgatgctgcgaggcagtacttgacgtcctcagggccctgtgtgttctgtacgcgtgccagtgtgacttgtgtaggcgatgtgtcagcagttgttaccactacgccaattcccctttctgtaccctacctggtggtgagtcggtatccttgttacatccggagagaaacgtcgacgcactcggactgggtgcccctcttggagtcaaggcccaccgaaagaacagcggacaccgagcgaaaaagtccctgggcccccctctatagtcttgtagacgcgcatgcccaggcacgttgaaaccaattccttgcgagggataggtacgggatacctcagccctagatacgcgccagttccttcccccaggggactcaggcagttgacaggtgatcggggcacccctaaacgggacttccttgtgtcaccacttgtacctcgggcattagatgtgctcggggcccctggaattgatcgccttgggaagtggcccgtgtgaacccctttggtacgccttccctttgaaccgtcagtttgcctctctagcgcgcaacccccaaacacccaaaggtgcacatcggacctccccaaccacgaaacgcaatggtagcccaagagggttcaaccgcaaggagcactcacaaatccggcgaggcttcgactgtggctactttgtggcaaacattgtgggggccaaaggcggattatccaatgcaatgggagcgagagcgacaggcatggggtcactttgctctcgcgtacaacagcggggaaccgcgggcccgcgggtcctggagacccttagcaggcgtggacagcgcggaaacgcggtcgcacgcttgcattccacactgtcccctttccatatctgtaggcggacccaattggcaaaccgctgtttgcaagagcgctgccttgtcatgtcttgagcatggctcctaaggcccttgtgccacctgggtggtcccaccca

SEQ ID NO: 678570 - DNA, 505 bp, Homo sapiens
  misc_feature (48)..(48): n is a, c, g, or t
  misc_feature (54)..(54): n is a, c, g, or t
  misc_feature (133)..(133): n is a, c, g, or t
  misc_feature (135)..(135): n is a, c, g, or t
  misc_feature (148)..(148): n is a, c, g, or t
  misc_feature (176)..(176): n is a, c, g, or t
  misc_feature (234)..(234): n is a, c, g, or t
  misc_feature (250)..(250): n is a, c, g, or t
  misc_feature (264)..(264): n is a, c, g, or t
  misc_feature (439)..(439): n is a, c, g, or t
atgagatgctcaaggggggagcacgagggcgctgggggcgcccaaaanccttgntccccgacgtcccacggtgatccacatcccgcagcgaggcctccgtgccccgaccatgtcgtctggtcctcaaacaccntnttcatgaaccccntgctgcctggggcttcatagcattcgcntacccgtgaaagtctagggacaggaagatggttggcgacgtgaccggggccccaggcntatgcctccaccgccnaagtgcctgaacantctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcntgtatcagccctttatcctcacacgcttttctacaatggcattcaataaagtgcacgtgtttctag

SEQ ID NO: 678571 - DNA, 1259 bp, Homo sapiens
gtgccaggaggctctttgggaaggagtgtcagcccagtcaggtggtgcgctcccggatcactaggggtgtacacgatgaagtatgggtgaacacctgctagctcatggatacccagatgacttctatgttcgagtgggcagctagagacagaggcccctctgggtacttgacagtccaaagcaaccgaacaagataaacaccaaggaacatagagaggatccaataaaacgacgtggcacagcacaaggtactggagaacgcccagatgatgacatcaatgctaaggcgtacaggatcgggccgctggaacaaccaacatggaaaatcacagcccataccgataccggagactccaaggaatacctgaagcgactcctacctgagcaaaaccaggaaaccaaacagaaccaagcccgtgacagaccaacacaaaaacacctccacaggggcactgaaaccctgacataaaaaggaatgcccaaagaacaaccaaaggactcacgtggaaccatgcggctatagcacaaccccaccaagccaggaacaagcgcggccagccgcaacagcgtggagacgcccactgaaagccacacacgagacacaggaaaaggcgaagactaccgaccaaaaccacgaccagacacacggcaacgaatctaaacacgtcaatagcagaaatcaaaacagaccaagaagaagaggaacgcccaacgacaccgacgaaccagagagaacaacgcagaaccgccaggcaggacgaccgagacaaacaggacgcagccaacaacagacacacagacgaggcgcagaacgaccacggagaaacaaagcaagaacacgagaacaggcgaccacatccgaactgagacagagagcacgcaagaccacaggagggcccccaatagcgacccacaaaacagccaagtaacacactagaagaaaacgaagacaaagagccaggcacaaacccaacgacaaggacgacaagcaaaccagagaccaaaagggccaaacgagaaccgacagacagacgagaagcacagacagaacgcgaaaatagagaagaagcacgaccaaacgagaagacgtcagcaagagagggaggacgcaggggcgcacaggagccaccgccacgaaggcaacgaacggccgcagacagccgcccaccgacgccagcagcgccacacggcccaaggcagggcggaacgacaccgacaagacccaaccaaccggacccgaggacgcccaacgccagacg

SEQ ID NO: 678572 - DNA, 163 bp, Homo sapiens
gctgccccacgacatgtagaggaaaaccgaccatgggggaagaatttttcccgccccccgtcccgaaggtattaacacactgcggggtgtgctttgttgtacaagctccgccgacacgcgagcaccgagctgacctccaaatatcgttaagctggagcctggc

SEQ ID NO: 678573 - DNA, 347 bp, Homo sapiens
cagctcggatccctccactagtgcaggccaagcatttgctggatcatttttctacaaaacttgtttgttcaatataaaacactctctgaagagttgactgtctttcagctacgtatcctggaaatcacattttgtaaaactggggaccacttcataattgtcagatactttttaaaaattattcagtacatcacttttataaaaaaaaaaaggcttcttgaaagaaaattagatccctgtggccccatatgtatgattaactctagaatgatctataccacgtctgtttaaattaactttttattgacatgccaggtgtccatttttgatgctaatcatggctcctt

SEQ ID NO: 678574 - DNA, 109 bp, Homo sapiens
agttcttctccttcttccttctccttcttcttccttcgtcaccgtcttctccttcttcttactttcttcttccttctcctcccttctgtcgtcttctcgcaacagtata

SEQ ID NO: 678575 - DNA, 697 bp, Homo sapiens
  misc_feature (238)..(238): n is a, c, g, or t
atagggcccgttgctctggtggcccaggcgggagtgcaaggatgtaatctcagctcacggcattccgtgacctccgtgtgtgctcaagcgatcctcccacctcagcctcccaagtcactgtgggacttacaagagcacgccaccatgtgccctgggataatttttctctatattttttgtgtggtagagatgtggggttttggcgcatgtgtgtgtgcccaggcggtgggctctcaangtgtgatctcctctcctgcgccttcgagcctctcccaagagagtgtggtgtggagacaattcacgagggtgtgtgtggagcccacagagacacaccggcgggtctgtgcgtctattctccttatctctctgagacacacttctcgcgctgtgtgggggacacactcctctgtatctctctacccgcctttcagagtgtgcgccccacaaaaagagtgttaactctctccccgcagatgatattgagacacacacactctcccctctccccccctttatctcacgtgtgagacaccacgcccacagatagtgagagggcacacgaaaacactttctttcacagagacgccacaacacccttttgtgcacagtgtggggccaaagatattcacgcggctctaaacacacccacagagacatctcacagaggggcgtccatatctctcactatcaaacccta

SEQ ID NO: 678576 - DNA, 155 bp, Homo sapiens
  misc_feature (6)..(6): n is a, c, g, or t
  misc_feature (87)..(87): n is a, c, g, or t
  misc_feature (114)..(114): n is a, c, g, or t
cggcangatgccatgtctttttgatcacttaaatagtcaatttacttatgatttatgtgtttaaattgtatcatggcatgtcatgcngcaaagttactgagttttcaagatgtntcacagttatctggcatggccataatttgttttgacagtga

SEQ ID NO: 678577 - DNA, 105 bp, Homo sapiens
  misc_feature (61)..(61): n is a, c, g, or t
agatccctattctcagcaagctaaaatcacctggaaatcataccagaccctctgaatcagnctgtcccaagcagcacgggaacccctaaagcttgaaaactccag

SEQ ID NO: 678578 - DNA, 116 bp, Homo sapiens
  misc_feature (97)..(97): n is a, c, g, or t
  misc_feature (108)..(108): n is a, c, g, or t
aacacttcatctcagcaggcagcaaccaagcagccagggcagcatgggccagcccacactcattccccaacacagccgtcgtgggggtcacgcagcntcgcacattcngtcaatcc

SEQ ID NO: 678579 - DNA, 107 bp, Homo sapiens
aggatcttttgtcacgagcagacagctgctgctgaagggaagtttggaatagcgatggtgtcattgtactgcctgcttgaaggtgccgcagcctgtgagatagggaa

SEQ ID NO: 678580 - DNA, 241 bp, Homo sapiens
ccggttgatagatacttgaggtcaggagtcaatgtactagcctggccaatatggtgaaacaccatctctactaaaaatacaaagattagctgggcatggtggcatgcgcctgtaatctcagctgttctggaggctgaggcagcagaatcgcttgaacccaggaggcagaggttgcagtccccagcccggcccggccccagcccggcccggccctgggtaccggacgctcgaaattcgtaat

SEQ ID NO: 678581 - DNA, 411 bp, Homo sapiens
  misc_feature (2)..(2): n is a, c, g, or t
  misc_feature (63)..(63): n is a, c, g, or t
  misc_feature (70)..(70): n is a, c, g, or t
gnttctaagagaccagagcttggggttggagcttggtctggccagcctctgtggacacaaagncaaaaangcattggttttgcctgtaaaactaaggaatttaagggagcgtcacatttgtaacaacacctgtatgaaaaaaacaccttcacatcaaagctaagacaccaaagggctcaagttcaccctgcaggtgaacaccaccatctccaaggtgttcttaaaccagcccttttgttgtgggtgtgtagctgtttttaaagaaaaaaaaataccaacctgttttttttcaaagttatcactgggctttgtatttcgatgtaacttcagaatacatcatgggacccatgaccaaaagtcagctcaaaacataactgaacaaggatccgaataaaccattcttgcttcgga

SEQ ID NO: 678582 - DNA, 194 bp, Homo sapiens
  misc_feature (1)..(1): n is a, c, g, or t
ntacatctccagcacacaagaacttcaaaacgcctgaactgcagcagccaggtattcctccaggacctcctcccccaggatcttgcttcaagtgccgaaaatgtggccactgggccaaggaatgccctgcagcccggtgattcctctgtaagcttgttgtcccactctgtgtaggggccccactgtgctagtga

SEQ ID NO: 678583 - DNA, 147 bp, Homo sapiens
gcagcgtacctcagttggaaatgcagaaatcatccaccttctgcgttgatctcactgggagctgcagatcggagctgttcctattcggccatgttgcctgtcaccctgacatttgtctctttacgaacacagtattctgtctggttg

SEQ ID NO: 678584 - DNA, 105 bp, Homo sapiens
ataggtggtagcgtgtatatttgtgtgtcttgtgatgaaatagggctgcctttcatcttttctttaaaaaaaataaatgtttacgaggacatttccctcaggatt

SEQ ID NO: 678585 - DNA, 897 bp, Homo sapiens
  misc_feature (3)..(3): n is a, c, g, or t
ctncccttttatattatatctattacaacgcacagacaaaataacttcactcttggtccaaacgttgccctgccaatctcccgcacgttttaaccccaaagtaaaaagaatgtgcccgaaacaaaatactccaaacaggccttcccctatcgggttcccgcgcacatcttacccccgggccctctccccccttaggtgtcccacaccccagatgtgccttccaccaatcgcaaaaaaacttgggcgcaccccgccatattcccaaactttttttatataccgccctcaaaacccagcgggggtctcccccagagttccccaccactcctacctctgcccaatttctggtggccccaacacaccccattaggggcgtctccaccaaggccgtgggcaccactgacgcatcctcgccggggtgggcttcccctcgatgcccgccgacagtctaatctaatggcgttttgccgcccggccgccgcgagtccttctcaactaagtcgggcgccttggatctgagccccttccagtaccgccctctgggtgtctcagatcattaaagtcgggcaaatgaacttcgggggtcccccgactcttagtttattcgggtactctttccctacaaaaagcatgccttcggacccccgccccctctggggcggcccaccttatagtgcgctctctgctgtggggcaacacccggaggcgctcaggctctccttggctcgtttagttgttcgctagcccagcacccggagggggcgacggtcaagccacacctcccgggtggggcagtcttcgacgcccccccccacctgcgagaaaaaacacctgggctgcccccgatagttttcccccaccccccccgtaaaaaaaaaattcccccccacaataaca

SEQ ID NO: 678586 - DNA, 616 bp, Homo sapiens
  misc_feature (39)..(39): n is a, c, g, or t
  misc_feature (98)..(98): n is a, c, g, or t
  misc_feature (182)..(182): n is a, c, g, or t
  misc_feature (321)..(321): n is a, c, g, or t
gatataatccccaggtacatatggagagaattcttgganttcatagcactgaaaggttaaatctataggttagtctcttaataagaggcaaaaaattnaaaaattataactaccaatacttgtgtttaacataaggcaaaaaaatttaaaaattgtaactgccaatattatgtttaactttnaatgtacatatacaaaatatgtatgttaactaatatacatatgtacacatgacatacatgtgtaggacatgtatacataatatcatacatatgactctaaggtagaatacatgtcatacatatttaccagtgtcttttngcactgttcctatgttttctgagtccttcacttcagatatttaagttttagtgcccatgtcttctatacttaatcctttgatttacccaacccttaaatatgcattgtattagtttactctgctgcctatttggttggggaacaaggaataaaaacagtattttatttggaataatgttggaatggaaaatgtttctgtttcagcttagataatatacaatctacagacttggactcttccaaaaaattacaatatgatacacattctaaaatgcataaggtcaggcaggtggcg

SEQ ID NO: 678587 - DNA, 498 bp, Homo sapiens
taacagtaaagttttgtggagtttaaaatatagagagaatcaaaataaaggtcatatgtccaacaatagtatattagttgcattttcctactagagggttaaggtactaattcgtcacttctagggtaaaccaatgccatagtttccagcctcacagccaaccagaacttaaacttccctcccttccttaaaacgccaagaacagagagacaaccaaacagaataggcaggacaaatagcacagtaagcaggttgatttaaacccacatttaccacttcaaaacttttgaggatgatatataggagtatattagtcctttctctcattgccataaagaaatacctgagcctgggcaacaagagtgaaactccgtctgtgtagaaaataaggtttgaaaacaggattttataagcctgcttgtaaccagtggtggggcaaaactgttcaatatagctttgttgttactggaactatgttaaaaataaattgccacaagc

SEQ ID NO: 678588 - DNA, 1531 bp, Homo sapiens
gcattgtttcagcggaggccaaatctgaagtcctttccagggcagtggctctgcttcatcttattcgccagccaaagctaggaacagcgtacagagcgagagcagacacacttcagcagccaaagcgactcgcgtggcaaacgagcagaacacccatagaacagtgcacgctcactccgacttaccctggaacaacccttaacagagaaccagaaggcgacatggtgctgtattgtcctgctgtagttggtgctgaacacggggccttgccacgggcgggcaaactgcgcgcgaaattggtccaacttggaaacctcctacgtcctctggaaggccagaacccgttccccaacagagttaacccggttgggccaaatttcctggaactgcaaccgcggagcgaaccggccccacaaagcgaattgaaaggccaacgcacttggacttgacttggaaagaccgaacgattccaccggccacttaccttgaagaaaaacccgcgcaccagcaaatctcccagcccaagttccaggaggagggactgtgacacacgcgaagagggccccaataaaaggggcggcaaaagagaggggccccaaagcgcctaacccaggggaacaccccaacatagccacaacgacaagactgggtctaacagaccacacccctctcctaccccccgttaccccttggaaaccccttcgttgtgcgcactaaaccgccgcacaacggaactcgccaccacgcttactacacctctaaacgctgaagcacggcgctaacaagcgcgaaacgcgcctctatccacgccctggggcgctcttaaacacctgcccctggcaaagacccccctatcagtcggcccacaaaccccttagcccggcaaaccccccgccggcccacccccgggccggccaacgccaaccacccacctttggcccacccccactgcgcactcccgggaggcgcacccactgcgccacccacaccgcgccgcgccctaccaccatcggcagagacacccccacgcggcccccgaaccacccacaccaccaccccgcgcgcgcaccacacccgcctcgggccaacgcgagatattcccacgacagtcctaacccaaacgccggcgcgaagcgaaccccgccaccctggcgacgaacgccacaacacgaccgggccaatctcccccttgggacccggcccaaaccgcggctaacctgccacacaaacagcggcaacggcaaaagccacgagcgcgcaggacgaaacacaccgcgttctcagaacagagaaacaaggagcgggccacaccttttagcacaactccaggctcgtcccgccaccacctatatgggtgcggcagtccgaaaacgccatgcgggaaaacgaactattcatgcgcaccgctatcggaacacatcgcgtagttgagcgaccgcacgttttccggttgtgaaccacgccgccgacaagatttgtcgtagacacaacaactttcgccgcaattcacgctctggtagtctcataccac

SEQ ID NO: 678589 - DNA, 130 bp, Homo sapiens
agagagtaaaaaatataaacacccatagtaggcctcaaaagcagccaccaatctaagaaagcgtgcacagctcaacacccacgtacctcacaacaatcccacaacatataactgtaactccatcacaccc

SEQ ID NO: 678590 - DNA, 375 bp, Homo sapiens
aatcccctacttcacaggaatgctaagctgctattatttgattataaattggagatacattccttttgaaaaagactggctctaagatgtaatttgagtattctccaaatcacatatttaaaggaaaaagagataaataacagcaactaaaacaagttttacaaatgactacaaagtaattatgtttcttttcgtggctttttgctttggcttaaaggtcagcatgaaaacagatgagagttaaacttagaactgagcatatcaggtagagaatcacttaggttccatcgaacacccactaccagccaagtttttgggtttactggtcttaaaaaaagatatatgcccttctgaactgagggaaagaagggggag

SEQ ID NO: 678591 - DNA, 389 bp, Homo sapiens
ttaaatgtctggtatgatacttctgaagcagagctgtaactattttcttaatgttacagaacatattgcattcttagagttagaatgacaggtaggtttggaggagaacttttaatttttaattaaaaatgtagatacatgatgatgatgttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaa

SEQ ID NO: 678592 - DNA, 114 bp, Homo sapiens
cgcgtgcgtgcgtgcgtgttgcctcgctcctgtgattgggtttgagagtttcttggctgtgcttgagaatggacggcgctccggtggccgagttccggccgacgatgacgcacg

SEQ ID NO: 678593 - DNA, 146 bp, Homo sapiens
caagcacctctgagaatgtatcagtatctcacctatctattacctctatatgttatgtaaagatacgggcgatgtctacacatctgagcatgtgcatacttagtccatacacaatatacatgtatttcatttaaagagttactttg

SEQ ID NO: 678594 - DNA, 397 bp, Homo sapiens
aatcagttctagacaaacatctatgatctatttcctttcaatggatagggaattccagcatcgctcagagcaatctaacaaatcccacatgtcttggcttgaatatgtatatttagagggacttatccttaagcaataaggcctgagggggtgtggtatatggccaatataccacggctaagggctgttcttcggcgctacgctgaggagccttattgccataataaactggttaccaacataattacagcagtaaaaataaatgttgtcatacccgtggtatatggtctgatataccatggctgtcggccaatcagcatccagggctcgaaccacccagttttgaagtcagtaacttataaagcgaatccattgcaggaaggcaagccgtcgacgc

SEQ ID NO: 678595 - DNA, 148 bp, Homo sapiens
gggggttttttttttttccccccccctttttcccccgcccccagggattaaccccttttggggggggccggggggccccaattgggccccccctagaaaggtaaaaccccccaccaaattttttttttatttattttttggttcccca

SEQ ID NO: 678596 - DNA, 228 bp, Homo sapiens
ggtgttaccttctacaagaagtagagacgggggttttgccatggttgcaggctgtcttggactcttggactccagggatcttgcctacctcggtcctcctagaagtgctgttgattacaggcgtgaggccaccaggacttgcctgactggacatttttaatttttttttttctttgagatggagtctccctctttcgtccgggctgctcaccgcaagctctgcctccc

SEQ ID NO: 678597 - DNA, 484 bp, Homo sapiens
taagtagaaccacctgtatataaccttagggtatatactcagtaatgggattgctaggtcaaagggtaattctgtcttaagtcatttgagaactcaccaaatctactttctacaagggctgaactactttacattcccaccagaaatgtctatactttccctttactccacaggctcgccagcatctgtaattctaggactttttaataatagccatttcttagaacaaattctgagcccaaaagaattcaggcctggtgatcagctcatgttgtagaaacagttacatgaggagcttctcattactgagtagggcatttgccttattcctgtgtttaaagtcacctagctctgtttaagcagcatgggtttttccattaaggtacttgttcagagttggattcaaattgcaaataatgtctgatgatcattaaaatcatttttaaaaattacaatgtttatacatctggttttaaaatctata

SEQ ID NO: 678598 - DNA, 945 bp, Homo sapiens
gacagaagcctgtataacagcacaacaatagacaattacttatgtaggacctagtaccacactgaagagaatccatgtagtaatattttctaagattaaaaactgcttaagctcatccagaatctcatcaggactggagcagattccctctggagctatactatgatatgtagcgtcacaagagactctactattcgtgtatacgctaaatagataagtgggcacgaacagttggtgtatattggcatctattaagtccatcctattttcttattacccataaaaatgggtgagctgctaggtgtctctgactacgacctcccgagaaaacgaaaggcatagttataggaaactggaaagatgaatgagtggccccgtgaaaggatcatctcagtattatgggcctgccacatgtgctacaagtagtgggtcatggtggatacctgaacccgatctacatgctcaattggtatcatacggatgctggccatcttagaaataatttctaatgaaactggcatagctttgactgttttagcttggcaagaaacgcaaatgaggaatgctatctatcagagtagactggcttagactacttgctagtagctggaatggaggagattaggtaggaaaaccgtttacttaactaagtggtggctagattataaatgatcaaggacaggtggttaaaacctaggtcggggcgtgactcagtggcacatgtgcctgtacagttgggcgagttaatcttgagtctatgacaatggttccagttaagagagataacctccatgagggattgcaagaaagaacgctgcggcccctgtttacatgctcgtagcgcgacggtgggtctgggatagaacgcattgtcgaaggcaatcacacaggaagaagaccacaacggggaaaagacgtcatcaccccgaaggagaagaaaactcg

SEQ ID NO: 678599 - DNA, 139 bp, Homo sapiens
ctgtctagaggatcccataggaagatgtgcttgaatgtgccggaaagcacagtcaaactcttcaccgctgttatttctacaccagactttgatccccgtgttaataaccttcatcttctcactgttattcagcagcaca

SEQ ID NO: 678600 - DNA, 197 bp, Homo sapiens
gttatctacgtcctcactcggcttagacacgaacggggagaggaggtttggggtgcccgtaacaatccaccctcgtacctctcaggcccaccgtcccttccccacaggtgctcagtccaccaggacaataggctcattggtgctggcaggatgtgagggtgcaggtagagggacagaaagagaaacccccaattagg

SEQ ID NO: 678601 - DNA, 859 bp, Homo sapiens
tgctgacatatctgaagtgcccgcgagaggaaggagcaggatgtggagccatctggagccgggcagggtaagcacaggacaagcatctgctggaaactttgcagagatatctagtgcgctgatttactgtcctttggggagtccatgtcagaacccagattcatgaggaagccggcatctggcaaaggttggggtacacaattgtgcttgattatcaggacatatgataaatctgtctaggcgtgtactctgtgccagattgtggatttcttatttggcccgcatcagccgtctgccagcaaagcaatacaaaagtgtcacaacaacaaacaaacaacaaacatgccaaaaaaacctagacttagcatagtgatatcaaaatatacagagtcaccttgaaataaaacagtggtggaggtgttggcagaggaaggaagggaagtgatatggtaaaaggtatttgactaacagggcagtgggcgttgttagctttgatgcatactcatgtactccacagaaaacacaaacccaaaattatatggtgcttaattttccagatgctattttaaactttttacttatataaccttcacttatttctcacaataactctaaaaggcaagtactattagtatcatcctctttttacagagcagaaaacaagtacagagaggtgaagtgacttgcccccagacacacagctactatgcactagaacccagactggaacggtagtggtctgattccaaagtgcatgctcttcacttctatattctcagaagcactgttttatttcaaggtgactctgtatattttgatatcactatgctaagtctaggtttttttttttttttttttt

SEQ ID NO: 678602 - DNA, 816 bp, Homo sapiens
  misc_feature (137)..(137): n is a, c, g, or t
cacttttccccccggagggggggccgctcgtccaaggattgactccaagcccaggtcagttcgcggacctttgccttctttggagtaagataccgccccttcccgcctctctggttgactccccttcaacaaagtgncttgtcatgttggccacccgcacggtgtttgctcttcctgccaccgtcgtcgccacctcgccgttgccattgttgagcggtcgtggaccctctttgttgacttagtgggcctccgcaccgcctatcagcggggcgtgagctctctggtatcttcttggagggctcaaccttccgtgtgtgtggcacccccaagcactccggttcctttcattggtaaccccaacacttggaagttaggagactaagtggctcaccacgacgatatgtctgtcatagacaccacgcacttggatttatgtgtcggggccactccacagtaacatgtgggagatacgatatggggattctgttcccctgttagagcgagatgcaaaataactggcccctaatccccctttccacaattcacgcgcctcgggtaactcgcgcgtctacaatgacaagaatattctcgcgaccattgtgaacccgctcacgactatttctgccaccactcacctcctctacctcactcgcattgtcgtccttcctcttctgctggggctatatcacccacgcgatttttgttcctgttcccgcccgaacctatagagactccgttatgagaaacttcccataaacccatacaataataaatgaaataacaaataaagaaaaaaacaaaaaacaatagatacca

SEQ ID NO: 678603 - DNA, 122 bp, Homo sapiens
  misc_feature (5)..(5): n is a, c, g, or t
atcanagcaatggccgaggtatgagacagcaaagaccaaggcctggaggtggagcgtctgccccagtgaggaggcaggtggccggcgggcactgtgtacagggagcaggctgagccccgccc

SEQ ID NO: 678604 - DNA, 640 bp, Homo sapiens
gaacctgggaggtggaggtcgcgttgagctatcatgccattgcacaccatccctggcgacagtgtgagtctctgactcaagaaaaaaagattactgatgtaatatgcatattgaacttattttgatattatctgttaatattactaaaattaattcctaagattaaattgttgtttttatttcagaattataatgattctttgcttttttcagtttgaaaagtgcaaggtgcataagttttttttttttttttggccttgggtttttacccaagaaagagatcaagaattgagtgttaagttcacaagaagtggggaaataacacgtggttagatttcaataaccaacacttaaatgggattacgtgagttagactacttttgaaattttctctaacagcttccacgggtgaacaaataacactataaaaccacgagccttacactttcaagcttcccgggctctcctttgagtaagaacgggctgtgatttttcaacaattttgtgtgtcacatttctcacttgggatcttttcaaaaaaccgttgggaacaattatacatctctatacatgtttcaagaaatttccataaaaaccattcccttaggtagttaaaaaaccccatgtaagtcttatccag

SEQ ID NO: 678605 - DNA, 377 bp, Homo sapiens
ctctacgaggatctctgcgaggataggaagtacgggcttgaaatacatcccccttgctggactctgagctgacgaattcccctgcgcatgcgggactggctcaaagaacggtctgggtcacctgtatgagaaggcttgaggacaacaaccttctgactgagaagcagaagctgcgggtgaagaagatccatgagaatgagaagcgcctggaggcaggagaccaccccgtggagctgctgggccgggacttcgagaagaactataacatgtacatctttccctgtacactggcagttcggccagctggaccagcaccccattgacgggtacctctcccacaccgagctggctccactgcgtgctcccctcatccgcag

SEQ ID NO: 678606 - DNA, 101 bp, Homo sapiens
acgcgggatcctattaaaaatatataatacagcaagactacgtgcttacttcagaagtactaaggtcctttgaaaactatatgactgctaaaatcggggta

SEQ ID NO: 678607 - DNA, 116 bp, Homo sapiens
gcaggaacgacttcttggccttctcctcctccatgggggacaccccctcctcctccacctcctggatctcgtcgaaggtcaccggaagagtcttgaagcgagactggcgcggccgc

SEQ ID NO: 678608 - DNA, 162 bp, Homo sapiens
gactctccgctcggacaacaacagagaagagagtggcgaccgctgaggggcgtgacgccaagttggtccgagcggacccgctcggaccacatctacaaatatgccagtatcaggcgcgcggcttcgaatgccaaagtgatgtttggatctaatagtgaaata

SEQ ID NO: 678609 - DNA, 481 bp, Homo sapiens
agctgaattagccctattcttatcatgtgctaaattaaatgattacttgaatcatactattggttgttctcaccaacaggaatccggcatggccataggaccaagtaagtagaaagaaaggctcagcagatacaacaagcaaacgaaggtctctggtatacctaggcagacagtccctgtgtcctcccgcattgctttgtactccctgggctacttaacaattcagggatgctgcgtcgtattgattactaaaacagagcatgctgcctctcaagcatctgtttaacaaagcacatctggcactgcccttaatccatttaaccctgagtaggacaccgcacatgtttcaaagagcacaggattgggggttaaggacacaagatcaccaggatcccaaggcagaaaaatttttcttagtacagagcaaaatgacaagtctcccatgtctacttctttccacacagacatggcaatcaagctg

SEQ ID NO: 678610 - DNA, 645 bp, Homo sapiens
tccgtctacgacggcggttgggggggtttagcccgaagcccgcgtcccgcgaaattgtgcaaaaaggcgctcggatgtacccccattaggggggataaatgccagttgtcccggccaacgccgtacatggagccatggtgaatgtacgattgtagattatcccgactagttcccgcctatcgtcgtagctgactccacgttgttactcgccgccgcccccgacgcccttgcgttgctattttggcacaccggaaccaggtttaccatggggtaccacccgcccttatgtccccggcccccctccctgctccccttagggggcctgtcccccgcttaccggctttttgcccccaaatggggccacttatcggtaggattccccaaaaacccatatgccctcaatcactccccacccatcatagcccccactcacccctccttaacctctaacttcttaaacctacggcctattttatctccacccctccattcacacctatctccccactatttgttaaccaacggttaaaaattaaaatgaccacgcgtgttggaacaatacccaaaacccacccccctttctccccacaatttttgccccttcccccctatcctacctatttccccctttaaaccaaaaaaaaa

SEQ ID NO: 678611 - DNA, 944 bp, Homo sapiens
gaggagaactagtctcggttttttgttgtttttttttcaaacaaccggttaattggggcttatgattaactaacggcaggtctaggtgcaggaaggccagggtcccctccggcgcgtggtcacccaattccacagagcagccctagggccaggtgcagccacggccacccagggcacaggggaacgggacccagtgctgcaggccgtgctctccgtgcccagggaagatgccacggtggtgtcggtccggacagcttcagtgacacagttaccaagcagcatagggagggctaaagattggtggggtgtccccaggcctctccctcgggggctggggcgcatccccacagcccccaagggaggggggctctgccacggggcccaatgccacagctccacgggggggcccctccggggcccagggggcagagccaagtattctccaaagggggctgggaggcccggggggggcggggagaggagcggggagagcctgaaaaagacccaaagggatgaggccaaccccttgcattaattccacaagagctcctcgatggctgaaaaggagctcgggtcaaggatggagtccggcgtcgaccccgggccgtgaggtcctccagaaaagccagggtcccagaaaaaggtcacgggagggcaagagggagaccagccgcatcgtccaaggcaggtctcagcctgcgaaaagtttgccctcccgaagcagaggccaaagggaacagtgcctcagagggctccggggagaacggaaacggcccagcggccaaggtaaaggccggagagaaacacgggagggcagcccagtgagtgatcggcagccggacccccccaggcgtgcgaagagcagcgccgcgaaaaagttcgcagccggaggaaacgaaaggggggtcaaagggcagagaggcatgccacggcgagacacggaa

SEQ ID NO: 678612 - DNA, 164 bp, Homo sapiens
acacacaataattttacatatttatggggtacaatgtgatgtttcaatgcatgtatcatgtataatgatgaaactggggtaattaccatatccatcactttcaacatttatcacttctttagggtgacacatgttcaccagacctcagttctcccaagcatgct

SEQ ID NO: 678613 - DNA, 726 bp, Homo sapiens
  misc_feature (350)..(350): n is a, c, g, or t
gcagccagcacaccggcctcgcgctctgggccgttccgccgcagccggcctggcaccggacatgttgggaagctctgggacgcggtagccgagggagcagtctccgcaagtgccggcccccggagccagcacgtcgtcttcatagcctcccgcttccatgggccccgtaggccagtcgtcgcccccaatcctcgccgtggcaccgctcaagtaggaggccaaacgccagcgccgcagcccttgcccgcccctcggcccgcccctgcgctccggctccgcctcgggaccggggtctgggccccgcctcagccagcggcctggcatgggaagcgctgggtcaggttggggcncggggctccgctgggctccaggccgcggggtccgggcgcgaaggcggggtccgagccgtggcgcacctcgcgggacgcgctggacggcacgtagtccagccgctggtgcccgtcgggtccgagctccgggaagcggggcccggcgcccagggtgaagtcatccgggtccgcgaaacccgcgcggcccccgcgaagcttctcgaacaggccttgcgggcgcgccggcgtgagctgcgggtcccactggtactgctgctggtagagctggtcacggtggaagtggctggtctggaagcggaagtcgtcgccgtggctgaggaacgtctgccgcgacacctgccgcgcggccgcgaattctccacggcgcccgcgccct

SEQ ID NO: 678614 - DNA, 650 bp, Homo sapiens
  misc_feature (12)..(12): n is a, c, g, or t
  misc_feature (46)..(46): n is a, c, g, or t
  misc_feature (60)..(60): n is a, c, g, or t
  misc_feature (136)..(136): n is a, c, g, or t
aaaatcctaganccacaaacaaagccagttaagacctttaaaagtnaccttttgaccaancctggtgacccaaaaagggcccataaggaagacctacctaattaccccttaagggccctcttgaggaatgcagganacgtgctgctgacccctttcaggtcccctgtctccctcaacagaagccctaggtgttgtaaaaaaagttccctttgtggcccaagactctgctgtttttgcaattgagaccccctgaaatttttttgggcccttcaaaatcccaaggtaaatgcccaagagtgagcatttgactttggagtactgctatgatttgaatatggtgtgtcccctctgaaactcatgttaaaattttattgccattttggccatgttgggaggtggggtctttaagaagtgattaggtctttaagagggattagtgcctttctcatgggagtaagttagcaattaaagaagttcagcccccttttctctggtgtgtgagtgctctctctcccctgctcctttcacttttccaccatgctataaaacagcatgagggcctcactggatgcagccacccaatcttggacttcccagcctccagaaccatgagctaaataaacctccattctttataaattaaaaaaaaa

SEQ ID NO: 678615 - DNA, 1803 bp, Homo sapiens
gtgcaatggtagcgatctcgtgctcaccacaacctccgaccttccaggttcaagtcattttcctgcctcagcctcccaagtagctgggattacatggcatagtagcctaccatgcccggctgatttgtggatttctcaaggtatgatatgtactactcactcagtcgtttgggatcggtgggatgctcatacagacaatcgccaatgcatcatgctgagtgatgcacgtaccctgccccaccctacgtgccttccctcaaaggtggcctggcgattcattacgggccatgcaggaacaactggtggcccacctgaacaaaactaggcgcctaaacattaaggtgtcgttactacatttggaaaaccttgggttcgacaccctactttgcgccgcaacttaggttagttctcctgtcgtgtcaacaagggacacccgcgcaacgatctttagaatcccgaggccagctaatcgcagggtaagattacagctggaaaccacacacagctctcaatacgtttctcacacctactatttccccgttatacccgatcgcggattatcatctaccatataaccccaaaggaggtcttcaaggggtacctcattttccgattacgggattcatacaagcagtgcttaagcccgttgggagaaacctgctgctcacagtttcaacggccaaacattctaggggtacagcaggtatcttacacaaagcaacagcactaaggtgggtcccacccaggattagcacgccgccccttatagacaccccggacattgctgctatggcacattataacattaactcccatttgggccatcaccatcagttgtccattgaaccccccctaaccaatcagcaacagatgggagccgaccatagagcattagacacctacacgatccttgatgcaaggactaatgtctacactagaggcgggttctcgcacttagtaacttcctcccgcgatgtatttgtaatagcccgcacccttacatttatcgatccccaaccacagtatattcacccgccgagccaacaagacattccagctgtgatctgcccccctcctactaacagctgcagattctacaccaacttccatcgggcgctcgccctgcaccacccccctataataaaacacgtgtcggaccatcaattacgacgaaccagctatcatcactgccacctaactacagtgcagcaccgatcctcacactaccctgcgctacctgcggcatctcgctgcgactctactcctacactgctctctatctaaacaaccagtatatataatacaccattggtatacacattacgcaccatccacccacccccgccacccaaaaaagcatcaaccattctatctcacaccacaccacacgcctctctactttatgtacactacctccctcctatcttcaactacacacaactccgtcattctttttgtaacacatcacactataaaactcacaccaataccctacacatctctatctccactcccacacatcaataccactaattcaatccacaccactcagtacatagtacctctcatcggactcataaattctgtcatagatgtcacagaccaacctataacacccccatacgctacttagactactctcccccatctaccgatactattctcttattattctccaatacacccacctccttacattgccgctacaaatacttacctacgataccaatcaacactatctttgctgcatctcacctaacctaatcactacacatttttctaacaactatcagcaacccatat

SEQ ID NO: 678616 - DNA, 643 bp, Homo sapiens
cgtagtcgaagtcactgcccatggtagttgctggtgatccgcaattacaggacccgaggtgtgggaagacatcaaagacagaggcacaggtagatgaagaaggatcagttacttgtcagaatactatatgatgactccaaaacttatgtattaggtatagctgctgcaagcatagatcctcaatctcaatgctggagaaatcctccaaatagtaagggaagatgtttattcgtctttatgcccagaatctggttatgatacaatcttgcgtgtcctgggctctaatgtcagagaatatctacagaaccttgatgctctgcacgagcagctataggtaccatctacccaggaatgcgtagcaccttcctttaggtagcactgatgcagaaaagggcaaaggactcatttagcactacatactcagagagcagaaggaacttacaggatattgtcataggaactcactccaaaacagatggcacaacaaatccatggcactgacaaatagacatgaaggtatattcagcaaagaaatgaagaatgtgatcatactcaaaattttaattggaagaaaacagagtcaaaagaagaggatataacatgaagatcttgaaagaatatgaagaaaatggtaccaggaatt

SEQ ID NO: 678617 - DNA, 522 bp, Homo sapiens
ttccgattacattagaaccccgacaagcgggccccaggccccagtatttttaaaaactctctcggtgcttcctatgcaccgcccagtttagaagctgttgtcttaaagcagtggttctcagaattgagctcatgggagtcgcctggagggcttgttacatcacatattgctgggcgctaccccagagtttctgacccaatacttctgtagcttggccctactcgctcttacaaggttcccaggtgatgccgatgctgccgctccgggatcacacctggagacctagtgccaaaccctcctaatcaaggcaccgactcagccggcaccgcgggatcaccagggagcttgttagaaatgcaggtttagagaccccgcctcagaaccattgagagagaatctacatattttattttgctttttattgacccataattgtacgtatttttggggtacaatgtgatgttttgatacatgtatgcattgtgtaaaaatcaaatcaaggtatttagcctaaaaaaaaaa

SEQ ID NO: 678618 - DNA, 130 bp, Homo sapiens
tagcacagcaagggcaaaactctttgcacctgatttttgctgcctccagcagcgatgactggcctcgaagcatgtatccctagccccgctgcgagacttttttcccccccaggagcggccccgccccaag

SEQ ID NO: 678619 - DNA, 825 bp, Homo sapiens
ctgatacgggccgcgtttggaatatttcgaccactgcggtcgggatcttatagtggataaatgggaatggaaacgtgtgtgttcctccaaattttcgtattatgagtcatagctgtgtcctataagaagcctcatattacagagttagcttttgcacctaaattagaatgtatccatgaactgttcctcccttttctctgcttttctcctctctgttcctctttataataccacacgtctgtagcttgcattataagttagtcattcttccttcagctgtgatatcccaaaactgttaatacagaaaagagacatttcagctgtgattatgaccattgtttcatattccaattaaaaaacagaacagcagcctagctacttaaggtggggatttccatagttccaaagaagatttagcagattagagtgagttcacactttcaggtgacactgtaaggttctctcagacctgagaaaactatcaactactttctttaaaacagccagagggttgaaaatcctctggacgacaccgaaagtcactttggcatgttccgtaaggccaaatgttaacacacacgtatagcaggaggcacaacgttcaacacctcaagatcaaaatggatttgaacatatattctatcgatatcatatagacagaaaccccaagacgaataagcattacctcctaatttgacttcataacctttcatatagaaattggcactgattaagaccaacgtagggacaatgaacactttcattctgacacacgtaaactgagacatcaaggaaaccgacatatatcttactctgaattcataa

SEQ ID NO: 678620 - DNA, 320 bp, Homo sapiens
tcggtaccctgatggcgctgatgacaccttccgcctctggaacacctaccgcctgccaggcgaatgggacaagctgactgtgggtgggggccgtgaactggaactccaaatccacactgcaatatgcgcgctataacagccacgtcacccaggatgactacttcgtcaccagcctgatggctcgctaccgcatcaaccagaacctggcggccacgcttaacgtcaacaacgtattcgacaagaagtactatgcaggcatggccggcagttatggccactacggtgcaccacgcaacgctacggtgtcatcagcgccatca

SEQ ID NO: 678621 - DNA, 1400 bp, Homo sapiens
ctgccgttcggcgcctccctgatatgtactcgctcctccgtgtgagtcgcatcttgtttgtccgccgcgccacctcgctggtgggttgtctccactgctgggtgccccccctcgctcggtgtttgttatggctctctctcgtgcttgcatcgtccctcgccttctatcctcctgccggctctttttctctctttgttggtcgcccgtccccctggtggtgggacgcgggtgttcccccctcgttcctacggggtgggcgcccccccagtgggtgatttgtctccccccatgggggtattctttatgtgggccctccgcactttttttgtgcttcgccccctggaatttccaactaccttggggggggctgttttaccgccccctcttcttcagacgaggtgttcacacccgtgcgccaccacaaggggttttttagagtacacacactttgtgtgatcccccccgcggagtgtgattaatatgtggtggcccacttttttggatgagaagacacgttgtttcgccgcccagattgatcagtttttttggttgtccaaccccccgatatctcttttatatttagaggatgatagggggtcactcacagctgtgggggagagacacttgttgtgtgggaaagccttgccgcgtagagcccccctacacggaagaggtgggcgcccgaagatatttttcctccctctcttcatgagtgatatattctctacagagagaacacccacgacaccctcttgttatgatacatgtggggagaaaacgggcgcggtgtgatataccacacataggggagagatgtgcactacttctcacactttttgtgtggaatacatatatattgtagactcacacatctcccttttactgctgtgtgagacatgcgccaccatcactttgtgtctcgcccttacaccacaaatagtgagccccccccacttttgtgtgttatacctttcttcttgtagacacacacaccttttctctctatatatgagagacaccggggtatatatagccacacttcacaacagagaagtgtgtgggggagccacaccgtgtgcccacactgtgtgcgcgcacaaaatgtgtgagagcgcgcccgcgatattttggcttgtggcggagaataatatttttttgcccacggcccaccccctgtggagagaccacactgagatatatatgtaaagtataagcctccgcgggtatattttcccaataagccctggggggaactttcctcggtgacccaaaggcacgtgcactgcacatgttggggttttccttatccttttttataaaggtgtggccccaaacactccaccttaaagtttttttaatttgaacccttccttccaaaaaaaaaaatttgggcccccaca

SEQ ID NO: 678622 - DNA, 165 bp, Homo sapiens
ataggtatggtaaaattatctacttttcttaatcactgctagtctcccgtgggggtgtaggctaggctaagcgtaaagagctgcattgtagcgtgcttgatagcttgtccctattagatcgtggtgatttagagggtgcacagtatatctacatttaccgggagt

SEQ ID NO: 678623 - DNA, 567 bp, Homo sapiens
gcacgcggtacaattaaacactatttaatcttccagatatcacttctggtcaaactcaagagtaatgaatggaccttaccatacgggtgctttctgactgagctcctctctactctgaatgcaagagaccctcataggtaggcagaaatatcgcccctattcagccggaagaagttatagaggatggatcttcgtccctctgcaacccttagaattaagggttctcttataaaagggaagggggaaaatgttggaggcgtgtgacacagagctccatctttaacaggagcagggtaaaatgaggctgagacctaccatgcagcattcccagagaggaattctatgtcacaagatgagatgggaggttagcacaagatacaggtcataaagatcttgctgataaaacaggttgcagtgaaggagctgggtaaaactcgccaaaaccaagatggtgacgagagtgacctctggtcgtctttactgctacgctcccatcagcgccaatgacagtttacaaatgccatggcaatgtcaggaagttacctatatggctaaaaggggtaggct

SEQ ID NO: 678624 - DNA, 278 bp, Homo sapiens
ccccccccccccctttttatccggggggggaggaggggttctccactgtttttttcctctggcccctttagttttggggggaaaaccggggtttttcatcccacgtccttgtcccccctcaaggggaggggggagttttttgggccccccttggtttttttttttgggggggggcggtttttgttttttgtttttttaacccggcctttttttgggggcccccctgccccccaatttttcccccgttttttggccccccttaaaaagttttttgggga

SEQ ID NO: 678625 - DNA, 174 bp, Homo sapiens
agcaccttctgagactcgcttgcacttggcggcgaggttgcgtgagccgatgatcaccccactgccttccagcctgcgcaacagagcgagcttccctctcaaaaaaaaaatttttgttttcccatgggcatactgggtgcttgcctggatgtcccgacttctcagcacgggggt

SEQ ID NO: 678626 - DNA, 118 bp, Homo sapiens
aaggcaggaatggacaggtgagacattctgcgcatggtgagtgccgtctgtgcagggcagctgtggattctaggtgccgagtaccatcctgtgacccctccccagtgcctggctccca

SEQ ID NO: 678627 - DNA, 287 bp, Homo sapiens
acctacagtggtctgtatgtatatggccaccacagctcagtttcttctgttctggcggacataattcctcagtttagccttcccacctcaatacagtctgaaaacagatgagcctttattagtcaaatcagctaagcagtttttcaggctcttagtattcagtgaaacctttatatcccttacggtcctccatcttcaagaaaagtagaatggactaaaggtcttttaaaaacacacctcaccaagctcagccaccaaaaaggaccggacaatactgttaccacttt

SEQ ID NO: 678628 - DNA, 447 bp, Homo sapiens
tggatgttattgattgtacactcctggtgtagacaatacactctattgtcctctggattttctatcaattgggaggcagacccaaagggttgattatacttacattcgacctcttcggaatgattatgtgtggcattgtactctttcatcaggaggtatataatgtctagtttttgttctttgtgatgtttacacccattgctgcttaatacctagatatattaatttattaacaattgcaaaatggtgatattttaattctattatgttttaaaactatttttgagaataactttaatgagacatttcctctcattaacattgttattaatgatgtaggccaaataggaaaggcaagagaaatgcttgtttcttttatatatccagctttttaagaaatacgtgtttgccagtcatcctaataaagtaaatagtaccattataaaa

SEQ ID NO: 678629 - DNA, 835 bp, Homo sapiens
  misc_feature (339)..(339): n is a, c, g, or t
  misc_feature (360)..(360): n is a, c, g, or t
  misc_feature (639)..(639): n is a, c, g, or t
  misc_feature (737)..(737): n is a, c, g, or t
atgattccaagcttttagatccagcaagccatcctgttgtgggacactgctgatcgctgggcctcgttagctagagatgctctggtccatgcacgcctgcctagttttgccatcccatatgccattgatgtactaactactggatcttacccacggctgccaacctgcattagggtaagttctttgcttgcccccatgttcctaaaaactaaaggttttggcactggattggattgtattattaagtagcccagcaaaaaacattgttaaaacaaacagtacatatagtttgctttttttctctgtaactaaagttgtgcttttttgaaataagttggngccagatgtgagtagatatcnaaatgggtgaaggttttatttttttttcccccagggatgcgcggatgtgcagacataacatctatttcagatgtgaaaatgctacatgctagttgctttttgaaagtgttttaaacttttattgttttggtagtttactgacttggtgccatattgtattttatacttgtaagaacttgtggaagctatcaagtgatatttagttggtttataaatagagcattaagggaggtcatgttgtattatgatcttagctaaatgactagaatcattgttgtncttatgcacgatagtaatggccattgtttttgtaagtagactgcagaaatgagtgttaagattctcttaggtaaagtacgcaacactgtataaagacnggaaaagattgaaaaaaaaaatccccgtttgtacattatttaaaaatcacttaaatttttttgcaggataaaattattcctccagacccgactaccca

SEQ ID NO: 678630 - DNA, 544 bp, Homo sapiens
gatggttctgacctgtcgattttcaagtgtcatgactggtgaaaacccctgcgtgagtccatggtagctgatgatcccccgatcgtgaggtcggcggagggttgagtagtgatgccactgtcagcaggtcgggtgatgagcagcagctccctatttaagtgtctacctgtgcgagcgacccccctgaggactgacggactgtgctttctttagaagcacaaaacacacgggatcccggtggttgtggcctataacaggccaaagtgccaacaaaaccacactcgccttgcaatccaactctttgaatgccatgtacatacttgcctcttgggtttcatgttaacattagtccacttcagagtcagcactaagcaaaccgcttctccagggcccatgcctggatgcttgaactaaattgcccccaaggagccatctgggtctgattcaagttcccaccccatcctgtggtttcagctcttcaatcagacggcacccactttcctgaaagtcatctttccaagaaacttattatctagttaacaag

SEQ ID NO: 678631 - DNA, 142 bp, Homo sapiens
ccgaactcgagctggtaccccggcggattgtgtccgcactagtctcaggcttcaacatctgaatacgccgcagccctcttcgccctattcttcatagccgactacacaatcattattataataaacaccctccccatactca

SEQ ID NO: 678632 - DNA, 359 bp, Homo sapiens
catgtaatgaaatcattttagctttgcttctcagagtgtcttggctggtctcctaggaatatcggtacttcttaatatagttattttaacttaagaagaaaatataagatcttaagtcagttatcactatagtatcttcgtattttgtgtatcgcactctcagtcttttattctgtgtgtgtgcatgatcataattcatgttatcctctggatctcttagactgtgaaagccttcttggtagggaccctgcaacttgcagcagagttctaaacaaaaattacacgctgcttgtgtccatggcccccttcagcaatgaaatccggcctgtcagcagctgcacccctcaggtaaagaccgt

SEQ ID NO: 678633 - DNA, 254 bp, Homo sapiens
tagctatcctgaaaattttcatctgagggtagattgcgtcatggtcttctgaagttgtctttctctttaagaccattcattgaataaacctattagacgctttggagtcataattgaatataagacagaaatggtttgatataaaagcaaccaacatgcagtagataacacagcaatagagtgaacacattgcagaagatagggcaacctctaatccagaaattatcagataaagaaaaaccaagacactttgc

SEQ ID NO: 678634 - DNA, 357 bp, Homo sapiens
cccgtcagatcatcctgaccctgctcctacgctccacctgccccttcatttgctctccctcgcgccccgtgacatcttctctctccgtgctgtgtcctttgtaggtcgtgcctctgcacactttctagcatcaaactgggccgtcttctcacacagtttcacttcgcccaagacagcccgtaactggggctgtctaacgcaggcgatgaaccagcgactgccattgacaaaggcctggcgaaacgaaggctctacaacctgctgatagagccacaacagggtgcagacaactgcgatgtcagccagtgacactcgctcgcccaccagaagagtcctcgtcatcaagtaagcatccag

SEQ ID NO: 678635 - DNA, 166 bp, Homo sapiens
atccggacttaactgcggtgtgatgctgttgggggcagtgccctcctaattggggggtaggggctaggctggagtggtagacggctcagaataatcctgcggggggaaacacttctgaggtaataacataggattatcccgtatcgaaggcctttttggacatgtg

SEQ ID NO: 678636 - DNA, 108 bp, Homo sapiens
cgtgcgaaggataggaagtagggaaatgggcgaagagggggaaggattcagcaatatagcacaggtcacagcgttgcacacaaaaacgagcgatacttcctatccttc

SEQ ID NO: 678637 - DNA, 246 bp, Homo sapiens
gcgcggtgaggttgtctagtccacgctcggagccatgccgtccaagggtcccctgcagtcggtgcaggtcttcggacgcaagaagacagccacactttgggcgcactgcaaacgcggcaattgtctcatcaaggtgaaccggccgcccttgagatgatttagccgcgcacgctacagtacaagctgctggagccagttctgcttctcggcaaggagccattttctggtgtagacatccctgtccct

SEQ ID NO: 678638 - DNA, 523 bp, Homo sapiens
gtaatcatggttaactgtacaaatgaatcggtatcaagaatgttccatgttggagtagtttatcaactggagttgggaatggcgcatgtaaataagaaatgctgatgttatgagctgagtcctgaagcacagagagtatacaactttgacgtgcgccagttgaactggttggaatcaattgaaaattatgttctgggagtcaaaaacatacttatcgacaagcggctatggctgggatcccaaacagcaaatgcaacgcttaccaaggctccgaaatattcactacctctttaatactgccctcttccttatcgcctgccgccttctccacttgcccgctctcagatgcctcgcaatgtccggtacttcatgtgtacccttctgtcctacacttcctctcctactttacacgccctccagcacgctcaaagcttcaagagcatttagcccatcgcactttatatctggaacctctcaagatacccttctcaaaccacgcaaacagtgattcccaacgcatgcc

SEQ ID NO: 678639 - DNA, 597 bp, Homo sapiens
taacatcgtgtacctgtaaaacaccatttgctaggacaagaccctgtactatttcctctgaaacctaaatttcggcagggtatgcataatccatacgcatcatcagggtgcagccatcgccatcttgtattaaatctctctttgccaggctcacactcatctcgcctgtatctatggcatgaaaataggtcctacaggcgaccaccccgtctatatgaccagaaatttccatgtcttctgccacaattgtgacatcgctcagcaaattgtaacttcttaattcgttcatgacttttaaagctttcttcatatgccaagaattcactgtccctgcacagtgtttttcggtattatcatcttataaatccagaggcttatgatcaccctcctttgtgcatgcatgaggcagcgccggcgtatccactgtggctcctctaggtcttcaaaacgcaggcaccgaccatcacagccagcaccattccatccgcggacgccggctctgaccgcccgccgaaccgcgttccacacgccacgcagggggcgccgagctctcctcaccgtgcgccacctcttgcggcgacggccaccgagaccatg

SEQ ID NO: 678640 - DNA, 455 bp, Homo sapiens
tatctatggtttacctcgtagaaaactcaggacggtacgagagaatgaagacaacaaagctactgacaattccatctcccagaagcaatcactatatagtataagagtatatgtcttactagtttcccttcacaatggttgaggttatataccatgtataactttgcatcttgctttttctatattaaatatcttcccatgttattaacattaaggttgcatgatattcagcacatggataatctcaaaatttcccttgctgctaagtatgcattgttttcaattatgatgagatgaacctacatatacactctgtcagcataatctgatcagactcacaaatgttttaatcactcggcatttcttggattagtagaatacatttcatccatgtgtctctcattctgctgatggtctttgcctaccctgcctactagaatgtgacttattgcaca

SEQ ID NO: 678641 - DNA, 565 bp, Homo sapiens
  misc_feature (238)..(238): n is a, c, g, or t
  misc_feature (451)..(451): n is a, c, g, or t
  misc_feature (453)..(453): n is a, c, g, or t
  misc_feature (456)..(456): n is a, c, g, or t
  misc_feature (463)..(463): n is a, c, g, or t
  misc_feature (485)..(485): n is a, c, g, or t
  misc_feature (504)..(504): n is a, c, g, or t
  misc_feature (506)..(506): n is a, c, g, or t
  misc_feature (526)..(526): n is a, c, g, or t
  misc_feature (528)..(528): n is a, c, g, or t
ccgccagttgtacacctagtgccgttgggtaccttctcgcgaggagaacttatatttcgatacagacttggccactgtccacaaagaatccggtcagcaccaccagatttccaaaggtgcatatcaaggaagggcaggcgtatgtgcttatatgtttgtattcaatgattgtctttccccattcatttgtctttttagagcagccatctacaagaacagtgtaagtaaacctgctgtngccctcagcaacaagttcaacatcataagagccctgtagaatgacagcctttttcaggttgccagtctcctcatccatgtatgccatgctgttcttgcagtgttaggtcatgtgctgagaggcatagtaggccagcaggcgcatgaaggcaagttgggtagccatttccttgagaagtcactccttctacataatattcgaactggctgccgnantanatagttnctcctagccagacgtgtttctngtcccttggagctcctatnancagttcttggctgggatgtntncaggttaggccccgaagctgtggggtccgagctcgaa

SEQ ID NO: 678642 - DNA, 697 bp, Homo sapiens
gggccgcctgcctgcggcctttgttgcgggtgccggtgctggaggtcgtgcctgggaggaaaaccaattctgtgtcctcggaggaccacagcccagttgtgcccctagtgcgaaacccagcctgtgagcttgcaagtgcacggactgacgtgttcatgcacgcagacctgccgaggacaaggaggaacccctgtcgctcgattatcagcaggcagcagagatgctgtgcagggttccacttccaaacatgagttccaggccgagacaaagaagctttaggacattgttgcccggtccctgtactcagaaaaagaggtgtttatactgggagctgatctccaatgccagcgatgccttggaaaaactgctgtcacaaacatggtgtctgacggccaaagcactgccagaaattggagattcactttgcttgaccaatgccgatgaaagtgcaccatcaccatccaggatactggtatcgggatgacacaggaagagctggtgtccaacctggtggactgattgcagatcgggggtcaaaggccttcctggaatgctctgcagaagcaggctgaggccagcagcagatcatcggccagtttggaggtgggttctactcagctttcatggtggctgacacagtggggtcatttccgctctgctccctgggagcctgtgtacaggtggttcagatgtctgc

SEQ ID NO: 678643 - DNA, 503 bp, Homo sapiens
  misc_feature (269)..(269): n is a, c, g, or t
taacattttttagtataaaaggggaaataggtaggagtaggggggtaggggcgagagtggggggaggaagggggggggttggtttgtccaacgcggtcatttatttttccgtgggtcacacaactctggggacgatacggtgtgactggacgggtggcggtcgtgtcaagttacgatactacgtgactgccacgcaagcatacgagaccggggacgacgactacggacaaccactttcgagaccgtgcgtggtgaccttacggacccgnggacttcacaacgcaacacgacggcggggcgatgtgtggaacactggggcgtataccgtggcaccgggggtttcacaaatacgttgggcaccacacgtgggtggagcgcacgcgcacacactgggcacggtgggccccatacaggacctcacgacgagacaaaccacccgtgaatacggggtggtacgagggacaaaaaacacgtgggctcaggtcatccggacggacccccag

SEQ ID NO: 678644 - DNA, 106 bp, Homo sapiens
tgtcaggcactgatagcttgtcaggctcttgtatgtattttgtggttgtttttaaaccaatgtgatctgaggctcgtgtggacaccactagcatgacagtctaaag

SEQ ID NO: 678645 - DNA, 118 bp, Homo sapiens
  misc_feature (114)..(114): n is a, c, g, or t
gctcggtaccctagttgggtccagagcggtcataggttcctggaaaaccattccaatactgccgccccgaagggccgacatggcatggtccgaggcacctagtagctccttagnggat

SEQ ID NO: 678646 - DNA, 405 bp, Homo sapiens
ttaacacagacagttgacggaccaggaagcttgaatgcatggtgaaagaattggtctttcttgcccgggcttggtggctcatgcctgtaatcccagcactttgggaggccgaggcaggcagatcacttgaggtcaggagtttgagaccagcctggccaacatggtgaaatcctgtctgtactgggattacaaaaaaattagcccggtgtggtggtgcatggttgcattctcagctacttgtgaggctgaggcaggagaattgcttgaaccccggaggcaggggttgccgtgagcagagatcatgccactgtactccagcctgggcaatagagggagactccatttcaaaaaaaaaaaaggggggtttttatctgggaaaagggaggttgcccagttttcaaagcc

SEQ ID NO: 678647 - DNA, 334 bp, Homo sapiens
  misc_feature (223)..(223): n is a, c, g, or t
  misc_feature (242)..(242): n is a, c, g, or t
ctcggtccctgtgtgatagcacaacctagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattngtgcccggtcaggttgttncgtgattagctgtttcctgcgtttgttcatacaataattgttcattattgttctcaacttggggctctccccaacctggggacccttcctta

SEQ ID NO: 678648 - DNA, 241 bp, Homo sapiens
ggcggaccggagtctgtgcttaagtcactaactatatttttatgtaaagtaaacactgacaaacattaacttctctgctgtatgtctcaggccttttaacagcttgcaatcctaacgagctgctgcatgatcgatttaaattacatgtgacataaagtctcttggcattttaattagttggcttttttgggtttttgtttgttttgagacagtctcgctctgtcgccgaaactggagtgca

SEQ ID NO: 678649 - DNA, 262 bp, Homo sapiens
aaaggggggggggggggggggccccccggggttttggggcccccccggtttttggggaaaaggggggggggcgggccccccccccccccccgttgttttgggcgggggggggcccgccccccccccccccccccccccccccctttttgggggggggggggccccttgggccccccccgccccccccccttgttttgttccccccctgggggggggccccgtttggggggggggccaatttcccggggtttggttttcccca

SEQ ID NO: 678650 - DNA, 359 bp, Homo sapiens
  misc_feature (33)..(33): n is a, c, g, or t
  misc_feature (43)..(43): n is a, c, g, or t
  misc_feature (85)..(85): n is a, c, g, or t
  misc_feature (101)..(101): n is a, c, g, or t
  misc_feature (136)..(136): n is a, c, g, or t
  misc_feature (138)..(138): n is a, c, g, or t
  misc_feature (154)..(154): n is a, c, g, or t
  misc_feature (159)..(159): n is a, c, g, or t
  misc_feature (314)..(314): n is a, c, g, or t
  misc_feature (349)..(349): n is a, c, g, or t
tttcggcacagaaaggtcagaatttcttttatngaaacggggncttactctgttgcccagtctggagtgcaatggcaaggtcatngctcaatgtagcctcngactcctggggctcaagcggtcctcccacgtgagncncccaagactacaggtncacancatcatacacgggacagggtctcgctatattgctcagactggaaagttcagcatttttaaatcaggtcttgggactcccgattctgtttttccacagagtcaccatctatcctgacaatgctccatttcatgctgtttttcctcaccttcaatantgctcccccatccccccacctctagggtgtggaangttaccgggg

SEQ ID NO: 678651 - DNA, 1267 bp, Homo sapiens
  misc_feature (441)..(441): n is a, c, g, or t
tttttttttggagcagtaacaatatgtttattataacatccagccaatgaatacaagacacaaaagtatactcttaagttcagggacgaactaagaaaaacactcgagggtggatcacgtggaggtacctatctacaaattaacagcgcttaaccgtacgagtaaaagatttaagccaagtttcaactccagtctgtgggctctatcatcccgagttcttgtcttccccacttgtgggaggcttgtgtggccccaaccaagactgtggttttgtggcccagtgaagtgcactctgtgattcccacttcttagagttcacgaggtgactgtgcgagcccattttgagtatacgcggagtcttgtgcatttaggccgcaaaaaatatttatctccccgagcgtttacacgtatatctcttagaaaatataacgccaaggctcnttccgagggcatgtgtgtcgctttttattagcgagcgcgagggggcacttttacaaggcctctcagaatgattcttaaatctcccagagcggtttgttaatattttctccgtatcgtgtggagtgttaacgtggcattaaagagcgttttacgcacgcatttcacttctacattgtggggccttataaagtcttcacgagaagttattagcgtggcccagagtggcgcgcggggggaaaatagcgctttccaaaagtgtgccctcaggagaaaaagctctctttttaaaatagccacatagcgtgggtctcaaggttcccaaggggaccatgtgtgtctcttctactcaccaatatgttgcaggttggctgaactcgtgtgtaagagggacactaaagattaccaaaatctctgcgtgtgtgtggggctccccacccttcgccgggcggttacaccaaagaaaccggctttataaaccccccgttggtgtttaaagagaaacctttttgtgaacacggttttttttcacgccccccaattgtgggcatataatagagtgccccttttttccataaattgtgttagatcctccccatcacaaggtaatgtggtgtgcttggttagaaaagccctcccgagaaggcaactatgtgtgcggcgacaaacaaatgggggcggggccgaaaatatcacccttatataatcggggggtgtaaaaaaaccacccacacctggtgagtgagtattctccgcacacatttctgctgataggaggagaccaccatgttgttacacaggagtcccgcaaatatcttctcaaaagaga

SEQ ID NO: 678652 - DNA, 1646 bp, Homo sapiens
agtgttttatcttttctttttttaaatttaaatggcgaatataacacagttttcccttccatattcctctcttgcagctttatgcacatctctactaaatcattacgttttctacttcttattacatacaacattctttcacaaacactgcaacactagtgaactctcgtgcacactgcgactctttttccactactccatcttacaacttccctcacatctttcaaactgacatacctttccatcttcttctaactctctacacacaaatctacctctcagctcatcactgcagtagcgctccttacacctccagcctgagtgcggctctccttctccgcgctagcgtggagaccactacacaactcgtgcactgctcaacgtgtctgcgcctcgtctagcacagcctcactaccctctcactgcgctctctcacacagcaccccacacaacaaacgtgcagggcttctgctgcctctctgcgctacacctccagcgcacacactcaaacacaaaactataaacgtgaccaccctttaaacacaccaacacacaaccacaccgcggttttctgtcgacgcgcggcacaacccccacggcgcgcgcttcccccacacacaccctcctcgagcgcatattcccctcttataacccggcccccacgacctctacaacgggcaccagagatagcagcacacgtgcgtcgcacacgagcccattcaaccaccaccgcagacaacaacacacacctgctacatcacccaacattgtgacaaacaaagcggcgactccgaccaccccacggccccgcccgcaccaaccgcgacaccaaagtagccagcaccacaccacccggcgaaccccaccgcggaacctcccatccaccacgacgacacacagcaccacaggaggtcactccagcgcaccacggcacacaccacggcgaccacagacaacaccccccgtcgacccaggcccgcaccgccccacccacctccgggcgacacacacaccgctctcgccccagcccgacccagcgccacccgacagatacacgggcaactcacctggcggcccaccccatacctcgccaaaaaggacctcctcacaaacgcccaacacccggcacacccccccagcagacctcacaccgcagccaacactcaccccccattgatcgctggcaacacaccctcgagtcacagatccactcagcaaccacaacccccccgcagggcgccatcgcacgcgacccctacttcccacacccgcgaaccatcaacacccagtgcgcacacccacaccacgagacacaaaaacccgcatcatcacctccccgcgacacacctccagcggagcagcaaaacaccatcatcctctatcgcgctcactcacacatcctctagcagcatcgaccatcgccaactaccgcatccacagtacatcacatcgcgacatcgtcagacacacagctacaatctcgcacacaccgagctcgcagccaacactcgccgatacataagactttcacacagcaacgagcacatcagcgccacgtagtctatccacactaggaacacgcgatgagcgaacactaagcgcgaacctagcctggaagccacactcacgtaggcgaccgtcacgcc

SEQ ID NO: 678653 - DNA, 561 bp, Homo sapiens
agaaatgtaaagggtcagccaatgatcagctgtgagaaaagaagggaggggaggactgggcttgttcagagagcaggaaaagtttgagaccagttgtacagagtggaacagtgagagaactaaagaaatacaggaggattgttgaatggtgctgacaaatcttttgaagttgatcatcatgaatttatagtgaatattttacctcgaagagtgacttgctccagcagcactcagctgctcttttccacatatgaagagaaccagtgattaggatcacacatgattggaattttgccagatgggtatgatcagtatagttttggacttatcatattaagtcaaaatatcaataaagatcgtgataaaatccaatttttcatcccattataaggacagagaattttcaatattcacctgcccagagtttcctgggaacatggaaattcatctgagaagatgagagagagatgagggaagccagcgtgacatttggacccttggtcataggtcataggtctccagaattactcctctcctctctaagtataatttctgttggcg

SEQ ID NO: 678654 - DNA, 419 bp, Homo sapiens
  misc_feature (413)..(413): n is a, c, g, or t
cgtgtgtagggcagtagggagtgcacctcatggagactgcttggcccacagaaagctgagcaggaggtggcacagtggaaaaaagaagcgtgccaggaggaggcgctgatacccgggaaaggggagccccaggaaccaagtcaacggcaaagggccggtggtcacagatggacctcatctctgagctgaaacggaggcaggagaaggaggcactcatttatgagagcgaacgtgatggggccattgaagacatcatcacaggtaagggcttggccaggccttggtcttatcctcagtctgtccttctatgctttcttctgaaccaatgcgctatcctctgggggactggcttgcacactgcttcttgctaacttttctgtttttctttcctttttcctttctctacccacaancaactg

SEQ ID NO: 678655 - DNA, 394 bp, Homo sapiens
ggtgaaagaattataacacgcgagaacgcttacacgaccgatagtgcagatatgacaacgacacatctttgaagaacggcatatcttctttggataaatggtccaaagaaagtaaatgttttagaaatgagctccttgaaaacagtgccagcatctaacacaggtatactttccacaaaaatggaatgaatgaacattccttgcagtatattaagtatggtaatgattagtgtagaagccatggggctatatagttgtcaatacttatcttatgagttgcattttcaaaactgtgcaagtgaggctatgtctgagcaaatggtagcactctagcctccacagcgcacttacttttatttttgacctttctctcactaatcctaactgccaggta

SEQ ID NO: 678656 - DNA, 222 bp, Homo sapiens
cacacgcaggttgatgcgctgggcgcgggccttgtcgtgcagggcggccgtgtgggcgccagtgttgagggtcagggtgtcgaagaaatggtcttgctcgaccttcacgcccagggcggtcaagcccttggccaggatcgcggtcagctggtgaatgcgctgagcgatctgggtcagtcctttgggaccgtggtacacggcatacatgctggcgatgtgggc

SEQ ID NO: 678657 - DNA, 341 bp, Homo sapiens
gtttttgttccctcaacccatttgggtaaaataacggatctaattagaaactgttttaaggaggggctgggctcggtcgcacgcctgtaatcccagactttgagaggccaaggcggtcacgaggtcaggagttcgagaccagcctagccaacagggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacaggcgaggctccgtctcaaaaaaaaaaa

SEQ ID NO: 678658 - DNA, 100 bp, Homo sapiens
tatcccccagcatggcgtaccgctccgcttatgcccggttactgatgctccgcttactgatgctccgcttactgagctccgaactgatgctccgcttacg

SEQ ID NO: 678659 - DNA, 269 bp, Homo sapiens
gctgccgctgccgcccaggctggaagcccagacacggaatcccgaataaccaaaaggacactgtctgtgaagacgctattctgattatttgacacaggccaggtgctgtgcagagactgaaactcacgctcagctgaggccaccatccagacctgggcagaaagctgaagaacccctgaacagagtacaatatgctagcgaaggcttccatgtggccagagagagtgcacaacccaagcagctacctctagctagagtcacacatgcgc

SEQ ID NO: 678660 - DNA, 898 bp, Homo sapiens
  misc_feature (32)..(32): n is a, c, g, or t
  misc_feature (111)..(111): n is a, c, g, or t
  misc_feature (123)..(124): n is a, c, g, or t
  misc_feature (165)..(165): n is a, c, g, or t
  misc_feature (167)..(167): n is a, c, g, or t
  misc_feature (181)..(181): n is a, c, g, or t
  misc_feature (186)..(186): n is a, c, g, or t
  misc_feature (213)..(213): n is a, c, g, or t
  misc_feature (255)..(255): n is a, c, g, or t
  misc_feature (288)..(288): n is a, c, g, or t
  misc_feature (291)..(291): n is a, c, g, or t
  misc_feature (296)..(296): n is a, c, g, or t
  misc_feature (305)..(305): n is a, c, g, or t
  misc_feature (309)..(309): n is a, c, g, or t
  misc_feature (321)..(321): n is a, c, g, or t
  misc_feature (351)..(351): n is a, c, g, or t
  misc_feature (385)..(385): n is a, c, g, or t
  misc_feature (394)..(394): n is a, c, g, or t
  misc_feature (401)..(401): n is a, c, g, or t
  misc_feature (407)..(407): n is a, c, g, or t
  misc_feature (420)..(420): n is a, c, g, or t
  misc_feature (422)..(422): n is a, c, g, or t
  misc_feature (441)..(441): n is a, c, g, or t
  misc_feature (445)..(445): n is a, c, g, or t
  misc_feature (450)..(451): n is a, c, g, or t
  misc_feature (453)..(454): n is a, c, g, or t
  misc_feature (461)..(461): n is a, c, g, or t
  misc_feature (464)..(464): n is a, c, g, or t
  misc_feature (472)..(472): n is a, c, g, or t
  misc_feature (476)..(476): n is a, c, g, or t
  misc_feature (486)..(486): n is a, c, g, or t
  misc_feature (490)..(490): n is a, c, g, or t
  misc_feature (514)..(514): n is a, c, g, or t
  misc_feature (690)..(690): n is a, c, g, or t
  misc_feature (887)..(887): n is a, c, g, or t
tttcttgttaaatttgcatttgctggggaacnggtgtgtataaaaccttaattaagtataagctctgatcttcatcgtggtgcctattgggtatgtgatataactgcagtntcccttttgggnnggggggaggggatttctttacaccaagtcctaatgaaactntnattttcactttttnctttnagctatcaacttaggacttggcaaaanaatttttgagggtggttcaatagaggatgcttcaccactggncactcactgtcatcaaggtgctttagaaaattnaanacatngcacaaatntttnttctcttctctncaagttatcatgacctgcataagagatggnaagctgattcacatgtttacagtgatcagcaggnagaaatgcnctaatgnaacatnccttttacctaanangctaaactacagccatatnctgntttcnntnntttttgnganggcttcanaatntccaaatgtnaggnttcgctgtacaattgtcagttttngtctgactttttataaagggacactgcagtatttagtacaagttcggatgcacttttttgaacatctgatgtcttacaaaagtaacatcttgctaaactattatacatccaaataactacaatatctgaagaagcaaggctgctttttcagccacaaaatacgacaaaagcaaggnctgttatgatggtcatgaggaagtcttacaagcctctgaaactaaaggcaactaagaatgttacatttggtatattaaaatcttaccctcatatcatatttaacaagccttgcttttatctacaaagattttctatgtacagtacagacagggtatagttcaatcctctgctactgaggtagttaaccaaccctttnaaaaggttctg

SEQ ID NO: 678661 - DNA, 462 bp, Homo sapiens
actgtgttatcgctggttcttcctgaggctccaacactggggcccctcatccggtcttcatgctcctctgatgaagccaatccaggatgagcatatcccaggcctgtccctttcctccagccagtagcctgttggacacagcctcctttgctgctagtgtcgatatcttctttatcaccaagtttacgatcactgtcagtttccctggagtacttaatccgtattcctttctggagagtccaaagactggagcttttccctgcgatcatttcctcttcctttaaagttaccctctcgttctctcctttccagataggctagctcctgctcagactgttttatcttccggtggatttaccaggttttgcttgtgcacggtctgacagctgctggtgttcgatcagaactactttattgggaaactgccttctgcacagcacaacaagccagtttattccagtc

SEQ ID NO: 678662 - DNA, 843 bp, Homo sapiens
aaggtcgtagtatagctgaggtgttactcggacgagggcactgcgcatgtaagactgtggccagtaactgtatttgtgatggctcgcggtggcagtggccatggaggccgtgctgaacgagctggtgtctgtggaggacctgctgaagtttgaaaaagaaatttcagtctgagaaggcagctagggctcggtgtccaatgcagtcacgcagtttgagtacgcctggtgcctggtgcggagcaagtacaatgattacatccgtaaaggcatctgtgctgctcgaggagctgctgcccaaagggaggctagggaggaacagcgggattacgtcttctacctaggcctgtgggtgaattaccggctcaaggaatactgaggaaggccttaaatgtactgtcctgcgggttgctgcacgatcagagcccgagaacaagcaggccaaggaactgtgagcgggtcattgacaaggccatgaagaaatgatggactcgtgggcatggccatcgtgggagtgcatggcccctgggatgtggcgtggactggtccggacgtcattcgacaattgctgttgttccaaatgtccaaatcctgaaggtcgactgcgggtagctccacgtagaaaccaattccaaggagggccctgtccatccatcgcttgtcctttccctgttctcccccttgcccccgtctctatcctctgtggccttcagctaaatttctgcgtcccctgagattcgtccttcagcccccatcattggtgcttttgggatgagtgtacaattaaaacgggggcttgtgggtttggggaacaaacagatatctaaatcaacacacaaaatcctc

SEQ ID NO: 678663 - DNA, 167 bp, Homo sapiens
cgtggcgagccgctcctcatggacgtacactgctctttgagagatcgaggagacgcgtggtgccctctgtcatcaccagtttggaggccaccgatggctgtgaggagagcatctaccgtcaagcataactccacattgtcagctgccctggtccctcttctgggcag

SEQ ID NO: 678664 - DNA, 643 bp, Homo sapiens
gctgggaaggggacccacccgagggtccagccaccagccccctcactaatagcggccaccccggcagcggcgtgcagcagcagcagcgacgcagcgtgctgacatgctcatgatgcatgggatggcctgctgccacctgcgggcctggccggagctgggcatgccccagtgccccctccccgtgtgcaccctgctgttcatgcaacgcctggtggcctggtgacccagcatgtctccccctgccgccgcctgccgcctgcctttaaatccatggaagtggccaacttctactacgaggctggactgcttgtgctgctgcgtacggcggcaatggctggccgccgctggaagccccccgacggcagacccggggccgcgcccaccccaaacggcgagctgggcagcatcggcagagcacagaagcgcagccatacgacgttcagccgcgtacctggaggccgctgggcgcgccagaaggcccccggcagcaccgcacaaccgggacagcggacacctttcgagggcggcttccggacacacaggaccaggacaagaagccgggactcactccagggcaagaacacaagagtcgcgccaccgaccgtcgttctcgcgaggactacagacgcagaaactgcaaaag

SEQ ID NO: 678665 - DNA, 1062 bp, Homo sapiens
tgtgcaagaacctcaggacagaagcgagagcccattgctcctgctccgcagccgggctgagctgagcaggagcaatgggctctcgcatcaggtcagccctggctgctggagcgaacccattgagcatggcagagacctggaggtgtcaggagagctcaaacatccatccatcataacacagcagggcatcccagaagtccccgagaagagccttgctgacagctagaagcaggagttgcttcatagagtggacgagtggtcaacttggcggaagcgggaccttggcacatcaaccattccaataccgtgattgcgctgtcatcccatgaaccagtgactactggcagagataagagcacagatcagacaatggagcagatagacttcccaatgcaggaacaagaaatgctcatcccaccgtaagagacacaggcaatcatgaggatccagggacatgggacatgagcgtcaccagaggacaagggagatatcgaatagatgcattagtcaagtaagagaaatacttggacgcacatggcaaaaaagaaaaaaaaaagaaaaaaaataagaaagaaataaaagagaaagaatagggaaaaacaaagaataagtaaaatgtgaaaaaatggtacaaaagaaagaaaaaatataaacaaaaaaataaatgtagaaaaaagggagataaatatagaagaaaaaacagaatatagagagaaagaaataacataataaatatggcacaagtttacacaccgtacaataagtgaagaatcgtacacaaagaccgagaataaatattaacaattacaactagatgcataaaagttaataagaataaaaaaagaatgagaataaaaaatcacatgagtaaaacatacacactaatcaaaatagaatagcataacattaaataaataagagaaagagaagtatacgagaaagagatagtagagaagagagaaggataaagagaagaagggaggaggtaagtagacataagtaagagagaagagaaagtagagtaaaagagagcaggagagagggagaaggaggagagagatg

SEQ ID NO: 678666 - DNA, 821 bp, Homo sapiens
ggtcactaggtcctggtcttggggattgacagccacgggaagccatgagcgtgctccgcctcgtcaccttccatggagccacccgtcttggaggtgtgggctggcgctgcgtgcacgcgtgctccatatcctgctgtgagtacgtgtcatggtgaaccgtggtacgacgtggggtgggacgatctctagatattgcacagatgcacgacccatgtaatggtagcgaaggatgcctgtgtggatgaaggcatgcatctgaggatgtacaccgcagccatgatcctgcatgctcctgcaagacatgtgtccatcttccaaccgcggatccatgagaccaatgaatggcctcgcgtcgatggaaaaggcatggtcggccctggcgagcgggtgtactatcgcgttggtggcgaacatacgcacgacccaagtcttcttccatctactcggccaaatcgaggcgatcgcaacaccgtggaaagggtcgggcgtgacagtgacggccccccacaaacattttctcgaaacaaacgacgcgtctgacctaaagggatgacccacccctgatggctttgtaatcccgtgaggctttggaacccgtggaacatgaattccctttgccgagcgccaatagctgaaattcgaccccgtgaaaccaatggtttcctggaccccaagttttttgcacccaacaagcggtggatccaatttggaattcccaaaaacacctttctaataatgggcaacacgagggggaaggcggaaaacctctttttggcttggccttgtgggtaaccaaatttggaaaccataacgaacattag

SEQ ID NO: 678667 - DNA, 345 bp, Homo sapiens
gaaaatccgtattaacttggatggacggcatcgaatgctacctctgagtcgttacatggctagtgttctggcctgaaagtccgtaatactggtagaaaacctaggatctcatgtcaggacaaccgtacttctgcacgatgtacactgtcactctcaagtcatacaagcattcaagatccctgatggcccagaccttgtcatctctgatccatgtgcgggatgacctgctactagtaagcactatgaaagctaaccagtcatcagttagcaccgtaaggatcttactgctagatgatttctggcaatgtggtcagtatctactagctccatgactaattgtgactt

SEQ ID NO: 678668 - DNA, 152 bp, Homo sapiens
caactccatgtcccggtgagactgagctatttctcggatactgtgaatgaggacccctgctgcctgcccaaacgggtccatctgggtggcctcctcctcggacagcatctcctccactggatgagggcatggggccactggatgagggcatg

SEQ ID NO: 678669 - DNA, 290 bp, Homo sapiens
tcgcctgcccatcctgtagctgtcttacatattatactgagagaaatgggcaccaaacaatttgttgaacaaaagagagaaagcaatacatgtgaatgaacgccacatacaccttttacaaagttgacaaaaacctaaggtaatagatcattatatagcctctgtctgccatctcctctcttaaggacgcatgctcagaacttcttggatgctctgataactccagctctgaccgacatatgtttacctttgttggcccggtatttcccgtactttgtgcggcctttgta

SEQ ID NO: 678670 - DNA, 109 bp, Homo sapiens
atcgtcctgcctgctctggcacccagccaattcctcctccctcccatcgagcctgttgtcgcctcctggaagaactcttccctgagtctgtgacctcccccagcacatg

SEQ ID NO: 678671 - DNA, 178 bp, Homo sapiens
gcctgtagtcctggccttcaggaggctgaggcaggaatatcaattgaacccaagattatgaggctgcagtgagctatgatcatgccactgtactccagcctgggaaacagagcaagaccattttttaaaaaaagagagagagaaaaaggaaaagaaaaaaaagaaagtgaaagaatga

SEQ ID NO: 678672 - DNA, 169 bp, Homo sapiens
ttggtcatgatatagatgcggacagagcagagagggtctgtaggccatggacaagagtgagaatttactcaatacacagctggaagttggggatgagggagaagcaccagagtggcacactgatttctacaacagtcagtctagctgctgggagcagcagggaaagaca

SEQ ID NO: 678673 - DNA, 336 bp, Homo sapiens
attcaattgcggagccatccctacagtgctagctactcgggaggctgaggcaggagaattgcttgaacccgggaggcaaggttgcggtgagctgagatcgcaccactgcactccagactgggtgacagagcgagactccatctcaaaaaaaaaaaaaaaaaaaaaatttggaaaacagagtattttttaattctgcaagagctttacagccttttattccattattgttttggattttaaagattgatataaattttagggggtggatttccattcattgggaaatctcctattattggcgggttgtaattccattttaggggagtgtgcattaag

SEQ ID NO: 678674 - DNA, 306 bp, Homo sapiens
gatcccaggactcctcagtgggttaaggatccggtgttgccctgagctctggtgtaggttgcagacacggctcggatcccatgttgctgtggatgtggtgtaggccggcggctacagctccaattggacccctagcctgggaacctccatatgctgtggatgcggccctaaaaagacagaaaaaaaaaagtagattacatacacatttgagttgcattatgtgtttattgtgtgagtgtgtgcagacacacatgcgtgctcattgtgagagcagcccctcccagtcccgaggaaatccctggcacc

SEQ ID NO: 678675 - DNA, 490 bp, Homo sapiens
cgcacgacgagacctttaaatacgcctgtttttcccacgggctagtgagccttatctctccacttcccaggcattgtgaagaccctgtttctctagctgtgcagctgcaaggtcactagacagataatctcaagtcgtaaagcatgttgttccttaaaaagtaagaaatgatgtaatgcatgtcttaactgaataactgtctttgtttcttgcttctgtaatacgcttccccctgcacagatctacccccaccccacgaaatgcttaaaaggtagcttgactttttgttcaaggctcagtcctttggatgttaatctgactgggttgatgcacctaaacaattaaataattccacctcaacccctccggtctctctgattccttaattatcccgctgcagtgtctctactaaaaatgcaaaaaattagccaggcatggtggcacgtgctgtagtcccagccacttgggaggctgaggcaggggaatagtt

SEQ ID NO: 678676 - DNA, 469 bp, Homo sapiens
  misc_feature (64)..(64): n is a, c, g, or t
  misc_feature (86)..(86): n is a, c, g, or t
  misc_feature (153)..(153): n is a, c, g, or t
  misc_feature (309)..(309): n is a, c, g, or t
  misc_feature (407)..(407): n is a, c, g, or t
  misc_feature (464)..(464): n is a, c, g, or t
cagctcgggaaaaaaaaccagcagaaaagaaaaaaccaggcgttgaactccaccaagggggagntgaaagaggacgacccaagggnggggcaatccaacgccccgaaaaaagcgcctgcaaaggtggaggtggccgatgaaaccaaatgatgntgtttattcaagaggagaaagagaaaatcgctgcagcgacacaagtgaccctgggcgcgtgcagccccatgaatcttctccgtgcagccccttggggcgcgaccttgtgcgaggccctcggggcccacccacagcggcccagggccagaccctggntggaagccagaacgcagactgcaggggccgcgcccggctaaaaaaaagacccacccccgggaagataaaaatcacttccttcaatgtaagactttggnccgaaatttctacacctgggtgtctaagtccctccccctccaagagcccattaactnattta

SEQ ID NO: 678677 - DNA, 269 bp, Homo sapiens
acggtgtgactcgatatcacctatacgttattcattaatccatgtattcaacatgccttttttttttcacttttctgtcctttcagggccgacactctgcggcatatggaggttccccggctaggggtctaataggagctacagcgtaagacataaccgcggccgcggttatgtctcacgggatgagtagcgctctgaccgccatcgattgtcaggatcatgttgctgttatttacccatttgaccgtgagcgtaagacataaccgcgg

SEQ ID NO: 678678 - DNA, 576 bp, Homo sapiens
  misc_feature (5)..(5): n is a, c, g, or t
  misc_feature (25)..(25): n is a, c, g, or t
  misc_feature (91)..(92): n is a, c, g, or t
  misc_feature (119)..(119): n is a, c, g, or t
  misc_feature (124)..(124): n is a, c, g, or t
  misc_feature (140)..(140): n is a, c, g, or t
  misc_feature (242)..(242): n is a, c, g, or t
  misc_feature (313)..(313): n is a, c, g, or t
  misc_feature (372)..(372): n is a, c, g, or t
  misc_feature (458)..(458): n is a, c, g, or t
  misc_feature (480)..(480): n is a, c, g, or t
  misc_feature (489)..(489): n is a, c, g, or t
  misc_feature (494)..(494): n is a, c, g, or t
  misc_feature (511)..(511): n is a, c, g, or t
  misc_feature (540)..(541): n is a, c, g, or t
tgccnttatggtctcatgctcttgncccactcccaagggttgaaatcacagtagcatggtttgtggtctacaccacaagttcttgggaatnngcgactaaaaccctggtggaaaaaagnagggncctgtcagttctcagnggagaaaaatgaaggatccgggctctgaagatgattctgctcctcttccctctccttcccaacccaggtgatcatggtaacaggagatcatcccattacagntaaggccattgccaagggtgtgggcatcatctcagaaggcactgagacggcagaggaagtcgctgcccggnttaagatccctatcagcaaggtcgatgccaggtgagatcactaaagaatcaagatctgncatgttccctccatccccaggctgcccacccagatgcacttttactaaagtcttgggagtttctttcaatagggtaggattgtgtnggggtttacaattacaaaggtnaaacattantaggnaaattaaggtgattttntcaagggggtttttcaaaggggaggaaannttaaggaaagggggttaaaggggagggggggggtg

SEQ ID NO: 678679 - DNA, 165 bp, Homo sapiens
ttttttccaggaaaattggaccaatttaaaaattaaaccaaagggggggagtcttctgttaattccttttaaagcttaatgttaaatggatgaccaataaaacagtcattgttaaaagggaaattttaaaagggaaacattgaacatgggaaaactgtaaaatct

SEQ ID NO: 678680 - DNA, 280 bp, Homo sapiens
  misc_feature (38)..(38): n is a, c, g, or t
gtcgtacggttcgcatgttccatttatagatgaggaantgagctagagaggttaaaaacttgccgagagccagggtggtggctcacaccgtgtgatcctagcactttgggaggccaaggcaggcggatcacctgaggtcaggagtttgagaccagcctggccaacatggtgaaaccctgtctctattgaaaatagaaaaattagctgggcgtggtggcacatgcctgtaatcccagctactcaggaggctgaggcaggagaatggcatgaacccgggagg

SEQ ID NO: 678681 - DNA, 435 bp, Homo sapiens
  misc_feature (10)..(10): n is a, c, g, or t
acttttgctntggaaaatgcgtccacgaatatacttctctccctagggactgggaaggaggaagaattgtgcagcagggagaggtgaaggccccactggagagaaggggagcccggccagggtcaagggggtttgtccctatctctgtgaccccctcctcccacctggagttctccgctcgacgttcatcttcctgaccagactctaccctcggcagggcttttgtttgtggtttggtttggtgatttcctacttatttcaagcctttgttgctaactcattcctacttgggcctgagcctttggggaaagctcgctcccaggggcaactcagtggagctcagcagtcccagctctccttccccaccctagcatatgctcagcacccaagcagagcccagcctctggtgagtgctcattaaaccttagccaatga

SEQ ID NO: 678682 - DNA, 107 bp, Homo sapiens
  misc_feature (45)..(45): n is a, c, g, or t
  misc_feature (74)..(74): n is a, c, g, or t
  misc_feature (76)..(76): n is a, c, g, or t
tacggcgacaacatcctggccatcatggcaatagcggcagaaggngaagaccatcatggaacaggtgatgccgnanagcctggccatcacgatgccgcggctactga

SEQ ID NO: 678683 - DNA, 106 bp, Homo sapiens
cggcccgagaaagatcagcctataattcttgtgctgttggatatcacccccatgatgggggtcctcggacggtgtcctcaatggaactcgcaagagctgtgccctt

SEQ ID NO: 678684 - DNA, 458 bp, Homo sapiens
  misc_feature (6)..(6): n is a, c, g, or t
cacccnacaggatcctcccctagaagttcagaaatttaccccaaaagaaaagaggtagtactcacagccagggatttaatcaatacagatataagtaagatgtttgaactagaatttaaagcaatgattataaagatattagagggcttgaaaaagcatagaaaatcccttcttgtagagataaaagaactaaaatctagtcaagctgaaattaaaaatgctatttctgagatgcagtcccaagtggaggcccataaaaataaagatgaacaaatcagaaaagtgaatcagtgatatagaaaacaaagttatagaaaataaggaagctgaaaagaagagggaaagaaaactattagatcacaaaggtagacttagggaacacagtgactccataaagcaaaataatattcttattataggagtctcagaagatgaagaacaggaaaaatgggtaaaag

SEQ ID NO: 678685 - DNA, 734 bp, Homo sapiens
cgtggacttgaactcctgacctcaggtgattcaccaggctcggacctcccaaagtgctgggattactggtgtgagccactgcacctggcctattattatttttaaattttttgcttgtcaagttgatcattcttgggtgtttctcacagagggtgattgggcatgggtcgacactgacacctagtggaggggaaggtccgcagcataagcataggtgatcaagggtctctggtctaccgtaggcagaaggaaccctgcggaccattccgcagatgtcttgtgtccctgaggtacattcaaattagggagctggtgatcgactcttaaggagcgatgctgccgttcaaggcgatcttgtttagcaagagcacatcttgctctgcgccttaatccatttagaccctgtagtggactacagcacatgtttcagagaagcacagggttagggggtgaggtcgtagatcgcagcgaggatcgctacggcagagagaatttgtcttgagtacgagagacaaaatgaaggtctcgccatgtcctagctttctttcttacaaccatgacacaggaacgaaatctgattactctatcttttccgccaccctttcccgcctttgtgtattccatcaaaacctgcctatcgtcaatcatggcctgttctccatgagctgttggttacaggctcccagatcggggtggcgggtgggcaagaagggctccttcactgtcccgcatgg

SEQ ID NO: 678686 - DNA, 545 bp, Homo sapiens
aatggtccagtagggttgaagtttatatttgcaagagcttgaaggctggcacggtaaagtacactcctttagtcacagagggaagctctgaaccctcagagcagccatatgagagggcagagcatggtcatcagcagcagtcagaggggtccccttgtcctgcccttttgcaagggttcaaggctggtgcaggcctggggcttctgtcgctcagcagttcaggggtggtcgcagaaatgcggcaagtatagtggttctgtagatagtgagagcgacattcctagagatatgctcatacagaccctcagacagcccgagaaatatggtcatacggtaggtaagttaaggtaccgacttcgatataaagacaatgtagcagtgggaatggtttgtgctgactgagtatggtgaagaagcagtctcactcccttcttaatgtctatagatcaacattgaggtaagatatcaggacagggagctgatggaacacatcttgacacctgaaccccgtcccccaacaagccttgtgccgaattcagcgcgag

SEQ ID NO: 678687 - DNA, 136 bp, Homo sapiens
ttggtttacctattaaaccatcattgactatggaaatacttactaagcaatatagagacagacaatattatttttccccatccatttcaccaagagccaggtcccccactcaataaacccttacattcttttttca

SEQ ID NO: 678688 - DNA, 317 bp, Homo sapiens
tcccgaggcttcaacggaactttcccgtaatctgtcccctcttacggaagctagctcgtccgtatctgtccatgggctatcttctggagacttctaggatccagaagagtatgttatcaatatctcaagcctaggagaggtctaggagtagagaacagctctgagaagatactgttgtccaactgatctccaggcaccagggagtcggttccctccaatcaggaaggtcggaatctcgtgatgtcatcgttcatgccaacctgggaaccagtttgaaaaaaaacacatgtaactgccaggctgatctcttgtcctgg

SEQ ID NO: 678689 - DNA, 161 bp, Homo sapiens
  misc_feature (155)..(155): n is a, c, g, or t
  misc_feature (157)..(157): n is a, c, g, or t
cgtggccggcagtcatctagcggccgttcagaattataaggtgtctgtgcagagatttgaaaaatggcaacaaattgaaagtgtcagcatctttagttcagcctctggctgtggaatatgtagattacttttcctagatcttgcagacattaaantnacta

SEQ ID NO: 678690 - DNA, 175 bp, Homo sapiens
cagctgcacaaggatggtctggaacggaggcgtccgggaagcagggcggagagcatggccagtggtgggcttcggccgcggttctacctgtggccactcactctcggacgtagaccctggtgcacacaacgtcatccgccgtcatggtcaggatcagctccccatcggtgtccag

SEQ ID NO: 678691 - DNA, 520 bp, Homo sapiens
  misc_feature (348)..(348): n is a, c, g, or t
ctgccgggtttcgttgctgcctttgtcaacattcatttatggcttcttagcgtcacttccatacatcctgcctgccctgagaacacttagtgtggcaaagtaagtcataggtatttgctgcaggaaaatcagaaaattcaagtcagatgaaaagaaaacagttaaaaacccaggaactccctggagagtgcaccctgctggtgcctccactgctcgtgcccccccagcgcccccgcaacgtgccctgcgtgactttccgcagcgcctgtcgggtgttttccactcagcagcttgttgtgaacgtctctgcgtcctgtggtttctctgtcacactaatgattttggagncattatttcatacttttacaacaatgtctgttgctggacgtttacgtcataacaatttttcaaatgttataaactgtgaacacttgaaggtaaacttttcacagttgcctgatgaattttctggtgcgatctaattttcccaaatcgcctccagtccaaggggaatggtggt

SEQ ID NO: 678692 - DNA, 1036 bp, Homo sapiens
  misc_feature (488)..(488): n is a, c, g, or t
ggcggcgcacaggtcctaattcgggagacgctgcgacttgtactagttgcggtgctgtgtggctactagatgcaaagcccggttcgtctagtgggagtctccagggtctgccgaatacacgcggcgatggagaacggcaccgtggccctacggacatgaacgtccagcgctgataaggtccaggatgaccgagagtcagcgagggggctggcaaaatcgactttcccagctgcctagagcgcaagggtactttttattaacccggctgcaggaattcaatcgggacctgacatgtgctgtgatcaccggaagtttgcctcgcattcagtcttgggggccaaaggaatccagatcgaaggttccaggagagaaaggacacgcaaaaagtggtcgtggacttgtcagagcaagaggaggaaaaggttgctctgtcggactagtggtcctgctggggctcacggtacgtgcacttgcgctcatcgaccagncggccggaggggggtacggatctcgttgagcgcacagggactgccgtgtgtcttgggacggcgcctgggggtcttccgggccctacggttgccattgcgccctcgtgctgctgcaggatgcctgtgctgctgcattggtgcggtctgcggagggatgcctccacccgtgggctgctggctcttcatgcgcgcgtgatgtcccgatggtgccaaagaccgtggaccagctggtggcaagacagaatccaggcagagtgtcccggaatggctgatgttagcaagcacgcagagggttgtctggggaaagagtagagcgtacccgagtctggacccctggttgcaggcccaaccaacctttctggccatgacgcgtggtccgctgtgacctcaagaacgggttgcgtgcttatacttaacgcatttagagtgagggcaggtgcgatgatctgccggaaaaggaggggggaacaaatcggtatcctcgtgtgcagtaatattatttcctgcaagaagtctagtatactgaaatagcgcatcgattgtcctca

SEQ ID NO: 678693 - DNA, 156 bp, Homo sapiens
cgtctctagagtatccccctctgagctgttaagacacgtagtttgtcttaccgaccccctcaggacgcgcaagtatgaccgtttggatctcattcgtcgatctttgatagtatgtctgcagtcactccccacgagccaggacaggcgtcaagatac

SEQ ID NO: 678694 - DNA, 87 bp, Homo sapiens
accagtgcaccttcatttggtacaaccagtggcgggctctttgataatctcagtgataccttgaagaagctgaagataacagctgtt

SEQ ID NO: 678695 - DNA, 374 bp, Homo sapiens
tggccctgggcggaatgagaagcagaggcgccgtccgtcctgccgccgaagtccgcagcctcgaacgcaggggagtgcgaggtcggctgcggacggacggacctggagaccgcgcttgggaaaccgtggcttcggaggagcgtggtgtggaccccactgcggggcgcccgcacaggccacgcagagcatgaacccgactgggctcccggggctgggtgcatgggcgggggcgcggcgcgggccggggtttctttttcgggggaataggcgtgcccttgcattacggtggtggtagctcacaactctgttaatcgtgtttttacagggtgggtttcaggatgtgtgagttatatctcagtaaagcaattatttta

SEQ ID NO: 678696 - DNA, 275 bp, Homo sapiens
actcgtggcgagcactgtactccaatctggtgacgagccagactccgtcctcacaaaaagaaagaaagacttaaatgtcagacctgaaactataaactactagaaaaaacatagagaaaactcttcagaacatcggcttaggcagataatttatgagatgaaataccatgacaacacaggcaaccataagcaaacagtggacaacatgggatcacattcaagttaaacaatcttctgcgattgcagacggaaatatgtacacgtgatcgaaccaa

SEQ ID NO: 678697 - DNA, 186 bp, Homo sapiens
ctactgcttctgcctgatcaggatggtggtttgctgaacgctggggtggctgtggcaatttcttaaaataagacaacaatgaaatttgctgcattaacttattcttcctttcataaaagatttctctgtaggatgtgatgctgttttgcttcctgttctgccttgcttcctgcttctgccgcggtg

SEQ ID NO: 678698 - DNA, 101 bp, Homo sapiens
aagaaatgtagtttttgtagacatgggcactttcttattaagttctgtatgtgcatttatagagaaaactgaaagtctgccactgatttgacagcattgga

SEQ ID NO: 678699 - DNA, 520 bp, Homo sapiens
aaactacgacccccacctgcggccggctgagcgcgactcacatgtggtcaatgtcagcctgaagcttaccttgaccaacctcatctccctgaatgaacgagaggaggccctcacaactaacgtctggatagagatgcaatggtgcgactatcgcctgcgctgggacccaaaagactacgaaggcctgtggatattgagggtgccatctactatggtctggcggccagatatcgtcctggagaacaatgtggacggtgtcttcgaggtggctctctactgcaatgtcctcgtgtcccccgacggttgtatctactggctgccgcctgccatcttccgctcctcctgctccatctctgacacctacttccccttcgattggcacaactggtcccctatcttccaatcccagacttacagcacccgtgagatcaacttgcagctgagccaggaggatgggcaagccattgagtggatcttcattgacccggaggctttcacagagaaaggggagtgggccctc

SEQ ID NO: 678700 - DNA, 974 bp, Homo sapiens
gtaatatgccagccctcagttctgcttccctttctgagtccacaaaagccagatgtagaagacataacacctgtgtcgatctggaaacaaaaaaaaaaaaaaaaaaaaaaaacaaaaccagacaacgaacaccacagcacagccccccgcgcgcgacaaagcgggagggagagccgagcacacgacgacgcaagagccggagacacggaacgaagaagcacggaacgacaaacaccacagaatatacaaccgagacagcacaccacgcagcgcgaccaccacacaagcacaccaccacaagcacaagcaagcgcgtagtaggaacacacagcagacagacagccggaagcagagacaggacgacgcagcaacttacagcgccaagcacagcccaaagacgagaggagaacaagagacaaagagaagagacgggaaagagagacccgcaatgacaggcacagagcagagcaaaccacagaaagcagagcgacagaagagatagagcagacagaccaagcaagacgacgccgcgacagagagacgcgaagagcgaggaaaacagaagaaaacaggcccggaaaggaaaggcaacgaaagccgacagacgagacaacgagacgaccaacgaaacacatcaagagagaagacacatcgaacgaaaggacacgaagaagacgaacgaacggagaagcaagagacagaagaaaacaaacgacagcggagaagaaaaacgacaccaacagaagcagcctggagaacgcgactgaaggagaactgagacgaagagacgacgacacggaggacagcggatgcgacgacgacagagaagacgcggagcgagacagagagagacgacacagagtatcagagacaagaccgaacagcgcgcgaaccaggagatcacgcagacccccgaacgactagtgcgctaggtgcagattgaggagcgggagccggagcagagaccagagaat

SEQ ID NO: 678701 - DNA, 667 bp, Homo sapiens
  misc_feature (137)..(137): n is a, c, g, or t
gtgctcgtgagattaccatattacgtggggaggggccaagttgcttctctgaccagatccaatacgtcccagaggggcgtatttctttttagagaagcacagctggcagggccagtgttagtgaaaaaggagggaanagtccaattttcatccggttaacaaggatctcagccgtatatgaatgggggtacgagtaggacccctggtatcgccatcgtacccaccaaggcacaagagagggttctgtacccaaccaaggtagagcccagcttcacatttacgagcggcctccctcccacattctgtttgtttttcctggtaggctaagtttggccagtgctaagctgcccatcgagaaaccttgtacaaagagtagagtgttgggcacgggattttaggaaatctcgcattcatgtattgaggcacaggtcgagctctgtaaccgaagccgttcctgggttgccattggtgtcgaaagaacgcggcactctcccttggcccggtcttataccacacaagaagccggtaacttagtcgtgtgagcacgcattcataggctcgtgaacacgcggggcaagttgtactgcacccagttttgtaaaaccggcccgatatggtcatgccccttcattgacatctgacccacgttgtcatcctttcacaggca

SEQ ID NO: 678702 - DNA, 534 bp, Homo sapiens
aagatcacgtgtgtatcattaaacaataattcccccttcccaactttccacagcctctggtattctactttctgtccctatgaatgtacctattgtaggtacctcaaacaagtggaatcacaacagttgtcctcctgtgtctggcttatttcatgaagccgaatgtttccaaggtccatcatggtatatagcatatatcaagactgccttccttttaaggccgagtaatattccattatatgtatatacaccattttgtttattcttctgttgatggacacttgggttgttccacctttggctattgagaatagtgctgctgatcagacgcagtggctaatgcctgtaatcccagcactttgggaggccaggtgagaggatcgcttgagcccagaagttcgagaccagcctgggcaacatagcaaggcctcgtctctacaaaaagtttaaaaattaggcagccaggcatggtggtatttgcctgtagtcccagacactcacggaaggctgaactgggaggatacacacgtactt

SEQ ID NO: 678703 - DNA, 1101 bp, Homo sapiens
gcaggaagcctaggtgtcttgagaggccccacaacgatgccggaggctaccagagactcttgcgctcctcaccagaaatcccgtgggcgttctcaacaatggtgaacgtcacatcaatctgtcacgagtgatcccgtggatgtgtcttgtggcacaggtagatccttgtcctgggcccaatgcaatgttgcgatgatgctttattcattgactgcagagtgtgtatgcgatatcttcttgatgtgacgtgtcgaggatgttgcgagactgggcatggagtaccaaaccagatcgtactatcatgaaagaataatcgctgtccaagaggggttgaataatcactgagggtgatggtcaactgctagaataggatgtgaatctgatccttatataccacaggatggggcagatatacgtgagcatattgcctccatcatgagaccattggtagagcgaagcaccatggggatcgacgagaaaacggtagtaggcttttggcattgccctctgcatgtgaatccttgccccccgtgacttcctcgtagagtaccttgcaccaaggagatgaagagaatgattcagggacaaagccttggagaaacttgaatatactttcaaaaggccatgtagctgcagcatttctcatgattccggtaacataagcgttctacagggtctctaagtttcaaaaccgaagagtgacctgttaactaagattgttctaagacgcccaaagtcaaaccatttcttgatggcgcacagtgttcccgcttggggacactaactggatggccatggacctaatctaagctcaagagacgttgtatcatgagagagtaaacgctgaggattaacacctgcgaaggaaaagatatacatatgaaaaaaattgtgaggaagatgaatgaacaggcagctgcacgaacagcaaaaacaaagcgccaaagggcgaaacggggccccaatgaggtcccaaaagaggaacagccagggggcccagaaataccctggtacacacaagaggcgaaaacccagggagatcaccctaaagaaggaaccggaaaatactgtacacaaacgccccgataaccccgccaaccg

SEQ ID NO: 678704 - DNA, 288 bp, Homo sapiens
cggatcttcctttcacttatttgcatgtatttaacttactcctttgtcttagaaggctaaaacagttacgggacatctgaccagcatcttagcattcattccctcatcattcaggcagcaagtatttattgagcgcctacaatgtgcaggcagttttctaggtggtgggtataaataagtgaataaatagaccaaaaatccctattcgcatggactgtggttctgacgggggtgagggcacagacagtactgaaataagttagattatgtattatgctagaaggtgct

SEQ ID NO: 678705 - DNA, 241 bp, Homo sapiens
ttatggcgtcaagacctaaatgcaagaaactaatcaaaggttggtccgctggcttacacctgcaatcccagcatttgggaggttgaggcgagcagatcaccaggtcaagagatcgagaccatcctggccaacatggtgaaaccccatctctactaaaaatacagaaattagccgggcactgccggcgcacgcctaatagacccagctactcttcgggcactagggcaccgagctttaaatc

SEQ ID NO: 678706 - DNA, 670 bp, Homo sapiens
gaacggggtatgcggttgcgttgagcaggagctgtggtgaggctggggcagcgcccacatggctgggcatgctagtgaggtgcagcagctcatcactcagccccggtagaagctcaggtccagcaccgccatcgagagcaccatggctggctcagtggagcgtagtgattgtgttgcacggtcgctgtgtctgacagctgggactgcctgacgaggtccgacagtctcccctgtccagcagacgtcttcttggaggctggctcttgagtgcagctctgggctcttcctactggtctgcagtgctggccccttggctgcttgcttcgacgtgacggggtgacggtgctacgatgagctgtcgggagatcttgttcgaggacttccagagctcatagtccttgtgaggaagggccgtgtcaccaatggtgaatctgagcccctcctggccacctcagggccttggggagaggggacccaggcatacacgtgttttgtgtgcatccactgtcatgcacaatgcatcactgagttgccaccagggcctcccctcctaaccccaaatgctggctgtggcctgctcatagccagggatgctgcctctggagctgacaggctggccagtccgcagtgcccgcggaggagccagagggtacgagtcgatcgaatctgg

SEQ ID NO: 678707 - DNA, 714 bp, Homo sapiens
  misc_feature (656)..(656): n is a, c, g, or t
gagaactgggcatgagccctcatgccttgccttttaagaggccaccatcagagggacttggtcctccttgactggtacttgtgtacatgccggcgacctgaggactccactcacactggcgagcacaccagtttctcatggggtacatgattttctgaattcttaaacaatggtggtgctgtggctcttctgggaactgataagtgctttaagcaatgcccataccctgtcaagactaccagctcagtcatttgctctgatatgcctaggcacagtatcctgggagtgtgcttgtgtcagcagctcattttacctagattatatattgcacgatgaatagatcctcttttttccctaagggatatcacttgcctgtgatgtgtaatatcctgcttgcgaatagctggagcaaacctgaggctgacacacgtgagctagtgctgcaaagcgagaagagagccgctagagtgtacttgtccctgacaggctgacctacctgagtatctgagctattcactccaaatctgagcaaggctcaatatgccacagaacctatcctcttctcaccactccccatggtagggaccggaccatccctacatgctacatgcagctcctccagcccctaccattgccatggctcatgtaccttacgngcatggggacattacatgcgactgcttggttcgaccacctatcctctctgtcccctcc

SEQ ID NO: 678708 - DNA, 379 bp, Homo sapiens
aataaaactttttcaaaagtttttaagaagtgttttaaaaatatattattactatcagagctgtaagagaagataattattatgaagcaagaatataccattaggcctggcgcagttggttacgcgtgtaattcccgcactttgggaagccgaggcgagtggatcacgaggtcaagagatcaagaccatcccggctaacatggtgaaaccccgtctctactaatacaaaaattagccgggcatggtgcgggcgcctgttgtcccagctacttgggaggctgaggcaggagaatcaattgaacctgggaggtggaggttgcagtgagctgagattgtgccactgtactccagcctggtgacagagcgagattccatctca

SEQ ID NO: 678709 - DNA, 268 bp, Homo sapiens
ttttttaaaggtttaaaaagtttaggaaaattcgcccccccaaggctcctttttttattagggggcggtttccaagggggaaaaattcgccttggaaattttgggccccgtttttttaaaattcaaaaaaaccgcccggccccccgggtttaacctttattttcccatttggaacccgtttaaaattgggcccccaaaaatttgggggtttttcccccgaaggccccaaatttttttttgggaaataaaaggccctttttttttttca

SEQ ID NO: 678710 - DNA, 246 bp, Homo sapiens
  misc_feature (20)..(20): n is a, c, g, or t
  misc_feature (25)..(25): n is a, c, g, or t
  misc_feature (30)..(30): n is a, c, g, or t
  misc_feature (45)..(45): n is a, c, g, or t
  misc_feature (54)..(54): n is a, c, g, or t
  misc_feature (59)..(59): n is a, c, g, or t
  misc_feature (70)..(70): n is a, c, g, or t
  misc_feature (92)..(92): n is a, c, g, or t
  misc_feature (102)..(102): n is a, c, g, or t
  misc_feature (104)..(104): n is a, c, g, or t
  misc_feature (108)..(108): n is a, c, g, or t
  misc_feature (112)..(114): n is a, c, g, or t
  misc_feature (120)..(120): n is a, c, g, or t
  misc_feature (141)..(141): n is a, c, g, or t
  misc_feature (146)..(146): n is a, c, g, or t
  misc_feature (152)..(152): n is a, c, g, or t
  misc_feature (165)..(165): n is a, c, g, or t
  misc_feature (177)..(177): n is a, c, g, or t
  misc_feature (195)..(195): n is a, c, g, or t
  misc_feature (197)..(197): n is a, c, g, or t
  misc_feature (214)..(214): n is a, c, g, or t
  misc_feature (237)..(237): n is a, c, g, or t
  misc_feature (246)..(246): n is a, c, g, or t
tgaagtggactgtgtgagcntgggnattcncagagaggaagggcngctgtgcantgccnggccttcaganagacagaattcatcacccaatncagggggagntnttcntggnnnaagggnggagccgctcattcacccaanaaaantgtgtnttatctgccaggnaagaccagcctnacctgggaactgtctggnanggtaggctgggcccccnagtgctgttagaataaaaagccncgtgccggn

SEQ ID NO: 678711 - DNA, 316 bp, Homo sapiens
aggctcaggcaatcctcccacctcagctcccaagtagctgggaacacagacttgtgccaccacacccagctgtagagatggggtttgctatgttgccccgggctggtcccgaactcctgagctcaggcgatctgcctgccttggcctcccaaagtgctgggattacaggtgtgagccactgtgcctaaccaacaatataatttttaaataagtaaaagcatttctgaaaatcagcctatgtaacatgctgaacataaaagatgagtatttatggagaaaaaaataaattcagtaaagcacagaggcacagacagtc

SEQ ID NO: 678712 - DNA, 147 bp, Homo sapiens
cggcgcttgataaagaacaagatttaaggtgccaagtgtcagtgaaagaaagttaaaaattcctcaaagacgcaagtctgagtgcatttacccaggtctacaagcaatcatcatttacaaggttagggggccaaggcaatgcattgc

SEQ ID NO: 678713 - DNA, 431 bp, Homo sapiens
aagggaaaaaaggggaaagggaaaagaggagaggaggaggagggaaggaaagagaggaaggagaagaaggaagagaggaggggaaagggaaagaggaggtgagaaggaggagaagaaagagaggagagagaggagaagacaagagaagagaagaaaaaaggaggaaagaaggagagagagaagaaggagggtatgagagagaaggagaggggggaaggaagaggaggaaaggaggaagcgaagaggaaggagagggagacagaagagaagggagagcaggagagagaagaagaagtagaaagaagtggaagagagcaagaaaagtaacactatctcacactctctctaaatctatctctctctctctctctctctctctctctctctctctctctctctctctctctctctctctctctctctcctagagc

SEQ ID NO: 678714 - DNA, 113 bp, Homo sapiens
agaagagagagaaagaaaggagtaaagagaatagagggagaaaggaagaagaaagaaagagagacgaagacgagaagaagagaaaaagacacaacgaaagagaagagaagatc

SEQ ID NO: 678715 - DNA, 213 bp, Homo sapiens
gctgtacctacctcacagggctgttgtgaggattaatgagatggcatgtgaagcactttgaaattgtaagcgctatgtaaatgtaaggtattatagacacatctttaacatatagtgtcataccctcattttttcacacagagagggaaagtctgcttgtaagctcggttgagaaaggttatctcgatatatatctgtgtgtgataaatatct

SEQ ID NO: 678716 - DNA, 423 bp, Homo sapiens
gggaatacacagctaccaataaccagcccgattattgtccatacgatgcatatgaccagcaatcaggcaatgatcaacatcaaggctcatatgatgagcagtcacatcatgatccgtagcatgatacctatagtcaataccagcagtcctatcattcacaaagggcaaagtacagccatcagacacaagatgaccgtcgtgatgtgagtaggtatggggcagataatagaggatatggcgggtcaccgggaggaggtagagggcgtgcgggatatgacaaggatggaagaggtcctataacaggatcaagtggtggtgaccgcggtggcttcaaaaattttggtggtcacagggattatggacccagaacagatgctgattcagaatctgataattcagataacaacacaatctttgtgcaag

SEQ ID NO: 678717 - DNA, 168 bp, Homo sapiens
acttcaagctcaacctattctcgttctctttgttagaggtgtattgaggatagcatattgagaatatattctctggttcaaaccaaagattttgtgacattaaaactacttgaatttctacttcataataggagtcagtcacttctgggactatagtgatgcttgcaa

SEQ ID NO: 678718 - DNA, 620 bp, Homo sapiens
ccccgtgtggtcttgtgctgggagaaggcagcggacgcatcacttgcacttctagaaataagatgcacgatcaggacacaaggacatcctatagaattggagacactggagcagaaggataatcgaggaaaccttgcatccagtgcatctgcacaggcaacggccgaggagagtgggaagtgtgagaggccaccacctctttgcagaccacatcgagcggatcttggccccttcaccgatgttcgtgcagctgtttaccaaccgcagcctcaaccccagcctcctccctaatggccactgtgtcacagacagtggtgtggtctactctgtggggatgcagtggctgaagacacaaggaaataagcaaatgctttgcacgtgcctgggcaacggagtcagctgccaagagacagctgtaaaccccagacttacggtggcaattcaaatggagagccatgtgtcttaccattcacctaacaatggcaggacgttctaactcctgcaccacagaagggcgacagggacggacatctttggtgcagcacaacttcgaattatgagcaggaccagaaatactcttccagcacaagaaccaaacgccagcacaagaaccaggcttc

SEQ ID NO: 678719 - DNA, 211 bp, Homo sapiens
gaatctgacagcgtctctagcattgttatgattaggacatgatgcctgtaatcctagcgctctgggaggttgaggcaggtggatcacttgaggtcaggagttcgagaccagcctggccaacatggggaaaccctgtctctagtaaaaatacaaaaattagctgagcatggtggcaggtgcctgtaatcccagctactcaggagtctgaggc

SEQ ID NO: 678720 - DNA, 364 bp, Homo sapiens
  misc_feature (15)..(15): n is a, c, g, or t
  misc_feature (162)..(162): n is a, c, g, or t
  misc_feature (164)..(164): n is a, c, g, or t
  misc_feature (331)..(331): n is a, c, g, or t
aagatatgaatcatnatattatcacctccatctcaggaaaaaccaattttagattctctattaagcaaagagggacaaaaagtgtgttcagtatctgactggataactcaccttagggtaagaataaggaatgtggtttggttcattggataagcacaaagnangaggaaaaaagtatcacgttagattcacaggttataagcttgaatctcagttcacacagttttttagatcttgcagatcttttcttgctaagctttattttgaatgagaaacactgatctcttaggtgaaaatttgggaaagccatcctgatctgaatttggggcancagaccgttttgagcagtgtgatatcaaaaaat

SEQ ID NO: 678721 - DNA, 209 bp, Homo sapiens
acatcagtgcatccgaagtttgttctcaggagaaaatctactaaaaatggccaaataggttgttaatactcgtgaaaccctcttaaaaataatccctttaacagatgacttcttccccaccacaatcaaaggatgggaagttactcaggggaggactggcagatagaattcgcccatattccccaaataaatggcattcaatgtccaaa

SEQ ID NO: 678722 - DNA, 338 bp, Homo sapiens
tatagccggtcggggatctgtacagtcgaccctgcgggcgtggaacagagtgatggcgtcggtaagagaacgctcagttgatgggtgcagttgcttgcctctcctccctgaatccaagaatctatgttctcagccccgaggacaacacacaatttaaaaccggttctacaaggccacctccctatctgttgctagaagcctgctcccaggagttatgtgggccatccccctgcctctgcatgagatcgcctctctttagcccagcctactctggcttatccccactctccctttcgcaaactcagggaaagagagagtggagacaaggtagagccgag

SEQ ID NO: 678723 - DNA, 886 bp, Homo sapiens
taaaagggtttaaacgcttttttgtgcccaaaaaaaggcccttggcattgaagggaaaacgccgcccacccttgaaccccggaagcgatggttagtcgcgcccccaaaggcaaggaggttgtgggacctggaaaaggttgcgcggcctctcctgcgttcccccgcgccgccttgggccctggccaaccacggtgacccctgcccgtggtgtggcatgtgccgcggccttctggccatctctggccgcctagggcgccagtacccattagacgaaacgtgccggttgccagtggccggaaacgccactatatgatggcatctccgccgaggtgagctttgttctcaaacaaacaccctataaaacgtagccacacacaacctagaaaaacccgctactaacatctcggctagagtgtagtgagaatgtgtgagacaacagactttagaagaatgagacggcgatgtgtgagcccccctctacccttaggatgcgctctcaatacacacaaggcctctcatgcgggaggctccccgtgtgctcgtggcgcgttttgacccccctgttaccacaacatctctatacggtctccactgtgtgcggggtttaagaaaaaccccactaaaaaccccccggacataacgcccccatctggctcggccctgctttcagtagacctcgcgccacagcacaccgcgctctccacttgttggcggtgcccctttgtcgggccacctttgtggagagacccgcttagggcgtatatgggcacgcgccggtctctttcacccctctttttggccccctggaggggagcccggacggtccttctttgggccttatgccccgcctttgtgcccctctcctttgagcacccagcggccccta

SEQ ID NO: 678724 - DNA, 212 bp, Homo sapiens
aagctcggtacgtgatggctcccaggtgatgttaacacagagatgtggcaggcgcgtggtcacgctgcatcccaacaccttgggaacgccaaggtgggcggatcacccgaggtcgggagttcgagaccagcctggccaacatggtgaaaccccgtctccactaaaaaatacaaaaattagccgggcatggtggcaggtgccccattcccagc

SEQ ID NO: 678725 - DNA, 145 bp, Homo sapiens
ccgtttactgcccaaactccagtgacgggtctctatgaacatgccataacacactccagtgaagggttctctctgaacaagcctaactcactccagtgaagggtctctctgaacagacctaacacactccatgtgaagggttccc

SEQ ID NO: 678726 - DNA, 422 bp, Homo sapiens
  misc_feature (82)..(82): n is a, c, g, or t
  misc_feature (309)..(309): n is a, c, g, or t
ttcctttcccctttctcacatggaatgagggtttgaagagcaagccaggaaagtttagggtttcagggtgtcccaaaccccnacaccggccagtgggggaagtgaccgcccctcacattcctttaaataacagcctggttcccttggggtgcagggccctcaatttttttaagggtccaaaaggagggggtgacctccggccaggtgcctcttaaaaaacctgaagcctccctccggggggggccctgcccacccctcttggggggggtaaggcccgtggggccggggtttttgtgcacctgggttttnggggccttttttttaaaaccgttttcctccaacccctttatgaagggccgtttttggggaaatgggttgcccataaaagggcagccccgggcaatcaataaacagcgggtgat

SEQ ID NO: 678727 - DNA, 239 bp, Homo sapiens
tggtgattacaggatcgtgggagccttaccctgcagccccactgggtccaggggtcacggaaagctctgggaccttcatcacctttctggcccggaaaagggcctgctggccccgaggccccgggtcgcggtcagctccagaggggcctggctgtccgatggggccttgaggacctgtaggcccaggagaaccctgttctccttggtcccccttgcttcctttcggccccgggtcccgg

SEQ ID NO: 678728 - DNA, 375 bp, Homo sapiens
cattactcctgccactagtgctcttcggaggcagccatcatcactgtactgacaatgacctggctaaggtaatcacggccctccaagacaccaaattcaactgacttcatcactcatatggacctgactaaaacatttggcgatactcttttcctcagtttcttctgcagactatttgactcctgtgacatttctttgccaatttactatctacttttcactattctttctgcctgctttactagatcctttctttgcctgcccacccatccctaaagaaacatacttcttaaggcaccagcatttcttctcacattctcctagagaaagacttacaagatgcttggcttcaactgtcatctgtatctgcgggcc

SEQ ID NO: 678729 - DNA, 182 bp, Homo sapiens
caatagcagaatggaaaagacagaggaaagaatcagttatactgtctacaaggaatgtcaaagtaatgatattaaataggttgaaagaaaaaggatggaaaagataaaccatacaaacattaaacacaagaaagcagagtctgtcaaataaacttctggagacatatcccatcccccgaatt

SEQ ID NO: 678730 - DNA, 300 bp, Homo sapiens
  misc_feature (65)..(65): n is a, c, g, or t
  misc_feature (190)..(190): n is a, c, g, or t
tgggtgattagaggatcccactttacgcatgctctattgactgggttatcgtgtgacgggtggtnacgaaattgacaaccctggggttagtatagcttatgtaacttcggttatgctaaggttatcactgctgttttccggggggggtgtggttaggtaaaggtttgagctgatggtgcgtgttgatgtngtccctttgatcgtgggtgattaggaggggtgaacttcaactggaaacggggatgctttgcatgtgtaaatcttactaagagctaatagaaaggctaggaccaaacctat

SEQ ID NO: 678731 - DNA, 1935 bp, Homo sapiens
  misc_feature (1933)..(1933): n is a, c, g, or t
cagaatagaatacatgggatacagaatgtacatgaagaaatactcttgattttgtatactcagtttatctttggacgtctggtgataaagtacttattaggaagtgtcttaatttcactagtgtcaagatcctaaatacaggaatttgacatgtcatgtctgaacagtactatagtaaggtagtttgatgggatggagtgacactgaatgcatgaggtttatcctgagttatctttggtgtggttaagcttggacgtagtaatgagtgtttgaatgactgcattcatattcgataattttactatgtttaaatcacgttcgttagctcagtcaagattttacatctgattgaaattgcagtacgctggttgtcgataataacataagatcagagataattagaaaagataaagagaggggtgcgccgttttccctaaaagagggatgatttctcacagcaggctgtaagtaacggctctcgccaaaatccaaatgcgatactgatgcagatatgcacacccctaatccgttgtgctttgatgtctacccagggaacgtgaggtgccacactctcattatttagagcgatgagattagcactattcatatatatcaagtccaagcgagtaagagagggtagtgcgaattacgttgtgaactagataaaccgctgggactagagaatggtgttgtgggtggacaaacgacatgagtgacctgacatgctgcaatgggagggacaaatcacctgggggggtggggaggaggtggagatacctcctcaaatacttaagttgagggcgacgcgaagaggggggctcattcaaaatgtggagtgcaaacaaaaacgatataacccaaagggggaggaagaattttgtgaataccgaagcatatgtataaggcggcccataatatatgtagagaacgaccttgctgaaccactgggtgtgggacataacaaacgcgggggtgattataaacccctataggtcgcgtgaaaaataaagtgcatgctgcgcattaaggtatttggggaagagacaaacctttcggggaaatataacccggggggaagagatactatcacatgtggagtctaggtgaaacggaaatataattcttaaatccgacgaggacgagggaggaggggacaaaaaaaaaaaacacggcggcgacaaccacccgagcggcgaaccacactcactaaagagaggacgacgcaagaagtgtagacacaggacactaaaccaccatagcgccgcgctacgagacgctgcgtgctaccaccacacccaacagctcagagggggccacacgcaaatcaacacagctgcgccgcaaaaacgacctactaactcaccgaccggaccacttagagcagtcgggaccaaggctgcacagccccacaagcatcttactgcagcgcaagtaactagagcaagccggcgatcaagcacacgcaacaccccagtagttgtatctaccctagggccacggcaagagaaaaacacaaacacacactgcacaacaaacggagcggcacacgagacaacatagcaagacaatccgatcgcacacgaccagaacacctgagcgagagaacgaaaccacacccacacagaatcaccagacacgaaagcagccatggtcgagcccgggactaagcaacaacacaaacccagggcgagaccacaacgtagcgcgaagccgccgacagccacaaaaccaaacacacgacgcgcggacaaacccacatcgaccatacgacacgagcagagagagacagcacccgaagcacagcagcaataacagcagagcaaccaagaagacaacgagacgcacgcgcaacaacaccaacaagcaagacaaacgcagctcagcaagaaaaaaagacaagaagagaaacacaaagcgacacaacggcacgcgngt

SEQ ID NO: 678732 - DNA, 198 bp, Homo sapiens
  misc_feature (39)..(39): n is a, c, g, or t
accatcggtgcggtctggagcgggcagctctacggatcnggcttggctgggggtaccactggctgggtctctctctgcgatatgccgggttaggtaaacgactggcggccgcctggagggaggggtttggattcctcgtcctggtcgggttgtcgtggtccttaagcgtaggtgtgtatggagtctctagctccccga

SEQ ID NO: 678733 - DNA, 406 bp, Homo sapiens
  misc_feature (387)..(387): n is a, c, g, or t
tgtctagagatctcgtctcaccacctcactacacatctcagtcagtctcgctcggtatcgtgctcaccctctggccggtatctgcctgtcgtgcacaaggagagcccggacggacagcgaggaggggagcagcgggagttggggcttcccccctggccattccttggcgctgccccgggacgaagccactttgagcgagcagagagtcgtcaccttgtctttccttttgcccttcaggggtaggagacgcgtggttacttttcgcggggaactggggcaggaatccatggtggcatgaacttggtcgtgccctcggcgtgagtgaatcgatctaggcgcgtgtgggaatgcccgtgtgttctactttctttgcagctcgccatgagnttttttgtggatgtgcagc

SEQ ID NO: 678734 - DNA, 216 bp, Homo sapiens
gcgtcgactcagtttacatacttttcactctctgtgttctggtcacattggctgcctttgttggtccttaagcaggaccaagtccttaagctccatcctgctagaaagcctttccatattttattccttctgcctgaaacactctgctctacccctgcctcttcctcagcttgttagctcctcttgcacctgtgatgtcaaggaagctttccctgc

SEQ ID NO: 678735 - DNA, 112 bp, Homo sapiens
atgctggttgggttgcacagaggtggggaagatctagaagccccagcgacgtggcgctctaggtctctcagcgacaggctggtctaggagcagaaatacccagagaagaggc

SEQ ID NO: 678736 - DNA, 394 bp, Homo sapiens
tgcacacgccgagagaccatactgatcttactgaccttgtacgagcccagccacgagagctggccatggcagccctgggggaagacgattctaaagacggcatgggaacggctgctgctctcattcatgttggagacagccacagtccgagctttatttccacagtccatgaggtcagcaattactgcgagggaggacacagccaatttggacaggtcctgcacgtacgtgcctaggatggtgtgctccaggacccgcagagaactccgactcttgaggttcaagaggtctcgtacccgctcacagtagatcttcatatagctcacctccacagagtaggatagctgagcactctggttctcactaacgcgagagaagaggtcctcacagagct

SEQ ID NO: 678737 - DNA, 544 bp, Homo sapiens
ccctgttaaacacagatcttacttacagccaccaacaaaagccctgcctttgacttgtgtagcttcgtcattgtaaatcacatgcaagatcctccagtaccagtgagactttcactaagatccgcgcccttgcagaccccacataagtcctttctaggcatttgggtgcctcagttccaccctcggctgcctcttgagtgtaacattagtgcagaaaagtccgttaagaagagctcctatgtaaggccagaatagaactgtaaagttgcaagatcctctctcaatatgcaagcatgggggcccgcccgtacatgttgagacattacgtcctgcaccgctgttctttcatgggggccggtttctgaccccaaatggaaaaggggctggatttttgaccccccagaacatgtgactgttgccattagggcccgagacatgtgtgagggtattggcccaggttttagcattcatagcaccactggcacggcatagtgatttggcaatggtctctgaacagagagccacccaataaaaagcctgtttc

SEQ ID NO: 678738 - DNA, 334 bp, Homo sapiens
  misc_feature (276)..(276): n is a, c, g, or t
ttttttgagatggagtctcgctgttgtcacccaggctggagtacagtagcgtgatcttggctcactgcaacctctgcctcccgggcccaagcaattctcctgcctcagccccctgagtagctgggactacaggcacctgctaccacgcctggctaatttttgtattctcagcagagacgggatttcaccatgttggccaggccggtctcaaacacctgacctcatgcgatccacccgcctcggccccgcaaagtgctgggattacaggcgtgagtnaccgtgcctggccaagattcctataatttgagtgtaacaatctggtaattttacgtcg

SEQ ID NO: 678739 - DNA, 672 bp, Homo sapiens
gatgtaccagaactgcaattcgatggcgaggatgcccaaaaagctggccacttctagggacccgccaggacccccattggcctttgtccatccagaatccagaggtatccatgggagtgagccccaagagttctgaaagagtgtttgccaagacattttttcgcccttctgtccaagttttccaatgggacaccttggtgaagactccacacaggcgttctgattcaccatagctgaggattgtagagcccatatattgccatgggggtacccccatctggaagtccacggttaatggacttaatctcacccagcgtggttatggcccaaatccattaagagagcgagattgctttgacaacgattacgctttgattgctcgatctcttggtaaatacggcatcatctgcaactggaggatttgattcatgagatctatactgttgggaaacgcttccaagaggccaataacttcctcgtggcccctccaattgtcttctccaccgaggtggaatgaagaaaaagacccccccttttgtagaaggtggagattctggccaccgggaggacccgatccaccggcttattagaagaatgaactaaggtgtctaccctgaatatttttctaagctggttggttaataaaccagtaccctgctctcccaaattgga

SEQ ID NO: 678740 - DNA, 374 bp, Homo sapiens
tgtaaagcacacccgatgctgaaccgatgactgatcgagaacggtatccagaaagtccagtgcctgggtttgagctgctgttaaaggcactcctgccttaaggtgagctgactcaatgtagactcgaaagtatctgatcagtggaataccttcactggaaaagctgaggatgggggctttaaacagtttttcatcctctgacatgccgcgattctcaaaaaagaagtcgcatttgagcgcttccaatacttctgggaacgccatcagctcggcgtataccgcgcttgcatcgatgagaatgctctcacctcctaaaagtgctttctgtccacaggccaagatcaagtaatcgataggcaacgggtcgctcacac

SEQ ID NO: 678741 - DNA, 117 bp, Homo sapiens
agtagagatggttacgatcccatgatcgcccgcctcagctgcgaatactttatgtaatcccatctattctaatttcacttctgttgcttgtgcttgtagggtcatatccaataatgt

SEQ ID NO: 678742 - DNA, 481 bp, Homo sapiens
tgcccacaggaccctttctctgatcgctcctagaacatctgaacttcctgcgtatcttgtgtatgaaaaaaggctttcttacttctgcattatgaccattgatggtatggtattctgcaatacgatatatccacagagtcatggtcatcaaaagtaacaaagccaaagcctcttttctttccagactggctatcagtaattatctcaatggtatcaatttttccatattcctcaaagtaatctctaaggtgatgttcctcagcaatcttctttaaattcccgcaaaaaaaaggttcttcacagttacatgagcccctggttttccagattcctctcttgctgcagaacgttttgggtcaactactctcccatcaattgaatgaggtcttgcagccatggcagcatcaacctcagccatggatgaaaaagttacaaaaccaaatcctcttgatcttttgcttgcagagcgatcagagaaagg

SEQ ID NO: 678743 - DNA, 263 bp, Homo sapiens
gcccccaaaggtggtttgcttttgctggggtaaaaaggatgaaagtttgagaatgcccaattttttattttgggtttcaggccctgaaggttcttggggatttagtttcatgcctcggtttccccattgacttggacatttttgcggtttttataagaagaatattttatgaagtttttgttgccccatggatttttttcaaagattttcagggggaccaatccgggcgggaggtttttcccgatatccccccctccccaata

SEQ ID NO: 678744 - DNA, 716 bp, Homo sapiens
  misc_feature (405)..(405): n is a, c, g, or t
gctgcaggaattcggcacgaggtaaatgttaataacagactgaaaaagataatgtggcctgtgatcaggtgaagatagtataaacattattgaagtcatcaagaattttggttcaagatattacaaaactatagtcggaattactaaaatgcaatatttttttcttctgacttcatcgctaaactctccttttcgtagatgcatttaatattgttacataatatacttttatttatgtaagacttaagttgaggcttgttgaaattcctttacaattttctgctctgacataatattccatccaactctccacacactattatttagtaactatgagaaatgactaaatactagtaagaagctaacagaaaatctactcaggtacactcaaacataataaagcanatttatataaattaaacattaaaaataactgaaagagaaaatacaaattaaaatgatcataaaatatacctatctgaaggtcatgaaaatattatttttgtcttagcaacactattttattttaatatccatattaacatatttaccagagtttgtcttgcatgtgatttgaactatgggtaaagaatcaaacttttcaatgtggctccccatttgactcagtaacatgtatttgtaacatcaatgtcttattataccgcaatactgctggtatattttacccatcacacattgggctcttaggtactgct

SEQ ID NO: 678745 - DNA, 491 bp, Homo sapiens
  misc_feature (9)..(9): n is a, c, g, or t
  misc_feature (70)..(70): n is a, c, g, or t
  misc_feature (76)..(76): n is a, c, g, or t
  misc_feature (82)..(82): n is a, c, g, or t
  misc_feature (90)..(90): n is a, c, g, or t
  misc_feature (146)..(147): n is a, c, g, or t
  misc_feature (157)..(157): n is a, c, g, or t
  misc_feature (238)..(238): n is a, c, g, or t
  misc_feature (263)..(263): n is a, c, g, or t
  misc_feature (287)..(287): n is a, c, g, or t
  misc_feature (317)..(317): n is a, c, g, or t
  misc_feature (332)..(332): n is a, c, g, or t
  misc_feature (373)..(373): n is a, c, g, or t
  misc_feature (386)..(386): n is a, c, g, or t
  misc_feature (404)..(404): n is a, c, g, or t
  misc_feature (479)..(479): n is a, c, g, or t
ccgcccagngctttttccgtggtttcctgtgtgccgcctcccgcttgccgaagcgctaggccgaagagtnccagtngtagtncggcaggnccttctcccgctgcaccagctccgcgccctggggtgcggggatctggcggctgttnngggcggacangccggctgctgggggctcccggagctctcggggggcggggacagcgagggcccccgagggctcagcctggcagtagcagcnggcttcctctcggtgcacggcaggntctgctccccgggggccaggaggnccagggattctagctgctggcctgttggtntagaattccccacanaggccaccttttctaatggctccccaaagtgggttgcacanaggaaaagcagtngctgccaagaaaccagtnagtccatctcggtgagaagaggcaggtcctagaagtgcctcgaggcttgcctcagtcctggcctgggcaggagtntggcggactcct

SEQ ID NO: 678746 - DNA, 136 bp, Homo sapiens
cactctcgaggatcccgaaccgggtactgcggttgctacaccgaaagccgtttgtgagacagaacgccgccgcggacctgcggccgacgaggaagttttctactgtaaatgtcaccaacgagactcttccgccact

SEQ ID NO: 678747 - DNA, 239 bp, Homo sapiens
agattctgcagtgtaatatgaccaaatcaaatccgttgtatgatcgaataaggccgtcataaagtaagttgaaaatttcgttcttggctgaatcgtgttaaaccgttgtacacaacgtagtaaaattcataacccatctgcataccaatcgtcagccgtgatgcatttactcactttacgtcgatgaatgtcaaacatcgcaccttttcaatgtttactaaaaacatagcacgcaatat

SEQ ID NO: 678748 - DNA, 598 bp, Homo sapiens
  misc_feature (52)..(52): n is a, c, g, or t
  misc_feature (123)..(123): n is a, c, g, or t
  misc_feature (138)..(138): n is a, c, g, or t
  misc_feature (163)..(163): n is a, c, g, or t
  misc_feature (524)..(524): n is a, c, g, or t
  misc_feature (537)..(537): n is a, c, g, or t
ctttccgagtagcttctaagagacaaagaccaacgagccaccacagccaccngtcccagaacccgccaatgctggggaacggaaaatgagggagttcaactctggccctcacaatccagtggnggagacgaaactcanctgcctctgtccctctgggcacgcntcatgccaggtgcatctgtggacaggggccatgctcctgggcttccaaagttggagaaagctgccaggctcaggtctgaaggccagaattctacagtaagtcctactgagtcaaggtgggagcagggtcggtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgnacttatgaattcnacaggtgaagatttacacttgataaatcaactttgtcagctagacctgagcagaccggggc

SEQ ID NO: 678749 - DNA, 459 bp, Homo sapiens
  misc_feature (431)..(431): n is a, c, g, or t
ttatagtaagagaaaaaatatatatgcagtttctggagaagaggctttttatttctgaactttctaaatgctggtcagtgaatgccaccaataaaaaatattatgctcgccagaaatagagatatgcatccctcagagtcaggcatgtgggttttatcaaatgtagtggattttgtctgtggacatctgcggattttttctgcccagattcatttaaccctactttgggtaaaactaccccgacctctccctattccatcttatcttaatggcagtatcacatgaggtaccccttcccaaatgcatgagcacttgactcaagccatacctatgagagtgttcttttcctgagaaatacctacctcataaaactattgtatggattaagtgtgttaataacatgcaaagtatttagaagcattactgcatanggtaagcagtacatgagtgcactcttat

SEQ ID NO: 678750 - DNA, 125 bp, Homo sapiens
ttttttttgcaattttttttccttttcttttctctctctctttttaaagcatctcatcagctgtcataagtgtaagtgtatattatgtgtggcccaagatcagtgtggcccaggaaagccgtggt

SEQ ID NO: 678751 - DNA, 205 bp, Homo sapiens
  misc_feature (2)..(2): n is a, c, g, or t
  misc_feature (6)..(6): n is a, c, g, or t
  misc_feature (8)..(8): n is a, c, g, or t
  misc_feature (16)..(16): n is a, c, g, or t
  misc_feature (25)..(25): n is a, c, g, or t
  misc_feature (42)..(42): n is a, c, g, or t
  misc_feature (44)..(46): n is a, c, g, or t
  misc_feature (64)..(64): n is a, c, g, or t
  misc_feature (77)..(77): n is a, c, g, or t
  misc_feature (105)..(105): n is a, c, g, or t
  misc_feature (107)..(108): n is a, c, g, or t
  misc_feature (112)..(112): n is a, c, g, or t
  misc_feature (153)..(153): n is a, c, g, or t
  misc_feature (155)..(155): n is a, c, g, or t
  misc_feature (186)..(186): n is a, c, g, or t
cngcangncgaccggngcggtaggngcagcaatttatccgtntnnngccccaaactggaaagangatgctaattaangtgaagacgctgaccggaaaggagattnannttgncattgaacctacagacaaggtggagcgaatcaaggagcgtntngaggagaaagagggaatccccccacaacagnagaggctcatctacagtgg

SEQ ID NO: 678752 - DNA, 106 bp, Homo sapiens
cgactctgaggatccctgaaatcttgaacagaggtcccggaaacttcagctacagaatttttgaaacatcaagcagtgaataactgctgtccctggaaaatggcaa

SEQ ID NO: 678753 - DNA, 210 bp, Homo sapiens
ggatagtaatttgtaaataacttgccctcctctctacacacaaaattgtgtgtgtagtttgtagtgtgtgtgtgtgcgaagaaaaccgtgcacttttaccgtccctcagaaaagatgtgactgaagaaaatatctagaagataccgtgcgttagaatagtagagtatgtcaacgtgacccacactcaaatgctctgagtgactaagtagg

SEQ ID NO: 678754 - DNA, 133 bp, Homo sapiens
gggaagctgaggacaagtgagttcagagctagcgcgtcacctgttgtgctggaggagcggaggactcaaggtgcacgtccgagagagctttctcttctcgatggcgttggacacattccctgacagagaggag

SEQ ID NO: 678755 - DNA, 314 bp, Homo sapiens
ctcagccactggttgatgcacagaatccactaatgtgacacatggatggttgttttattataccgaattttgagcttgtttgttattccacgcaatagatagctagaatataggatttaaaccacaggcttctcctcactaggagattggggctggggctggtggtcagacgagctccttccctccctctcctgatgttgctgctcgaatgaccttccgcctcagtaatccagccactctctttagtccttgcttttcttgactactgggtagctcctggtgtggttacccattcccttctcgaatcactcctt

SEQ ID NO: 678756 - DNA, 204 bp, Homo sapiens
ttttttttttttccagtctcaagcccttcctgtaatattcagccagggggggaggccaagagaaatggaaggggaaggggattgaagggaagcagaagaaggaccaggtttattttttttttgggggggggggatatttaacaccccaacttttttttcccccatattaaaagaaagggggaggaagacacttttggggaatat

SEQ ID NO: 678757 - DNA, 438 bp, Homo sapiens
  misc_feature (5)..(5): n is a, c, g, or t
  misc_feature (10)..(10): n is a, c, g, or t
  misc_feature (110)..(110): n is a, c, g, or t
  misc_feature (239)..(239): n is a, c, g, or t
  misc_feature (371)..(371): n is a, c, g, or t
  misc_feature (424)..(424): n is a, c, g, or t
  misc_feature (426)..(426): n is a, c, g, or t
  misc_feature (429)..(429): n is a, c, g, or t
  misc_feature (438)..(438): n is a, c, g, or t
ttaangttgnaaggcccaatgccttatttcccccatcctggaaaatcccttggggccccttaagaattatgcctaaatcctactcctgccctatggctcctacaaatagnacaacaaagtgtgggtgacagtatatctgtcccatagcatggtttacctgaatatttaaagttcactgttgagacctactgctcagaaaaaagatttctttccaaatattactactgcttgacaatgtncctggtcacccaagagctctgatggagacgtgcaaggagattaacattgttttaatgcctgctaacacaacatccgttctacagcccatagattaagaagtaatttagattttccagtcttattacttaagnaatatatttcataaggctacaatcgccgcagtgattcctctgaagaaaacagncnttnaaaaaaaan

SEQ ID NO: 678758 - DNA, 1376 bp, Homo sapiens
tggacaacaataaatttatttattggggggtgaggcaggcaagcggggagggagggtaggggtgacctcttctttccctcacgagggccaccaggccttggtttctctctctcccagaatataagcataagggtcggcaggggcgtgaggggagtgtgaggcagggaggagtgcagtggggccgtgggggaactcaaaaaaaagccgcgggggctcagagagggatgaggagagccgtgagcgcgcgtgggggggggtgggggggtgaaaagggtggaggcagagggctcaagagggtgaaagcgggcagcccgcggagaggggaggggctccaattaataacaccgcaggagacttgtggcggggtgtgtagaaagttatacaagtgggacacctcaaatagagagggtgtgacaagaagaaaaggtgtgggagtctcagagaggggagaaatctcagagagaactctaagagaagaaagcgtggtggggtctcagagaggtataagcgagagcgcgctggggcccccgacgggtgggagaggtgtatacagaggcgttggaggccacgagggctccagcgcgcggtgaaaaagcgtggcacagtctctccagaagaggggcgagggggggtctcacaaccatatataaacccagagaacactctcaatgagggcgctcactagagagggtgctaacagagggggggaactcacgagggggggggggggacacaagagggtctccacaggggggtgcacagcgccagaaaagtccccacgagggcgcgtacacacgggaacgagggggctccgtgggcacagaggcgtccaaaacgaggggggggcgggcggggggattccccccccaagaaaggacgctgcgcacacaccagcggtgggggtgaacaaaagacgcgggggaggggagcttccacactacgccgcgggggccaaaacgttggctcccacaaggcgtgtcgtgcgggcaaacacgagaagggcgccccaagagcgggggggcggggctccacaacagcggacatcatacaaaccactcaaaggggggggcgccgccacaaacagagggggcggggaagccccccaaagggggggtctcccgcggacgcaaacaatgctgaaacaagggttatcgccccccacaacaaaggggggtcgtaaaacaaggcaggagagaaggcgccttccccaacagacgagggcgggtctccatccgtcggtcacccaagcaggcggcatcccacgagggggggggggcgaaagcatcaacacaccgcccctctgtcgagggactggctgggcaacaacagcggccgggggcgagcacacccacaaagaaggcgcgttcaccacacaa

SEQ ID NO: 678759 - DNA, 90 bp, Homo sapiens
gctgtacaccgttatgtgtcgtgtatcatttcatcaaaactcttattttccattatgtagttttccccacaggtatgtttttctcactgt

SEQ ID NO: 678760 - DNA, 144 bp, Homo sapiens
aaaaaaataaaaattgcctttttgcttgtacaaataggagcaaaactattatattatgtaggccgttaaccccacttaaaagtttagggtttttttttggttgtaaaggggcccaaaattgccttttgaatgaataaaggttta

SEQ ID NO: 678761 - DNA, 391 bp, Homo sapiens
ggcaaagctgactggttctgtatgaatgcaattttaggaaatataatttttcatcttaggggactgggtaaatctcagtcgcttgagtagctgggattacaggtgcatggcgacattgtttcccttaagtgaaaatgatttttttttttttttttgagacggagttttgctcttgttgcccaggctggaggccaaagatgcaatctgggttaaccgcaaccttccgactcccagtttaaagcgattttcctgcctaagcctcccaaagggctgagattacaggcatgagccaccgtacctggcctgaaaaagatttttaaaaggcattaaacataaaaccactttttaggaacaggggggaacatttgactgggaaccagtcagcattaac

SEQ ID NO: 678762 - DNA, 483 bp, Homo sapiens
  misc_feature (20)..(20): n is a, c, g, or t
tgatgagctcggcctctttngcccaaactcaccaagctcactatctacataaaacctctgctgtcactgcctgataagttgatgggccaaatgcccaggatgaaggaattctacctgtatgacaccaacctcagcaccgtgccctggagcctgtttgccaacatgagcgggatggagaggctctccctgcacctcaacaacaagctgagggagctgccccctgaccttttttgctgcctgcccaacctccagaagctttctctcaagtccaatgacatccaggatctacatccagatatcttctccaagctggccaatatgaacactctgctcctgaatgataacaagcttcgctccctttctgaggacatatttaagggcaaccccagtttggccagcgtcgagctgaagaacaaccagctgcggacccttccgggggaggtcttctctactgcagggggtttaagggttgtcactctgagt

SEQ ID NO: 678763 - DNA, 757 bp, Homo sapiens
  misc_feature (12)..(12): n is a, c, g, or t
  misc_feature (77)..(77): n is a, c, g, or t
  misc_feature (129)..(129): n is a, c, g, or t
  misc_feature (220)..(220): n is a, c, g, or t
  misc_feature (284)..(284): n is a, c, g, or t
  misc_feature (286)..(286): n is a, c, g, or t
  misc_feature (294)..(294): n is a, c, g, or t
  misc_feature (317)..(317): n is a, c, g, or t
  misc_feature (338)..(338): n is a, c, g, or t
  misc_feature (358)..(358): n is a, c, g, or t
  misc_feature (373)..(373): n is a, c, g, or t
  misc_feature (376)..(376): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (400)..(400): n is a, c, g, or t
  misc_feature (403)..(403): n is a, c, g, or t
  misc_feature (470)..(470): n is a, c, g, or t
  misc_feature (481)..(481): n is a, c, g, or t
  misc_feature (488)..(488): n is a, c, g, or t
  misc_feature (491)..(491): n is a, c, g, or t
  misc_feature (496)..(496): n is a, c, g, or t
  misc_feature (498)..(498): n is a, c, g, or t
  misc_feature (506)..(506): n is a, c, g, or t
  misc_feature (514)..(514): n is a, c, g, or t
  misc_feature (603)..(603): n is a, c, g, or t
  misc_feature (692)..(692): n is a, c, g, or t
  misc_feature (731)..(731): n is a, c, g, or t
atattaaaaaangaacaaacgggggaacccaaaatgagggggaaaacttagagctaatttcctagagtatgtatttnaatgggaagtcggggctcacagagagcagtcaggaattctgcattttctggntctatcttttgtgccttctcatagtactcagcagcttgcctcttttctccttccagcttgtaaacaaaccctaggggacttaaactctgcncatctaaagcattgtgacaaagtctcttggtagacaatttcttcagagcacttgtcagtttggngngggggggnggtctgtctttgacctttaaggnttctgaataatggtggatggnagtattttctggtttacggnggaattcctggaagnggncatngtgggnangggncnggngtntgnggtcatcggttatgttctccaggcggggggctttccgggaaatgtcctcagcattgctatacgggcntccttcagcgngcatgtnggncgggncngtgtaggnagatgcgnacatagggtctcgttccatggctgctttgaaatgaaatatagcagatgaaatcagctcatcaacctttagtttatcctttcctttaggnctgttgtgtgtggccttcttgatttggatcatttgtgccctgtagcaaagtcccatctggtgatgcaggaaagaagaagttggtgtcanctccaaggccttttttaaaagttcgagagctttgttccnggaatttttctcctatagaacttggc

SEQ ID NO: 678764 - DNA, 536 bp, Homo sapiens
ctcgaccagtacgaaacccagggccacccctactactccagcgcacgactgtgggacgacggcgtcatcgatccgttgcagacccgcgacgtgctggccctggccttgtccgcttcgctgaacgcccccatcgagccgagccgcttcggcgtgttccgcatgtaaatggagctgcaccccatgaccgatttcaacaccctcgaactgatcaccgacccccgtggttttgccaccctgtggctcagccgtgaaaccaagaacaacgcgttcaacgccgaaatgatccgcgaattgatcattgccctggaccaggtacaaggcgacccggccctgcgtttcctggtactgcgtgggcgcggcaaacacttcagcgccggtgccgacctggcctggatgcagcagtcggccgagctggattaccacaccaacctggacgatgcccgtgaactggcggagctgatgtacaacctcgccaagctgaagatcccgacgctggcggtggttcagggcgcggcctacggcggggccctcgggtt

SEQ ID NO: 678765 - DNA, 390 bp, Homo sapiens
cggtgccgacctggcctggatgcagcagtcggccgagctggatttcaacaccctcgaactgatcaccgacccccgtggttttgccaccctgtggctcagccgtgaaaccaagaacaacgcgttcaacgccgaaatgatccgcgaattgatcattgccctggaccaggtacaaggcgacccggccctgcgtttcctggtactgcgtgggcgcggcaaacacttcagcgccggtgccgacctggcctggatgcagcagtcggccgagctggattaccacaccaacctggacgatgcccgtgaactggcggagctgatgtacaacctcgccaagctgaagatcccgacgctggcggtggttcagggcgcggcctacggcggggccctcgggtt

SEQ ID NO: 678766 - DNA, 1464 bp, Homo sapiens
  misc_feature (1464)..(1464): n is a, c, g, or t
gccaggctaggtaccggtaccggaatgtaccagggatacactgacaatccgctcataccatagggaacgttcaaggagacctatcgtcgaatataccgacgaggatagagacgcagcaggcgctaccctggacagcatttacgccgacgccacgacattcaactcatcatgcattccataagagtgcaggtggaaaccatactaccccaggagacgggcgcacctataccccaagcgcggccagacctagcgtaggtagcactaacaccgggatagctatagaagataggaaagaaataaagatatacctacccgggacagaaacaagccctatatacagtattatagctaaggcaagcaggcaggtagataccgaggctagggaagaaggggttagcccagatagagtagtagggtcagagagccaaactagactaataatactaccagatatatagcctaataggtagccactagggcacccaggcatacatacgccaccacaatagccactactacgtactatacgatagtaggagctatactaaaaactaggaatagacaggaataggcctacctaccctataagctacccctagtaactatagggatactagcccataggcagggatactaggtagcctaccaagacaatagtaagcacatagaataccataataagggagctataatcctagatagtatccactaccactatagtaataagacatactagcccctaagactagaaatagtagtatctagtacacttccaagctttggctataccgaacacctactagtattaccctacttataccccctatatctacctacgtaatagtagtagtatttacctaaaaataaaaatagcccataaaaaccttacaagtaaataccattttattaatagatataccattattgaggggtagccagcattcgagtttcccagccctattgcggcatcataagggtttcccgaatttcaaggtaccatgaggcccaaggtatttaaacgagcccaagtgggcaggttcaaacttatagcatttatggcaataaggcggttagcgcgccggaggcggcttttgccgcacacatatttatctaggcactatctggggcaggcaacacaccaacacacacatagtatattaacacaactactgtgcggatgggagccggcgacagacactgagtcagatataggagggccgcggcgaaggaacggggaatagactaccacacatgaacgaacaacagacggggggaagagacagccaacaccaacagaggggggagggggaggccgacccaccacaacgaagaaacgctcacgcatacgcgacaaaaacacggtaggacaccgacgaacaaccagagaacgaacagcagcacgcactcaagctaaaatcagcaacacggcgagcaccaggtgcacagataccgccactaagagcn

SEQ ID NO: 678767 - DNA, 715 bp, Homo sapiens
  misc_feature (3)..(3): n is a, c, g, or t
  misc_feature (68)..(68): n is a, c, g, or t
  misc_feature (70)..(70): n is a, c, g, or t
  misc_feature (73)..(73): n is a, c, g, or t
  misc_feature (81)..(81): n is a, c, g, or t
  misc_feature (88)..(88): n is a, c, g, or t
  misc_feature (91)..(91): n is a, c, g, or t
  misc_feature (102)..(104): n is a, c, g, or t
  misc_feature (107)..(107): n is a, c, g, or t
  misc_feature (112)..(112): n is a, c, g, or t
  misc_feature (127)..(127): n is a, c, g, or t
  misc_feature (129)..(129): n is a, c, g, or t
  misc_feature (133)..(133): n is a, c, g, or t
  misc_feature (136)..(136): n is a, c, g, or t
  misc_feature (165)..(165): n is a, c, g, or t
  misc_feature (173)..(173): n is a, c, g, or t
  misc_feature (176)..(176): n is a, c, g, or t
  misc_feature (258)..(258): n is a, c, g, or t
  misc_feature (298)..(298): n is a, c, g, or t
  misc_feature (308)..(308): n is a, c, g, or t
  misc_feature (331)..(331): n is a, c, g, or t
  misc_feature (339)..(339): n is a, c, g, or t
  misc_feature (363)..(363): n is a, c, g, or t
  misc_feature (378)..(378): n is a, c, g, or t
  misc_feature (441)..(441): n is a, c, g, or t
  misc_feature (483)..(484): n is a, c, g, or t
  misc_feature (499)..(500): n is a, c, g, or t
  misc_feature (504)..(504): n is a, c, g, or t
  misc_feature (509)..(509): n is a, c, g, or t
  misc_feature (528)..(528): n is a, c, g, or t
  misc_feature (548)..(548): n is a, c, g, or t
  misc_feature (551)..(551): n is a, c, g, or t
  misc_feature (561)..(561): n is a, c, g, or t
  misc_feature (676)..(676): n is a, c, g, or t
ganaggggctggggggggatccagagcaacctcgagggcgtcctggtgcttaccacctggaaactggngnggngggggggngggggtnggngggtggggggnnnggnggggngggggtgggagtggngngggnggngaggggggggggggggggggggggggggngggggggnggnggggtgggggggggggggggggggggggggggtggggggggggggggggggggggggggggggggggagggggggggggggngggggggggggggggggggggggggggggggggggggggngggagggcgngggggggggggggggggtggggngggggggnggggggtggggggggggggggggnggggggggggggggngggtgggggggggggggggggggggggggggggggggggggaggggggggggggggggggggngggggggggggggggggggggggggggggggggggggggggnnggggggggggggggnngggnggggnggtggggggggggggggtnggggggggggtggggggggnggngtgggggggnggggggggggtggggggggggaggggggggggggggggggggggggggggggggggggggggggggggggggggggggggagcagctctggatggtggggaggtagaccagggancaggacaccctcttgtcctggaagaggaagctggggtgt

SEQ ID NO: 678768 - DNA, 989 bp, Homo sapiens
  misc_feature (758)..(758): n is a, c, g, or t
taaaggatcataaggctttcatttatggaaaaaagaaagcaaaaaaaactaacaatggggaggggggaggaaaaacagttgggaacatccctttaaagttaagtaagcttaaagaaaacaatttttagtaagagtgaaatagatttcccaggggtgaacgcaacaagctagtccccccaagaacaggtatttggggatacaaaaatccagttgtacacaacccagtcagcatccaaaatacgcttagtgcagtatttatccaattcacacaaagtgcgggatcagtggtttaaacaagcgtatcttataaaagctcaaccattttaaaacgggcacaaatatctctaaggcgcatagtgcttttcaccagtaggcctttgtgaagtggtcctcacctcccaactttcacaaactcaaactctctacaggaagcgggcaaacgagactcagcagttcccagaggggctatgttttatttttcccctattcccctatactaaggggtggcaaacccctttgacaggggcaaataataacacacgttttcattagccaaaaaagcaccaacaaacttgggattgtgtcaccccattaggcttctcccccgtgggaaatttcacaccaaaattacaggggtccttgtggccctcacaacaagcggcgccaaacctcctggaaacacgggaactccacacggcgacaagaagcaaaaagttcacccccaaatcaccatggtcgaaagggccttaagagaaggncccaaagggataatatcgccaggaagacctgccataatccggggacacggggcctggtggggggggggtatcacactcgcggcctccgcgggaaccgcccccctgggcacacaacacgacacctgctcaacacgtcgcatcataaccatctacgttcgccgcaaagagcaactcgatcacacacagcccgcccaaccgagagacagaatctagcacagcagaccagacctc

SEQ ID NO: 678769 - DNA, 601 bp, Homo sapiens
  misc_feature (566)..(567): n is a, c, g, or t
atatggttctgtggaatctttaacaacaaacatacctgaagacccatttcaacaggttttgtcagtttcaaagagctaaggagtcactgcctggtgggtcatccacttccgacagagaagggtgacccagatgatgggcactgatgccctcagccttcttcacttcagtagaattcatctggcctttttttggtttgtttccaatgtaggtaaatgagctctgcaaatattaaccggtgtcaggcatgctgtgagcctcttcctaacgaggccctaaggacgtaagctggaggagctatttcagctggtctaaaggcactacctaacagtcagacttttaatttcacttaagtgcaaatcagagaaggatagtcctggaaggctttttaaatatgaaggaataaactcaaatcatagcataattcagttaatgacacaatagggctttcagaaatgacctaaggcaaatgataaagcaatgattaaaacaaaaaacaaatcccaaactagtcacacagcattatgaaggtctgttattttgaagtgctcctttgcagacatggaannaaccaaaaaaggcgccgctgggatcctctagaat

SEQ ID NO: 678770 - DNA, 496 bp, Homo sapiens
tcaagctttatacttccacagtaacataggtggaagttgaagtttgtttttgaggttgatacagaaggtctcaatctgggataatcatgccagtacttgtatttaggtagactaggtgttttggtatacaaagctacttttatagtactgaaaatatcagtaattatatagtaccaagtattttagtatatctggcaatctgcattattttgtgattgttatttagttaaggcataaagacaaaccctatagtctacaggtctagatatgaaagctgcaatcagccactccattgagtgacccagagttctgtattagttcggagactttctatccaagtataatagaacacttgacagcattaatattgtctaggcaatagcatcagactcttcatttatatatgatgaagcttaacaaaaaaagacaaatgctttcaaaaagctatagtccctcacctccaaattacagaagatctgttgtaagaactataaag

SEQ ID NO: 678771 - DNA, 140 bp, Homo sapiens
cccgtagcagtcatggacagatgtactatgtcatggactgaaagacccacatatcgtaaaaaggttatcttatgcagctgggcgcagtggctcacacctgtaatcccagactactttgggaggccaaggtcgggcagaca

SEQ ID NO: 678772 - DNA, 183 bp, Homo sapiens
cctcacacgacctggaagagatttgacagttattaattaacagcagtgatgaagaggaggaggaagaggaagaagaggaagaagaagaagaggaagaagaggaggaggaggaagactttgaggaagaggaagaggatgaagaggaatattttgaagaggaagaagaggaggcagaagcggaag

SEQ ID NO: 678773 - DNA, 956 bp, Homo sapiens
attccggaatagcgggaccactgaagataaccaaagtaggtgtactcccagatacatgaggatgggtagttatcttgacattctaatcgtgaattattaatgataattgacgtcaatgtcgaattacattaacgctaatttaagtgtagtataccttaacgtagcattaccaaataccatggaatggatgagaatgaactactttaatgggacaactatagacaatcagaaataaaatcgatggactgtctccagcaggatcacatgtggagtaatgtgacgaagtcgattgaaggaataagaaattcagctaggttgcacagcatgacttggtgagcatcagggaaagatttgtggaaaaagtggcacatgttcatatgagatttaaacatgaaggatgaaggtcagatatagttgatggtggtcgtatatgaatgggaccacgttttaataagacgctagatctagactagtggtttggatcttcctatgtcgagtcatagtcatcgcgaagggcatgcaacagggcagaaccgtcaataccccttcatggactccttctgatctttgatttgtttgacgctttgcatatctagttactcagtaatattagagcgaaatttcaaacaaccatggtgctgcttctctctcaccaagcaatgtaagatgacacaagactgatattactcagggttggaagggatgtagcggcaggaaaaattcttacacaaccattagtagaagtgtaaactgaccggcttctagcagtcacttgagtacctactcattaagttaccctgaacatatccttgtgaccaacatgcttcttggaatttcagccgatgtagtcacaactacgagcagaaccttcgaataagctgtatgctcaccgcgggagcctaagttctactgggcacgtaattgttgacatccagggagacccccatagaccgttt

SEQ ID NO: 678774 - DNA, 161 bp, Homo sapiens
atggaggccagaggggaacaggtgcggtgcagaggcagatcaagcgggacccccaggagctactacataaccagcaggccatttgatcatcagagttctatcgacgaggacacagcctccgtggccattcaacgccatccgagaccattcaactgcctccg

SEQ ID NO: 678775 - DNA, 222 bp, Homo sapiens
actcgatccgctgatccagcagcacctgtgactttggggaacttttggtttgagacagggtgttgctgtgttgcccagaccggggtgcagtggcatgatcatggctcactgcagcctcgacttcctgggctcaagcaattctcctacctcagccccctaagtagctggaaccacaggcatgtgccaccatgccctagcttatttggaaagaatttttttttt

SEQ ID NO: 678776 - DNA, 363 bp, Homo sapiens
gagtccaacagtgcccttgttctgaatttaaagggtacactcccagtcatactgtgtggggcttgtttctagtagactccctttatccagtgaaagttttcttcaagtttgctaagagttcgcttgtttttgtaatcatgaataggttctgaattttatcacagccttttatgcgatttatccttctttttattgctttatattgaaggacagagtcttaacctgtcccccaagatggagtgtaaaggtgccatcacagctcactgtagcctcgaactcccaggctgaagctttcctgaatagctgtgactataggcatgccccaccatcttttctgcatttttagagatagttatgtctgtt

SEQ ID NO: 678777 - DNA, 312 bp, Homo sapiens
tcaggtagatgcacaaagtgaagcccaggctttgtcctggacggggttcctctcccaggatccatccctccaggcctcagggagccggcaccagggcggcggctgggacagtgtttctgggtgcggctgggagggtgtttccggacgcggtgacccccgtgtgctgggcgtcatccaatcctctgacggcctgaaggtgccgcggtggaggaaggaggaatcgctcctgctcgcctgccttccttcctgcttgctccaggacgcctcatctcaccgtctctggaccaaggtctggaatttacaccaacctcc

SEQ ID NO: 678778 - DNA, 661 bp, Homo sapiens
ggtttataagggttttcccaagcccgcccccttgttcacaaattggcttattaaccaaatttttacccaattttaccgaaattttaccttatatttgccatccactttacagttcgcaactgttgggaacactgatcgtaacggccctctttcttttccccccgctgttaaaggggctgttcatcaaggctattaactttggtaattcaagtgttttcccacaggatttgttgtaacacgacggcgagtacatcggaacacgtctcctgtaagcgcatctttggtacgggcctccccctccaggtccacgccaacagatagcctgaatcgataatcgggaccaagactttggcacgaggagataactagtcgcgagttctttttttttttaggcccatttgagtattttgtttccacttagtaagatagttggtattagtattagcattgttgtagagcatagtacggatgctacgtgtccaatcatgctaacagggtagcttactggttgtcctccgcttcaggattagaatgaggagtgtattcgactagcagtcaatacagtgattggcttagtgggcgaattattatgctttgctgtttggatatatggagcatgggcattgtcgctagtatgatgatggacagtaataggccaagg

SEQ ID NO: 678779 - DNA, 310 bp, Homo sapiens
  misc_feature (210)..(210): n is a, c, g, or t
  misc_feature (243)..(243): n is a, c, g, or t
tgcagtggcgtgatctcagctcactgcaagccccgcctcccgggttcacgccattctcctgcctcagcctcccgagtagctgggactacaggtacccgccaccatgcccggctaaatttttgtattttttttttagtagagatggggtttcaccgtgttagccaggatggtctccatctcctgacctagtggtctgcccgtctcgacctnccaaagtgctggaattacatgcatgagccactncgcctgacccttatttagtcttaagtaacttaactgaattactagtaatttttaaaaggttggaatt

SEQ ID NO: 678780 - DNA, 282 bp, Homo sapiens
ccttgcgatgcaattgaccagagacggccaatgcatcagaataggtctcattggaaaactgagcagaagagctgggcctggaaagagacttcctggacatcccagtgccttgtagtagccagcacaatggtctatgagacctcaggtactgtccaggagggtactgtggtctggtgtggaaggggtcaatatttcctattaaagaaggagtgtattaggggtagataagaactcagccatctctaccctaatttaagaggaagtcggtgtgagtccttgggc

SEQ ID NO: 678781 - DNA, 100 bp, Homo sapiens
aagtatggctacctttcacttccaaagccaatgaagaataatgcaaacctgaaatcattaaaaccagacaagcctgactctgaggagcaagccaagatag

SEQ ID NO: 678782 - DNA, 862 bp, Homo sapiens
ttttgcgattcttccatactcagagtacgcacggtcctgatttctcttgggattcttccaaaatcagagtcagatgctcccggtgccatgaaggagacgacgcctttgcaaggagacccacgttggtgctcaattaccagagaagatccaaaaggccttcgatgatatggccaaatacttctctaaggaagagtgggacaagatgaaagcctcggagaaaatctctctatgtgtatatgaagcaagaaagtatgaggctatgattaaactaggtttcaaggccaccctcccacctttcatgtgtaataaagggccgaagattccaggggcacatgatttgataatgaccctaaccgtgggcactcaggtgtgaacgtcctcagatgacttgcggcaggctcagggaatctccccgaaagatcatgcccaagaagccagcagaggaaggacatgatcggaggaagtgccagaagcttctgcccacaaaatgattgcgaaagagctgtgccccccgtgaaaaccaatacctctgagaagattcaagagagatctggacccaaaaggggggaacatgctggaccacagactgctgagagaaaaacaggtggtggcttattggagaagttcaggactctgaggaagatgcgggtacttctcctcaggtttcgacttgcccttggtgggacgcgacgtggtgcctttcggacctgtgcttgtgcggcctcttatcacgtgcttccgttgagcctttccccggcagttcggcttttgtgccagcgggggccggtttacaatgctcgggcacatcttgggcctctgtgtgggtccccaaacttggctgggacccccgtaggggggtcgc

SEQ ID NO: 678783 - DNA, 626 bp, Homo sapiens
  misc_feature (588)..(588): n is a, c, g, or t
cttggtccctttttggtttgagaagtatttttttcccgcctttaaatgtcttcgatttcctacgcaaacatttcgtgtgtggaaactcccttgtttttttaaattaagcgttttgcctcgtttttccaaatcttggcctttggttcggttgattattcgaccgttataatactgggtgggcgttttcttcctctttagtgagaagggtcattagtgtttttagagtggggccaaaatgttgtatttcccttgtagtgattaaatttcatgggtgtctttttaggtgtttgggaggtacaagaggttctcttcaaccattagtttttctggtgagccacagtgtctctagcttgtgggtcgccccctagtgttgattcaacgctcaaggagtggttgcctcgccatgtttgttgtaccccgcttctttgttatagaattgctgcaaaagtgaagagagggttctttgtaggcttttgaatagtgtaatgctggggtgggcgctcagagggggaacaacgtaaaaatattgtccgttggtgggggatcacaatttgtatccacaattccccgcctctgtgtgtgccgtcnggtgaggaaaaaaccactaattgttggcttggagaagg

SEQ ID NO: 678784 - DNA, 975 bp, Homo sapiens
cttgtgccttctctttgtggacctatttatcccataggtaccatcccgcccaccttggtgggttgcccctggcatttgaggtgtggtgtccccacctgggccgctttggtggatggcgcccgcatgcccccgcgtggtgtgttccctccggggggcaccctggttccctgcctgcgctggttggaaacccccgtgggacgggaatcctttctctgttcaggggagcccatggggtcaactaggctctcaaacgccccaagggtttctccacatctctatctccgcccccccaggagaagtgtgtgagggcaccccaagggttgttacccatctcttctctggcactaagtgaaagtgaatatagttgtgtcaccccccccacactaagcccccacttttggttgtccccaccctgtcacatgcccttttcacatgtgttctcccctgaaccttgggaccacatgggcctcggtccggagtttttctctggcccccacagaggataaggaggccttgcacacatgtcccgcgcggagggacccctgagaaggttctcaacctaatgtctttgccggcacaccccactgagtttctatgaggagaaaggccaccgccgtttccacccctgcggaagagtgcgccaccccggagctattttggccccccggtttatgtcacgcccaacacaccctggcccatgagctgaaggacggacgaaagaaatattcacaaatggggttgacagtgtccacgagtcttctgctcacgcttcccctgcgtttataaggcctgccctatgcccgggctccctcctgcttccacgtagccctctcactggcactataggctcgcacaccccacccgaaggcgccagactaggatggcacctttcccctgctcggaagggttggcctgcctggctggggaggtccagttaactttgaattagtttaaaacaaaagaataaaaaataaa

SEQ ID NO: 678785 - DNA, 439 bp, Homo sapiens
  misc_feature (41)..(41): n is a, c, g, or t
  misc_feature (165)..(165): n is a, c, g, or t
  misc_feature (168)..(168): n is a, c, g, or t
  misc_feature (188)..(188): n is a, c, g, or t
  misc_feature (216)..(216): n is a, c, g, or t
  misc_feature (436)..(436): n is a, c, g, or t
tggttgggggtctctggacaatcaggggcagcatcagcagngaccctgggtgtgggggggctgtgggagtagcagcactggatccccgcgttgacaggtgccctccttaaacctcttgcagggaatgtcttgagccgggcagcccgctgggccacatcttccggnggntccttccgcctgttctgaancagcctgcgtctctcctccatagcttcntcggccgccttgccccctggccgggcacgaggccggggaccccagttgagcctccgggttaagcctaggaagcgcttgagtcatcgctgtcgggagctggggttggcatcttcccggatggtagaagttggcgctgcagcctgggctccacactgagaatgcggaacgtgggctagtctctgatagtcgctcccgtttcaccggaaattccttctcccancaa

SEQ ID NO: 678786 - DNA, 275 bp, Homo sapiens
  misc_feature (143)..(143): n is a, c, g, or t
  misc_feature (269)..(269): n is a, c, g, or t
gaattcggcaccttaaatggtacaaggttctcctcatacataatgtttggctcccttcaaaacacaagaaacaagccactcacatataacaatggccgtactgtcctatatctaatcctactagactcagttccttgaatttntttcaaatacatattggcccccaaagagctgggggcgtggaagagcagataattggggctcaggcaagggtggttataggctccagacctgcaggcagagatggctctcagaggaaggttggtttnacttcc

SEQ ID NO: 678787 - DNA, 292 bp, Homo sapiens
tccatggctccccactgtctttttttgtctcctatttaggacttttaacctaatttaaatttaggagtaggcttttatgtcccccacgcccccctgtgtagggcagaagggtcacacgcaaggttgccgcttcacacttgtagggttgcacatcggtcaggcagaggcgctcctctcttcccagacagtgtgggggccagggagaggcgctcctcacttcccagacagcgtgggggacagcaataggtgctcctcacttcccacacggtgggacggccgaacagaggagcat

SEQ ID NO: 678788 - DNA, 320 bp, Homo sapiens
aggtcaggagttcgagactagcctggccggcatggcgaaaccccatttttactaaaaacacaaaaggttgccaggggtggtggtgggcacctgtagtcctaactacttggaaggcttaggcaggaaaatcgctttaaaccgggaggtggaggttgcagtgagccgagattgcatccctaccctccagcctaggcaacagagcgagactccctttcaaagaccaaaaaaattttttgagatatttccacctagtttagaaatgacctttatcctccttatgaactaatccagagatttaacaagattgtggtttttcttga

SEQ ID NO: 678789 - DNA, 357 bp, Homo sapiens
tcacactagtcaagacactggagagtcctcatgggacaagatgtagtgtgtagtagagaactgcatgatgatggctagcttccatatggagtcggcgggtgtctgatgcatagacactgaattagaaagagcagaaatgtaaccagcgtgttccctatcttgggctggtagcttaaggggtctactgtcattggtcaaaaatttcatgaggagacccatcactaatgcaacaactctaatgagtctaagttggagagagctcagttctaaagcttgggggtagacaggtcactgagagaggaggaatgaaggagtgggatctgaacattgtcctaagtcatctagtagctctgatca

SEQ ID NO: 678790 - DNA, 269 bp, Homo sapiens
tacagtgaagtaagctagagaaaagcaaatgctgttaagatgctaggcatggtgactcacgcctgtaatcctggcagtttgggaggccgaggcgggcggatcatgaggccaggagttcgagaccagcctgaccaacatggtgaaacccgtctctactaaaaatacagaaattagctggatgcggtggtgcgcacctgtaatcccagctactcgggaggctgaggtaggagaatcgcttgaacctgggaggtggaggttgcagtgacctg

SEQ ID NO: 678791 - DNA, 266 bp, Homo sapiens
aacataaaagaatagatgaatgaagcacatgtacagcatctggaaaatagcctcaaaggggcaaatctaagagttcctggccttcaagagcaggtagagagaaatcgggatagaaagtttactcaaagggctaatatcaaagaattattcccaacctagaaaacgataccagcactgaagtacaagaaggctactgaacaccaaccagatttatacccaataaaactacctcaagacatttaaccaatcagactccgcaaagatca

SEQ ID NO: 678792 - DNA, 921 bp, Homo sapiens
ttaggtcaatgcgcccgcccagatgttcatgtgcatgtcctgcctgatgcccatgcctgcctgcatgatctgcctgccatgtatgcatgccttctgccatgcatgctgcctgctgggctgtgaacctgtgtgctgcatgtggtgatgctgatgccctgtgcccctgccatgcccatgcccatgcccatgcccatgccctactccctccccacttgccatgtggcatgcatgcctgttgctcagatgatgaatgtgttggatgtgaatgaaagtccaagaccctatgcactgctgctgcacctatcattgtgaccattattgattctcatgcaaagccgaactgattacattgcatgccatgaagatgtgacttgtggacctgtgtgaccttgctcctgtgaccctgttgctcttggtgagaacgcgaggcatgtatgaacatgaccattcactgtgctattgttgtaactacccaccttcctgtgaatgtgctgtgtgtgactacatgattctgatgaactattcttgaacgcatgtgagcttcctgtgtgatttggccttgaatgctcatttgctttgcttgcttggaagtgtcaattcctcacgtgttgaagccgcatttgtgcccaaatgctcatgcaggctgatgtggccaatgaatttggacgatggttgccatccaaaattgattctcccaaacttgtactaaacataatgtggcacccttgtgcactttactccactattgccatttgccaaacgtgtctggtccaacgaccttgggtatgtacccattactgatatagccaagacacagaaaaatctggtttgtgatttgggtgatactttgttgaaactgcattaaaccccttgggaggcaatttatattctttggtacccaactcattactttgctgctta

SEQ ID NO: 678793 - DNA, 757 bp, Homo sapiens
ggcagaaaatacgcaagaggaactccgagaattccaggagggaagccgagatcgcgctactgtactccggcctgggcaacagagtgagactccgtctccaaaaaaaaaaaaagggtgtcttaaacctctgaaattgtgccggcttcttaagcttctcatggagatccctaagaggtgcgtccgagtttccagagtaattttccagaccaaccagcgtcagggggaaatctgacctctttgggcaaactggcgatcattcatttccctgagtccccgggtgggggtgggggggaatctggcctcaggaccctgaggggtcttgggggcaagagggcctgggtaatgcagccactaagaacgggacttcattcaagggcttaatggaagtacccgggggaccatcaggtaaatttaaaggcacaagatcttggtaggaggcttcctggtcaaagacgtgaccgtggggatttccaacgcaccaggtgtgtccactcatcactgcttgtaggaactgtgtctctggggacacgagttaaaagaacacactaatttctggagtgtgcctgagttcacggcttcattgtgttactaggtatttctggagaccagcaaaaatttcgggtggaaaacagaccttccagtggtactgaattcgagaagaatagcggaggggtgtttacctagaaaatctaactgttccaagagatgtctttattcttaagataataacagagacgatgtggcttgtggtttggtg

SEQ ID NO: 678794 - DNA, 349 bp, Homo sapiens
cccatacgagaaccttttgggctggctctgtgctcacacctgtaatctcagcactttgagaggctgatatgggaggatcccttgagaccaggagtttggaccagcttgggcaacatagagagaccttgtctctaataataataataataatgataataataataataataataataaaattattcaggtgtggtggtgcatgcctgtagtcctagatacttgggaggctgaggcaggaagattgcttgatccctgagttcaaggctgcagtgagctatgattgcaccactgcaactgcattgcagcctgggacacagagcaagatcctatttctagaagaaaaaaaaaa

SEQ ID NO: 678795 - DNA, 649 bp, Homo sapiens
  misc_feature (498)..(498): n is a, c, g, or t
gctgcgatggagaacgcagcaaggccaggcggcggtggaaaggctgtaggacacactctagacatgtgtgagatcccaatgccgggcatccgatggccaaatccgtatccccccaatattgggtgccctggagggttccatatgcctgcccatccacacaactacttaatccgaccctgttctctcgaggtgtcatgatcctacttctctgctgatgagtggcggattctgacacatatatatcctcatatagaggatatgagcatctcttgtcgctggagccacgaggaatagcatcgcatagcacggaaatggagtcctgcactgatactttgtgcagtcatgtcactcgcagttcttaatgaggttcgattgatcatagatatcacctttggaatgctgaccattgcatcgaggtcgggagaacgaatagctagcacgcgggagaagtcgcgagttcaacaataggtccaattgctaatgtttttgagaccacangtgggacactggtcatggatgcatatgacgctctgaaatatccaggctccatgacagtcttgtccatagaaagaaacataactgtagtccaagttctatagaagtagccctctttctcctggatcttgctgaattagtggcttggggggag

SEQ ID NO: 678796 - DNA, 81 bp, Homo sapiens
ctagaagattcagcaaagtacttttgtgctcttggggcctaccgcttcctaatcggggggccgtacaccgataaactcact

SEQ ID NO: 678797 - DNA, 162 bp, Homo sapiens
agggcgaactttataggatcccttgttaaagcacacttttgcaaacgctaaagagctatcaatcgggcaatcctgaccgtgtacgggccggccgaggtttcctcattagtgtttctgcgaccatacacacacatttctgggtttattagccaaacagaaacc

SEQ ID NO: 678798 - DNA, 127 bp, Homo sapiens
ctctagcgactctattatcaccttgagagataaacaaaatttgaaaactttggcggctgcggtggctcctgcctgtaatcccagcactttgggaggcatggtgacgagtggtactagggtggtatag

SEQ ID NO: 678799 - DNA, 116 bp, Homo sapiens
ggacttgcggtgacgaacgacgctggacgggactacggatggctggtactggcgtcccgacgtttccttacttggtcctacacggaacccactttctcgacggactggttggccac

SEQ ID NO: 678800 - DNA, 288 bp, Homo sapiens
tttggctccagccacgaattttatttcccctgggacatgctgctatgctgggactcaagtatgtttactggactcagctcaacatggtccagaccttgaagtacctggccatcttgggcagtgtgacgtttctggctggcaatcggatgctggcccagcaggcagtcaagagaacagcccattagttccagaagaaagatggaaattttgaaaactgaatgtcaagaaaaggagtcaagaccaattcccagtatgagaagaaaaatggaaaaaaaaaaacttttttta

SEQ ID NO: 678801 - DNA, 211 bp, Homo sapiens
acggatagtgaggtttggactcggggtatgcaacattgcacgtgaatgatcttcccatggtaccactggctcgtgacagcacggcagtacactggacacgctgtagtaaccacagaggtcacgctcaggtgttccttgaacagcgctcttgccacttgagggcgtcccggtgaaggtgacaccatgaggcatgtctcaggaccggtcagtg

SEQ ID NO: 678802 - DNA, 353 bp, Homo sapiens
gttagccccggtgttgcgctctagctgtcctggtgaacctgagagtagctgctgtgagaacagtctacatgctctaagtggggcttcttacacggggtcgctgtgatcatcctgggggctgcctgaacgtctctgatcccagatactgatcatgggcggcagcctccaggtaccacaactaccttagtatgtctccctatcattctaatgcccccaggatgagcgacgttattatccccaagttgagaattccttccagcgctgtacttcccaacttttccatgtcactacggtgaaaggaggctcatcgggagagctgttgtactggaccagcccccgcacttgtcccccag

SEQ ID NO: 678803 - DNA, 334 bp, Homo sapiens
taactgcatacaacacgtagtactacgagacaaggaacacagctaccatcagactacctttaagcactatctctgtatagattagtctagttatacattcttactaaattttaatcaaagttaacaacttctttgcctatgataagaatgtcctcccatagctcagagtaatttgatcatctgaagccttcttctctcagctcatcaaagtcattctccatccagctttgttccgttgctggtgaggaactgcgttcctttggaggcggagcggcactctgcgttttagagtttccagtttttctgttctgttttttccccatctttgtggttt

SEQ ID NO: 678804 - DNA, 463 bp, Homo sapiens
tctagagtggcagaggccagtcaggagcttatagataaactcccatctccctgcaacagagcacctgggggaaggggtggctgtgggcgcagcttgcacacacttaaacgttcctgcctgccggctctgaagagagcagcggatcacccagcaccatgctctagctctgctaagagacagactgcctcctcaagtggttctctgaccaccgtgcctcctgacaggcagacacctcccagcaggggttgacagacagctcatacaggagagctctggctggcactttgcaggtgcccctctgggacaaagcttccagaggaaggagcaggcagcaatctttgctgttctgcagcctccgctggtgatacccaggcaaacaggatctggagtagacccccagaaaactccagcagaactgcagaagaggggcttgttagaaagacaactaacagaaagcaatagc

SEQ ID NO: 678805 - DNA, 123 bp, Homo sapiens
  misc_feature (116)..(116): n is a, c, g, or t
aacccgggactcctttgtcactgccttctcagcagcagcctgctcttctttttcaatctcttcaggatctctgtagaagtacagatcaggcatgacctcccaaaggtggtcccggngttgggt

SEQ ID NO: 678806 - DNA, 258 bp, Homo sapiens
agatcatctgaaaggaaggagaatggtgaaggcagagagaagcatgaggaatcaggacattggacaaagccttcacatgattttagaggattaaactgcttcggcatctagtaaactcctcccagaaggaaaactagagacatgcttttccctaaatactacttcagagcccataataaaggtgcatattgaacaagtggatcttcatcaagaatgaaagctgtctgcttcaaagtaaaatctgtcacagtgtcatct

SEQ ID NO: 678807 - DNA, 435 bp, Homo sapiens
catatccggcgggtgaacgtggagaacctgctgcacaacaggaacttctggatcctgcggctgaccccaggcagcaagggagaaatcccctacaggtgcctataacattagatgttatggctgtgtagttctctaagcaagtttggggcaagttggagaaactggcagaaggagctctgcaagccacgtcatgaggggcaactgaaagatgctggtcctctttggactacgccatctccaagatccggaaggatccttctcccagattgaacaaggaaaaggagccctgaaaattagcgccagccatggccccaaagattccaggaatgtatcctgatagacccccaacgaccagggtaaagggcttgggaaaaaggccaagggaggacatcaggtatatatgtgggaaaccacgacgataggcacagggcccag

SEQ ID NO: 678808 - DNA, 300 bp, Homo sapiens
  misc_feature (44)..(44): n is a, c, g, or t
  misc_feature (107)..(107): n is a, c, g, or t
  misc_feature (137)..(137): n is a, c, g, or t
  misc_feature (154)..(154): n is a, c, g, or t
  misc_feature (180)..(180): n is a, c, g, or t
  misc_feature (228)..(228): n is a, c, g, or t
  misc_feature (253)..(253): n is a, c, g, or t
  misc_feature (274)..(274): n is a, c, g, or t
  misc_feature (278)..(278): n is a, c, g, or t
aaagaggacgccatgattggttggcgctggggcggcggacggtngaagggcctggcgagtctatgttttacgcctgtgctggactttctcctctccatgtttccacnccgtggggggctacagagggcgagaagtcngctcagcggaaacctgnatttggttctaatccgtggggttganaacgggtgaccggaaatgatcgtgggactgaccggaagcaaagcctgnaggggaaagagagagcgagacctgngagggagggggcctccatcanaaangggcgggggaaaaggtgcaaaa

SEQ ID NO: 678809 - DNA, 491 bp, Homo sapiens
  misc_feature (277)..(277): n is a, c, g, or t
  misc_feature (423)..(423): n is a, c, g, or t
  misc_feature (470)..(470): n is a, c, g, or t
cctgtcagtggccgtgtggatgagactggagcggagcctgcccatatgccagtaagactttgaaaggtcgcctggtctgccctgcctcctggaagggctgcacataaagggaactggcaacctttctgtcttgtgaaattacttgctggaagctttaggtcacccctggccctgtggagtggggagagctggtggcaagaaggggacagtacactgatgggctatgatgagagaagcctacagactctgggagggttttgaggtattggacagactngtgggggtgaggagaggaacattcgaaagagtgtgacctgaagaactgacaagcaatgctgtctgttctgagaaataaccgagagcctaagaaagggaacctgatactgtctttgcatctgtgagccagtagccctaatgcctttntagttatagatgtgaaaatattcatttagggtttatcagatgcaccngaaagaaagacagtcctccac

SEQ ID NO: 678810 - DNA, 215 bp, Homo sapiens
cgatgtgatctagcaggatccccttatttccttctttattgcgatgtcaacaggaaagcagtgagcaaaaaataaatcaacagacaaggtgaaaagaagccagacagcactgagaaacggcgaaagacagacagcacacgaaggcaaagactgaaaagaaatttgatccactcaaaaaagagtgcagatacatagacactataaagtaaggaaac

SEQ ID NO: 678811 - DNA, 154 bp, Homo sapiens
tggccttagctgtgtcccaaagattctggtgatatcaagactatcaaacaaatctatggtctcacagtcagagcccaagggaaatggcaacatcaacaagcgactcccatccattgtggaagatgaggaagaggaggaggagggggaggaagag

SEQ ID NO: 678812 - DNA, 171 bp, Homo sapiens
  misc_feature (31)..(31): n is a, c, g, or t
  misc_feature (87)..(87): n is a, c, g, or t
  misc_feature (167)..(167): n is a, c, g, or t
ctgaaactggaatgagatagcacattcagtnctaacaaagcatctggcacgtagtaggcactctgtcaatagatggcactgaatgtnctatctcattcagttctgttatactcaatgaaaaaccaactacatttatattgcatttgaggcttaaagggggtttaccngcct

SEQ ID NO: 678813 - DNA, 345 bp, Homo sapiens
gcaccgtccgctagctctgtataaaggatctagtggtccctgaatgacagccacatatggaacctgtggtatgcctccatggcgaagaggggatacctgaagtacatgaaagcgtaccatgtgagagcggatgctcatatagatcctgtcacaccctccaaagatgtactaatgatgctaactgactacatccaaggagcccgagacacacctcctctgagggctgcagagaaacccactcaagctgtcactgcacggctggtcttcccaagagcacaggaggaagcctgcactctacgtccagtcacacatacttcactcttagacttctaccttcacgtgggg

SEQ ID NO: 678814 - DNA, 378 bp, Homo sapiens
gctgggccgactctagaggacccaagctccaacagaaagctcagcattcactagcccagctcttctccccaggtgtgtgtggcttgcgctccctgctgaaggtggggattgccatccatcttgttacaattcccctgctgtcgtcttagcaagaagtaaaatgagaaattttgttgatattctctccttataaagtgtcactcatcttttctagaattttatactgaaatcacatgcctgacaaaatacctgtacagttggaccttcccttccaagtttttcaggtccagcccctcctctttcttgcagtcttgggtattgatgcccaagggtctggaatttaagggcaggcccaagcaccggttttcctaaggggat

SEQ ID NO: 678815 - DNA, 1779 bp, Homo sapiens
  misc_feature (1)..(1): n is a, c, g, or t
  misc_feature (682)..(682): n is a, c, g, or t
  misc_feature (1141)..(1141): n is a, c, g, or t
  misc_feature (1148)..(1148): n is a, c, g, or t
  misc_feature (1157)..(1157): n is a, c, g, or t
nacctctctgtagactctagcgggctataatacatctgtgttgttgtagaggaccacctatgcgtgtgtgatcacagtaaggcgctttttataataaaagcgcggcaattaatcatcttagaaagaagggcgcccttttaccccgaagtgctgcacagaagacttgtcgccacgatttagcgggttttgcccaaagacgccgcccttggggaaaggggctctttctccctcccctccttttggaagtagatgttgtcctgctccccagagttgtaaataacagcggtgggtctccaatggggccgccacatccacagcgcacccaagaaagtgtgcgtccccttgctttgtgtctcccatttttgggccgcctccccacgaataggattagggcggccccacaccccctgtgagatggggaaaaaaatctcccaacgggggtggaaagaccggggaagagcccaaccactgtgtggcgccccgcaaagaagaagacctctgtggaaacagttgggggggccgccctcgccggcgaagagaagcgcctcttgtggacgcccgcaacacccaggggtgtcacacccgtggtgtggtagaaacaacgacgaaaatagtgtttgttgcggcgccacaacgagggaagtatggtcacagaaatatagtgaagtcttcgtaaaccgtnttcaataatcggcggcggggtgtgtgtatcacacaccaaggaggggccccctaaataagagggcttaacacccacaaaacgaggggtgttttccccacccaccacacgacggtgcccttgtgggggtcgaacccacaccccaccagaagagagagcctggtgcctccccccctctcacaagagtagcaccccctcatccggcgagagatctcctcggggcggccccacaacgagttgtggcgcccctcgtgtgtattttgggggcgcccacttgggccaaactctcctctcggtcttctcgctgtgttgaaagaccacctgctatctgctctactggtggggcgaccacaccgcgccgctctcgtggggctcaacagcaaagagaggggtgctcataacaccacttctcacgcctcgcgcacctctgcggatggttattttctcacccatcacgagaangcagttnttgagtaanaagagagatttgtggcacacaggggcgttatcgcccttatatacacacaggagccgcgcacacagctcttgtgatgcacacagagacccacacatgccgtctctctcactggagacttattgtgagcccgtatattctctgacacacacagagagcgacctctacaaccccatacttgttgggtgggcgctgttggtgcccacactcatgggggtgtaagagtgtgaccaccactaggactctttgtgttcacagtactgtaatagaggctgtgtttgtgttgggggaaaacccacagagaagaccgcgggtgtgctctcacacctctctctcgcgcacagatatcctctgtgtctgggtgctcacagaccgcaaacgcgcgcggtctttgtgagaaagaattggcactctaagatttcattgacacccaccctcccacagatttggcccactggccgcgctttccacgcaccctgggaagagagaaagaaaagccactttcatggggaacccctgtaagaaaagaacccgattgccaaggagaaaaagagagcttaatagcccgggcaccagattttcccaattggtggggtttccaataaaagattattttccccctgtg

SEQ ID NO: 678816 - DNA, 900 bp, Homo sapiens
  misc_feature (237)..(237): n is a, c, g, or t
  misc_feature (388)..(388): n is a, c, g, or t
  misc_feature (623)..(623): n is a, c, g, or t
  misc_feature (900)..(900): n is a, c, g, or t
taaaatttttcggctggtaaattctttttccccccccaccccggggcgacagagaagcgaaaacttaaaaaaaaaaaaaagtgtgtgtaccgtgcacactgttgaaacgacaccaaggtttaattctctcttttttacacgagaaattttaactttctccctctttcacaagtgtgcacccaacctcttatagaagtggtgagctctcgcaccttgggcgtgttatctcagccaccncagagctgggcctcctctcaagagaaatatatatttatatttctatgagtgtgtgcaaatgtgtctctccagaacaagagcgagatatctcacacagaggcggtgtatatacaatatatctctccacaagagcggtgttgaaaatataacnctctctcgcagagaaaatctctctcagtgagacctatatatctctgcgtgagaagacacacactcttttatattctccttcccatgtgtgatgaacccctccctgtgttgtggtgttgcaccacaagaaacggcgcagcgtaggtgtgtgtgtagcagcagacaacacccgctgtcgctgtagagaaccgccgcgcagcaaaaaacgacgtagtggaggaccctcacagcggganaagcgtggtgcggccccacatagaagcactcctctaataaacaactagaggagggggacacccactagtgtgtgcccagaggggaggactcctcatcttttatatctcccccacacacgccacacaaaactgctctgtggtgtgcggtcgtcgtgaacacacaaacttttacagaaggcacgcgccccacatgtatctcaaaactcctgttgagcaaaccacacttgtcgtcttctctgaagaaaaaagtgcaaagagaggatattaaaaaggagcn

SEQ ID NO: 678817 - DNA, 164 bp, Homo sapiens
ccggcatgtgtgtaggccagcgatgatggtggttcacaggatgcagtgagtgccctcactctctttcttctttgaatccttgcaggtggacaggtagacagcagcccagcccagtgccttgaagagcccaagcagaagaaaggcagacaggaaaaggcctacag

SEQ ID NO: 678818 - DNA, 138 bp, Homo sapiens
gtatccactcagccacctgtgtctttgataggggcatacagtccatcgacatttaaggtgataattgatagataattattaattggccattcgaacctcgtgttccacttgattctatggttctcttttcttccattc

SEQ ID NO: 678819 - DNA, 355 bp, Homo sapiens
gcgagaccgcgcttggcgcataggccggttctaatttacaagaacaccgcggctgaggccggagagtcccttcaacccgggaggcggcggctgcagggagccgagacggcgccatgccctccagcctgggcaaaaagagcgaaactccgtctcaaaaaaaaagaaaaacagttggccgaaaccaggaagctgcgcgaagtggcgccagggccccttcttctcccggccgtgttgttccggaaggtttccctccgaggcgccccggctcccgcaaagcggaggagagggcgggacgtgccggggccggagctcaagaggccctggggccgctcatgctctccacgccatcgcaagg

SEQ ID NO: 678820 - DNA, 360 bp, Homo sapiens
ggtcgacctctgccccaatcttttctacagagtcctgtccaaaggcatagccctatagtttttaaaatataaatacaagccaggcacatgggctcaacttctgtaatcccagcacctagggagaccgaggtactaaaaacacaaaaattagctgggtgtggtggcacatgcctgtagtcccaggtactcgggaggctgaggcaggagaatcactttaactcaggaggcggaggttacagtgaaccgagattgcaccactgcactccagcctgggtgacagagcaagacttcatctcaaaaaaaaaagagaaagaaagatcgacgcgggcgggattttgatgttgtagtcgacccgggaat

SEQ ID NO: 678821 - DNA, 353 bp, Homo sapiens
acagtagatgcttcatataggtctcagatttagcagatctaaaactgcattccgtgagcctcaatttatgggaggctcattgcctcacgcgtgaggtgatctcaccggccacaactgcctgccgatcccatctcagtagaggatgacatcatcctttgagtcactccgaccaaaaatcctgacatcatcttggactcctcacttactttgtacactccatatccaatcgcagttaggaaatctaattcatcctaccttcaaaaggtgattataaaattatatatgaagtacctgtaattgcctaaagtgaaatattattaacacacgcattagagtaggatacagtagggaga

SEQ ID NO: 678822 - DNA, 1140 bp, Homo sapiens
  misc_feature (1140)..(1140): n is a, c, g, or t
gtccgaggatcgctgaaacggaaagagaaaaaagtctgcgccgagctgcctggcaagcagggcccgcccgactcccttcccggctggtccagtcaccgacctgcggctcctggtggccgacgagggacggatgtgctgctggtgggtgcgcgaggcggcgtggcgatgcgcttgtggactcggcccggcgtcccggctccgggggttctcgtggcctgcggctgcgcctttctctgctggagggccggcgtgtggtccgctgtgccagcccggacctcttccttttccagaagcgtgcccgaagtggacgccacctgattcacgtctgagtgcatggctgtgtgaccgtggcagaggccgtgaaccgcagtggtccattaaccatcgcacagttcgaactttacgcgatgtccctgaccacctgcgaaagtgtgtgaagggcaggccttttaattaacaagcccccgtgcgtgacccaacgtggaccgtggccccggaagtcaccaatctatccggaccagaacctgtatcgttgagtcatagtgagtcccccacgtgaaaatatgacacacctcatggaaaaccgacacgagtggggccaaattaaccacccaagtacactatccatattattggtaaaggcttgaacaggtggtgtcacctataaccccaccgtggtgaaacgagaaaccccacatggggccccaacatgaggtatacaagggaaaccacccgtgtgtcgaaaacaagacacaccactaggtgtgacacctgggtaagtgaacgaccgtgacagttcacttttgccatgtgccatccgtgaagcatgatgagcatgagtcacagagcggagactattgacgcacagggactccccccctattaatggcagacgagtaacggagccaattatcatcagtattgccctgaaacgaatatgttcgcgcacacctaccagcagacgaagaagatagagaataaaggcaaatgcgacggacaacctgagtgaattccgcgcacagaaccagcgttatgaaggacacacaatctttgattcacactagcttacggacatgagcacagtggagacttttggtcaatatagagtcgaatacgagaaagcccatgggcgaaatatan

SEQ ID NO: 678823 - DNA, 370 bp, Homo sapiens
taggggagaatattaggagtaaaatatactcaagacaaatgtatatttcaagttatagagataaaaaattgggttataaaaaatacagagatggagtctcactgtgatgcccaggcaggtctcaaccccctgagctcaagcaatcctcttttcccagcctcacaaagcaatgggattacaggcatgagccaacatgcccagactattttttatatattagagatgacatcttgctatgttgcccaggctgacctcaagctcttgggttcaagccatcctccacctcagcctcctgagtagctgggactatagccatgtcccattgccctgctttgaaagattttatgtagtttcaagaagcaggaactgg

SEQ ID NO: 678824 - DNA, 307 bp, Homo sapiens
cgaaaccagtagtgaaacagtattcacagacagtatagcaatagaactactttttgctgtatcatgtgcaaatgttacttcagattgaggtttccctctactttagtctaaaaatcacaaaacattaaacaatggatatagccctcccctcagttcttgctaattgaggtgtccgtgatttacaaaataaagagttccttaaacactgcaggattcttatttttttaatatcatttatcttgctgagatagcaagtcaagtttataaagaagatgcatttaggaataatcctactggttttcgaggg

SEQ ID NO: 678825 - DNA, 312 bp, Homo sapiens
  misc_feature (208)..(208): n is a, c, g, or t
gggaaaggtatattaaccttctgcatcaaagatgtaacagtcatggggtcttggtggccatctggtctgagttaggtacaggacaagaaagagtcaattaatctataataaagatcaatgattgaaagaagggagatctggtctctgtctctcctagtcatttacagaacaagagcaatgaggaagaccgttatgctataatctaagnaacagaattggaaatatgctactgactcagtctccaggggcttaacttcccccttggcataataaatttaaggagtcctaaaattttattttcccttacattgg

SEQ ID NO: 678826 - DNA, 780 bp, Homo sapiens
actcaagaaaaatggggtaatcccagagccatccaagctaccttatataaaagcagtaaattgagaacccccaccatgatataaggaagggccgtgcctcatggaacaagctataggtggtctcaaggagaataaagaaacacaaaaatgagaatgataggaatcatgaatagaaactgggagaagcacaggaatggctgactagatcatcgtgaaacgtcggatgaggattatcccaggggcccctaaaaactactcttctcctggcagttttaaaagcccagaagccttctaaagccctttcagtcgttcatctactattgagccagacgtcaagagaagacaagtctcgccgaaggaaggtccatgaggtggcaagcatgaagagaacaaggagaggtgctgggagagatgatgacaatgataacttatttcttattaagcagagaagcaaaagaagtcttaagcgcgtcaggcgagcgctcgtgatgtggtttttcatctgttccattgttaggcctttgtggtctatgaaccttctgggcagatgtgttcattatctatgattaattaagagtgagtaaagggtcttgtagagatagttacagtccattctcatagagttactgaatatccagtggagatctgcaattctctgtgtccaacaggatagtgagggaagaaagtacgagagatgaacctggattctcctattcgaatattgtcatctttactcagaatcctagggataggtagaagaattcgtcttgtcaagaaagg

SEQ ID NO: 678827 - DNA, 750 bp, Homo sapiens
cctctgcccctgcccctgcccctcccagcacctgtgcccacaccctgcagccctgccccatggtctggccctgggtggctgatggctgtccagtgtgggtgtcccctcattggcctggctccagtgctgcctctggctcctgtgtgtgtgcatgtccttctgatgtgactgcgtctgcactggcctgccaaccactctgtccacatcgagagagagtagccaacagggaggagaatgagatcctgcccccagaccacctgaactggggtgaatgctggagatggacgggcacctcaatcgcggcttccacacaggagtgtcttcctaggcaagtgacctgggtggctttgattgagtgacgcagagccagcggcggagaccggagtgaagctgatgtgtcgatcattatatccaaggatggatgtgaacactgacctggaagatcagtgccaaggagatgcagcagctggatcatggaggaagacggacgagcacttccagtgaggccatggaaggagagccaagacacacttccgcgccgtggacctgacggggacgttacacgttgtcttgggacgagtataagtgtgcacagtataaggcgagtaaaggccatagcgagaaggaggttgacgatgccatcagtgtcaagagtaatcaattgtacgaggaacacagaagtccggtaaactgaagaccgtctaccagggacagccctgaactgaggaagaagaagatcttatcccacca

SEQ ID NO: 678828 - DNA, 740 bp, Homo sapiens
catgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctcccttagatcaggtatccagagatttttactcctccagtgccaggcagggcctacgtccataaactcagcaggaagtagttacggaaaacagatctccgccttctgcagccccttaagattaaggaggagtatctaatctctgaaggggggaattgaggtaggaggtgggactcaatctggaaggtggggctcaggcatcagaacaaaatgagcacttaagtaaata

SEQ ID NO: 678829 - DNA, 985 bp, Homo sapiens
cactgctaaaagatgggcaaaacacaagacttactgctcgcttgggcttctacatgcacctagcgaaactacagcactgacttcaccacacgcaaactattagcaactggaggcatcggaatcattcctgacacttcattaattacagaggcaaactttacactggacgccaccagatttcagacaccaacaagaaatccggacacaaccactctcaacaaacgctggacacacgacacacacatactccgacggaaacgaacatactgacttcagacctctgactgcactgactcaagcacagcctacccaatacagttactcactgtcacaactcagtactataaaacacataaacataggcgtaacaaggactatacacacactggtgctaacccacacacacagtacacataacttcacactggtacctaagtaacccactagggataccaccctcaaccatcaccatccatattatcccctacgaacggctcatctcacaatacaccacagcttctgtcataaccaacgattacacaacaaacaggctagtccctatacaccctcggtcacataccactcagtctgctcggacaccaatacacatcgctaccaacacagcttctagcaagcagacaacaccacacaaccagaaaacctctaacaaatcacatcaccagggacgcaacgaggaggaacccaaggagcaacatacacaatcaaaaaaacaagaccaacgggcacaggcaaattaccggcgaccacagatcacacatccaacacgcaaacatacattcgcaagagttacaggataaccccactcccatagacgaaagtacccccgaacgaacaaacaaaaacatctgcgatggatttcacaaaagagacaccctaaccgacgcacggacgcagaaggaaaacgaactaaccagcaacaaaaaacacagcaaatcacccaagcggacgctaaaacataccacag

SEQ ID NO: 678830 - DNA, 448 bp, Homo sapiens
cccccagtactctctttcaatccactgattccttcagttgttcacctggggggtggggttgggctaggggttggttagcaaaaaatgagccaaagaagaaaatgaattaaaaacatgaaagaataaaaagcaaactgccatttatgatgaccattatctcacacacagtggacattttaactcaaaaatactataggctcacaggcatagattaaacagaaacctgttcttcatgttcttatttttttgcttgcttcccacagatgagagaaaaatccagccagaattggcatctgtcaagataggcttttagagccacggctccctagagtggtctccacacattctgattatatgcaatctcattttgccatcaagagacttaacccactcccctatccatgtagactttgtaataataaattatacatatatatgactgaaaaaa

SEQ ID NO: 678831 - DNA, 320 bp, Homo sapiens
cggccgggcagggaggagaccggcacccagacaggtgcgacggcagaggagcgcagtggctcacgcctgtaatcccagcactttggcaggtcgaggctggcggatcgcctggggtcgggagttcgagaccagcctggccaacatggcggaactgtctctactagaaatgcggaagttggccaggtgtgatggcacgcacctgtagtcccagctgcttgggaggctgaggcgggagaatcatttgaacctgggagacagaggttgcagtcagccgagatcacaccgctgcacttcagccacctgggtgacagagcgagact

SEQ ID NO: 678832 - DNA, 856 bp, Homo sapiens
ttctgtacataatgttttcttgtaaaaaaatttattgaaattttttcctgattataaaaaactaacacatgttaatgtagagaatttgaaagctaacataaaggaataaagaaaatacataaaataggattgatatacagtcatcccttgatatccgtgaagaattggtttcaggacaccttatagataccaaaatccacagatgctcaagtccgtgatagaaaatggcaatggcatcatatttgcatataacctatgcacatattccagtatacttaaatcttctctagattacacaacatcaaatatgatataaatgctatgtaaatagttattatattgtattagttttaaattttgtatttttttttattgttgcattattttttattgtgtgtggggtttttagttgttgttttagttgttgttgtttctctttgcaaatgttttctatccacagttggttgaatccaggatatgggactcatgcatgcggaggactgtctgtattattttaagctatttaaagtgtttttaaaaaaacttacaaaactcttttatacttaatggcatcaggataaagttccctggacctttggccccttgcgtgcctcccaccttgcatttgaattctgactctctgtattgctcttgtgataaggcattggcttgaggttcctaggaaccacaactctccaggtccctgcccttgtccctgtgggcatcttggtctcagtcctcttcctctggactgtttctcctcatcctttgaattactgcctcggcctctccagaagcttcctgagtttagttttccttcctttcctgttttcctgtttttggactatactgtttc

SEQ ID NO: 678833 - DNA, 189 bp, Homo sapiens
gggcttcatgttggcctcattttaatcgtaaatgcacttctgtaggtgcaaggattgagctcatagctgctctgtgtgtggcaaaagccaaagtgctgtgttgtgtggctgtgtcaagcctggagcgtggtcctgtgagcgccgcctctgtctcctgctaccccactgtagagcgcctgctgaatatgc

SEQ ID NO: 678834 - DNA, 314 bp, Homo sapiens
acgagagcgtgcgtggtcacggacagatggcagacatgtggtaagcagacataactaatatactgcaaacgcctgtttgggagcttaaggcagctaagattattaacagaagccatttcttgaaatacctgcaacgaggtaaccctgatctatgctcttccagccttccaagggtctcgtaagcatctaaaatatcctctttgaaataacaaaaatggttttccttttttttgaagaaagggtctcgctctttcacccaggatggagtgcagtggtgcgatcatggctcactgcatgcaagccttgaactacca

SEQ ID NO: 678835 - DNA, 146 bp, Homo sapiens
cagacacagcacgtatcggccacattaagggtttggcccgagctaactctccagtacttcttgtccattccagctgcttcatgagattgttgcctaatattctagccagctgtacaggtcatgcttgtctcctcctgtagtgtatc

SEQ ID NO: 678836 - DNA, 394 bp, Homo sapiens
atatgacccaaataacagagatcatctcagattgagcctggcaatcaagagtaatacttcaaacatagtagaggttgtacagagatatcaccagtagagcggcctactacttccacagcagtattaggcacagttacggctaaccccagttattctttgccaaagcgtacacgtgaagaggaagaggatagcaccatagaagcatcagaccaagtctctgatgatacagtggaaatgcctcttccaaagaagttgaaaagtgtcacacctgataggaactgaggaagaagttatggcagaagaaagtactgatggagaggtagagactcaggtatacaaccaggattctcaagattccattggagaaggagttacccaggcagattatacaact

SEQ ID NO: 678837 - DNA, 236 bp, Homo sapiens
gagatatccctactttattataaagtaggcttgtgttagatgatttgcccatcagatggctcggggcaggtggtactgagtctaagcacggatgaagaagatagtagaaaacagtctggatgctggtgccactaatgttggtaagtgagggagagttgtaggccacaagaaatgatcagtgaatgtggttgtagtcaagaaacatttgttattgaaataagactatcaagtgtcga

SEQ ID NO: 678838 - DNA, 94 bp, Homo sapiens
cccacgcgtccgataaagagaaaaggaatttttgtttttttctttctcattttatgttgaactaaaaaggattaaaaaaaaaatctccagactc

SEQ ID NO: 678839 - DNA, 108 bp, Homo sapiens
ggtcctttggacatctggatagaatcatggattgttgaaagagaccaagcagtacgttctccatgtcatagattctgtcccgttgtaagaacttgtgaatggcatgta

SEQ ID NO: 678840 - DNA, 113 bp, Homo sapiens
agaggctagggcgggtgggtaaatatttgccacggtggttcctggtattaagccttttgagtcttaagatgacacatccctaggggtcaggtggttttcccgcacgaactctt

SEQ ID NO: 678841 - DNA, 334 bp, Homo sapiens
tgaaattgcaagtctgaaacagctacatatatacatacacacataatggggtatcctaatttaggataccccatttatgtgattcagcaacgcagttaagtacatgggggtttatgggtgggtgtttcgtttttggttttttaagaaagagggtcttgctctttcacccaggtggaatgcaggggcacaatactagctctccacagccttgaactccggggcttaagtgatccttccatctcagccttccaaagtgctaggattccaggtgtgagccaccaggcttgacctagttaagacttggatgggacaccccccggccacacacacacac

SEQ ID NO: 678842 - DNA, 503 bp, Homo sapiens
gcacgaggctttcctgactctgccggcgcggtgccccggttcgttgcaggagacattttgatggtacatcatttttcttgaagctaacatgtgtaatttggtcattaaattgcaagcaaaggggcagtagaggcaaatatcagccggattaagatatatttgtgtgtggtaacaaatagaaatgactatatctactcttagtaacgagaccacgaagagcggatcttgcagcggccaaggcaagaatggtgggaaaggctttacgtatggaaagaagtgcttcacgaaggaagaatggaaggagcaggtggccaagtattctgccatgggcgagctatatgcaaataagacaatacattatccgctgaaaatccagcccaacagcagtggcggctcgcaggacgagggatttgctaccatacagaccacacccatagagcccacactgccacggcttctgttaactacttgtttctaggcatataagactcgagggggggccc

SEQ ID NO: 678843 - DNA, 326 bp, Homo sapiens
gtgtcttgtggtcgtctctgaggatccccatgcgttcttcatgagtttgatgttaggtctacgtgcggctccaagagcctgggagtagttccctgctaagggagggtcagactgtccaacctgttcctgctccggcctccactattgcacatgctagccggagtaggctagagggcggttagactccgaagctctatgttgtttatgcggtgaaacgccatatcgggggcaccgataatgaggggaactaagtcagcttgccatagcctccgactctatgactgggtcttactatccaagacgactcatgacgtacgccatccatt

SEQ ID NO: 678844 - DNA, 1242 bp, Homo sapiens
gtgtgctcttgtcggtctcttgttcttgttttgttttttttttgttgtgttgcattttgtgtcgttggttgtttttgttttgttgggtcgtcttcgggttttctctgttgtgtgctgtgcttttgttgtgtcttttgtttcccttctttgttgttggtttttgtttatttcgtgtcctctttgttgtcttctctttcttttttttttgtttttttcgttggtttcttcttgttctcttgtccagctgtggctccttctgcctctctccgccgctttttttctttctcctctgttcttgttgtttcgtgttcttcctactgtggtcggctgttgtttcctctcccctgttgtcgtctcctccttttctttcctctcctttgcctttgcttgttctcgcctgttttttttttagttgtggttgtggtgtgtgtgttttttgttgtttgttttttctcttgttggttttgtttgttggtgcattggttttttgttgtatttatatttctgtttttattgtttgtttcttgttgttgttgttgttattttggttggcgtctgtgtttgtttgaggttaccccccccccgtgggtggggggtttttaaatatagtcgccgggggtctctttttttttttggtcgctccccgcctctcagtgttgctcgctcggggaggcgcccctctctcctcccccgtttgttttttcgcccccccctctaagaagaacaccctcgcggcggctctgctctccacgccctccccgagggttttttctcccctattgtctccccggcggcgcgcaggataaccaccttgttttctcccccgaggacaccaccctattgtcgccccctcttggcgcgcctctctgtttgtgggcgccccactatataagacacaccacctttttgcgcccacaaaaacccggcggtggggcccgcggcccgcgagagattccccgcggagagagagatctcgcgcgcgcgcccccgcgcgcgcgccgcggtgttttataggtcgcgcgcgcgcgcgcgcgcgcccccctctctttttttttttgtgtttttttttttttttttttttttttttttttaatgtgttgttttatttcccatggttcctccagtttcccttttaaacactttgcactttgctggaccattgccaattttttttaaaaattcccctacccccgtttaaagctgaaaaaaacatttggttcatgtgccttgtttaccaagcca

SEQ ID NO: 678845 - DNA, 356 bp, Homo sapiens
  misc_feature (309)..(309): n is a, c, g, or t
atacagcaactatatttatgtttatctgggcttcatattaaagaacaaaaatgattttaccttaagtgggatataaaataaaggaccttaggaagatggataatatataaacaccaactaggacataatgggaaagtcttgttttttccaggtctagctatttttgatgccagcgggttttaattatgaaaggaatgctttttccatatatttcccctttactctttcaacactaattaatttgtgagcatgtcaattccatatttagttaattgaaaaggaatatccaagaggattgaggtacttctnaaattaaatttttaatgaaagtcatttaaattaaagtaggttgtagg

SEQ ID NO: 678846 - DNA, 298 bp, Homo sapiens
ctgactgaggagcaggtgcagttgacttctaatcctacttccgctcagcgtgcgccttctgcttctcgatcggagtctctactgctttccgcggcgtgtcctttttaggttgggtctctgcaaacttgttagcagcaaactggtcctgcttctcgcacagttgcacttcggccaagacagccctaaactggggctggttaatgcaggtgaggaaccagcgggtggtattgggaaaggcctggcggaaagaagtctctagaacctgcttatagagccacaacagggtgcaagacaactg

SEQ ID NO: 678847 - DNA, 191 bp, Homo sapiens
cggactccaggtatgctcttgagtacacgaaggtgtgcccggtgttctccatcaaggctttcgactacgagaaggtgtacagcctgtagtggaccaatgagcatgagtttatgcagcagacgtggacggtcttataccgtgcagatcagctttgtgaagggctgcggccagtgctacaccgcgccagttca

SEQ ID NO: 678848 - DNA, 1391 bp, Homo sapiens
  misc_feature (1391)..(1391): n is a, c, g, or t
tgacttggatgtcaatattgacccaatcccgttctatgagagcgcaggggccatgttctgcggcgtcgcacgatgctgttttcgcacgcggacaggcatctccagaggaacgattccctcaataattgtgcacaaccacggatgttgctgatgccaaacctgtatcgtatttcaacaaggaaccaatctacaatgtgtctgcgatgcgaatggccaatgcattcgcaatctacaaattcggtaggaggtttcattgatcatggggcatatcacattaatgattcctgggcgcggtgcacatgtcgtcggtgtgagtctgtctggttgattacatacggtgtgcctcttgatgctgggaggcctatgtccataaaacttatacgtatcgttgcctaacgtgctggtaactggagaggaacgtgacgtactaccctacgtatcgtatttcgtttacctggtagggttcatgctttgggaaagaaggcttattttcccgtttagtctactcaatggttatttgggaagaggagtacaatgggtcccttctatagtagtagtagcgatcatttaatatctatcgcgctatataggactcgttagacatctgttatgtagtcgcatgggctattgcgggtaagaatgaacctttggggagaaccatggccttcgataagaaaagccaaaggggtgagcaaattcaccactacagataatgggcataatgcggcacgcattaggggccctattgccaaacgggagaggggaatacacgcggtatatgggtgcccagttttgtatctccgtggggtggaaatgggcctctatagagggacacccgtaacaagtggaaagttgggaaaatggtcatttgaaagccacgtgatgcttccaatgtggcaacgttaaggttattccccttccagaaaatgtttgggcaaccgtggacacttatgggggctaggttaaaagaggattttatacctgtgggaagccataaaagggggttggggtccaagagcagggaggataacaattttgtacgtgtatatgaccaagtgtttatgacccccctttttgggtttcgttattggaagcagcttaagttggtttagcgtggcattggccggttttggtacacgaaatgactgaagatgaaagggtgttgacaataggttaagtggagcaccacaaaattggagttctaaatgttggggaggtggaagtgcaagttggatatatttgggggagacggtgaaatgtttagttagatattcaagtggcgtcgtggaaattgtattgatcacagtgagacattaaaagtgaagtccttaggggaaaaatgtgcgggattactgggacgaagctcaaacgataaccgcatgtggcatatn

SEQ ID NO: 678849 - DNA, 916 bp, Homo sapiens
gagagtgtggtcaggcggtctcgtgattgagcatgacttaccttatcccacttgattgtgcagaatactctggctgtcagctatgtctatctattcaccagtggacttcttctgatatccagtggtgagacgaactgtgataatgcgatgcctcaggaccatggcttcagagcttgattctcagtccctcggtcgtaagattctgctgccagtaagttcgctccctttacctctccaagagaatgaaggatctttgccctggaggaatacttgagacacgatattataacgctgcagcataccagacgcatgtaccatgaaggctgaggtctcgaagcacttgggctgtggagagtgatgagctactgacgaaaggaacgttgcttctcaagggcaatcgagagagaacttatcgatcttgtctgtgacatggcttgatgacgactgtgacccagcagtacctggaagactggcgttcatagagaagcgaggatagtgtaaagtggttgccttacactttggaacgttgtagcgagagaaagtgatactgcatcattgtatctgtgcggaataccattcgatctcctaagagcctgctgacggagagctgaagcgtgactagttatgttctgggaacttgatttttacttcactcatttcctctttccgtaatattatcccagtagaactggctctgggccggtgtcacttttcattttttgaccactcctagactaaaatatttcttagaaagctaaaattgtagcgactagttttagggtaagaatccaagactccacgacttgttaaggatgtcgtataagaggggctaggaaggcggagaaacgtgaacgtgggtcactcgtttcctaaacgggtggaccaccaattggtagcagtttccgtgttgcctcaa

SEQ ID NO: 678850 - DNA, 160 bp, Homo sapiens
catctctcccagaaaaggacaatatcctcttactgatttcgtattcagtttactgaatgattaccacctgtaattcctctttggattgtagagaccggggcatccgcgggtccccaagagacccgacgctatgcttcatggccttttctgggcgcgagag

SEQ ID NO: 678851 - DNA, 1802 bp, Homo sapiens
  misc_feature (869)..(869): n is a, c, g, or t
ctagttctagatcgcgagcgccgcctttttttatatttccggggtgacaaatgtttttattataaccttgtggtcaccactggggcacagccgggcgggggctctgagggtgctgggaacgtatccagcccctaaagtcccccgcacaccccgatcgccgacaaaccatggagcggagccaaagcggccgccatactaatacaaagtcgatcaggaaatgcgaacaagcatgtgtcgcgagcgtctccaccaaggtaaggcggactgacagcctggcacaagcggaaagagtgaggccggctaatcacacgaccgcattagtggaggtacacacaacatatatcatagcgccgcaggagcatattgacgacttaagcgtctagctgacccaatcaccacagcgattaaccccatggatacacctgatgcgaacacagcgcgggctaacaagcactatggtgcagtcactcaagagtatctactctagctcgcagctatcgaatggcaccagcagatgctgaatacgtcggcaccattataccatttgtacatgataccctaatggcagacggacagtcataacgaaccacccagcagtagcaccacagcagctgagcgcacacattgtataacataaaaacgcctcgggcaaacaaggccaccccgacgatcgccccacctcaacgacactgcgtagactggaaacacaacaagaagaggcgacacgcagaatgtcaaccaacagcaataaagtggccacaccccggacaacgaagcgagaagactgagctgaaacgcccacaaaggtgaagggaaaacaacgaggagccaacacgctagccgatctgaggcacgctgagcacactcgnacgtcgaagtaaggagaccggcgcgcgcgcaagcctcagcggagagaaacggagcaggaggtggacgccgacccgcaccgtgagaacacacgaagatgctacgatgaaaacactattcaggccagacggcacgggtgacaaaccggtacacgagcgcgatgctcagacactgagctgcaccaccactacacaacatccacccaagccgtactttgatcaatcagcatcaacaaatcgtgcatctcgcagacgatgccctagggagcgggcgcacagcacaccaacggtgcactccaacacaatgccgaacgaatccgaacatgtcacgacctagtgtggaccggcacgcatgacgtgcagacggcaacagcaagctactcggacagacagccgctacctgtcgcgaggcagcatcgcacgagcggcagcaatgacaagctgtgagtaggagccagacacacaagttgacgcgagacgatagagtgcgagccaagacactccagcgaacaacaccgacggtggaccccaccagcagatgacgcgtacggatcgacacgacgcgaacactaaatctcgtctgtcacctcaccctacaatactacacactgtatgaaccttagaccaaccgcttatcctcatacgtcgaccaccacctctaacactatctctaactatatcacaactatatctagctacatattaggttaaccatcaacaataacacacaactactacaccctccacaaggctacacacactcataccttccttcactaccacttaaacacactatctaagccacactatctagctaccattccactaactacaactacctactatcgttatcttacgacaactatcaatatcacttagctacccacaccacttcaacatgcactagaccaaacgcctaatagtctcctatacctc

SEQ ID NO: 678852 - DNA, 118 bp, Homo sapiens
gcgtctctggaggagcagttccagcatttcaagcttcttgcgtgcatcgcttcaaggccggacagtgtgacgagcagatgctatgtgctagaggcaagagtgagtctatctagaatac

SEQ ID NO: 678853 - DNA, 167 bp, Homo sapiens
  misc_feature (59)..(59): n is a, c, g, or t
  misc_feature (135)..(135): n is a, c, g, or t
  misc_feature (142)..(142): n is a, c, g, or t
accggggaaaaaaaaaaaaaaagcaacgaatgcaggaaggaagcctgcatgctgatggnaggtatgtgagcctaggagttgtgtcaataccagctggccgtcccgtccctgtccctctctccccagcccacactnccaagtnccagtccctgggccaatcattacca

SEQ ID NO: 678854 - DNA, 189 bp, Homo sapiens
tttttttttttcttctctgttgttttttttaaatagagacgaggtctcactatgttgcccaggctggtctcaaactcctgagctcaagtgatcctcccacctgggtctcccaaagtggtgggattacaggtgtgagccaccttgcccatccaaaaacctgtcctcgttagcacccttttaactattcat

SEQ ID NO: 678855 - DNA, 1579 bp, Homo sapiens
  misc_feature (1)..(1): n is a, c, g, or t
  misc_feature (541)..(541): n is a, c, g, or t
  misc_feature (559)..(559): n is a, c, g, or t
  misc_feature (782)..(782): n is a, c, g, or t
  misc_feature (1108)..(1108): n is a, c, g, or t
ntatgcaagtgtggtggttgtttgccacgaggggactcccccgcggccctcgttagatgtgttggtcgacgcagtcgcccggaggtttgtctctcctagggggccaccactgtgtgcgttgtttcccgaggggtggggaaacccacacattggtagagggggggcccactaacatatggggggcccaccaaagaagacctcgttgtgtccgaccccggcgtggtgcgcgtctgtcgaggcccccctgttcttattatagaggccgcaccgaacaccaacacgtggtcgcccgacgtgtccgcgcctttaatcctttaagaggggcccctccacgggagccccttcccgctgggggttaatttactctggttccccccccgggggcgtagttcctcccccagtgtcgaagttgctcccccccgcccctcgccccacaatattccccgggagggggtgtgtccgccccaccacagagaggcggccacagtgtggtcgccaacacggcactataattgcgcacaacgtggagatgttttgtccnttcccggcgtgggtgttngagagaaagaggggttttataagggttcctccggcgctctcctaagaagcccgtgtagagataagagataagaggatttataaaagattgttggcccgccgtataaaaactctctaccccctcggacccaccgctgggcgcttctttgtgctcgccaccccgcgcttcctcgtagaaacacccacccgctcggtgtttcgcacacacccgctctctctgagcncccgcacaaatgtgtgccccctcttgtgggagcacaccagcaggagagagaaagggcggcacacaagtggtttctcggagagccccacaggagagtttttgagccgcggagagagagagagttattatctctcacaggggtgtttcacactctctcacgcgggggcgtctcccaacacaagcggcaccacacagagtctcggctttataggagagagagagagagcgccccccccccgcggtgttgggggagccctcgtcgggagaatttttataacgagagagagagctctgtgggagcacacgagagtctccccctttataggntctctcaaagagagaaagcgctttctctgttcgccaaaaacgcttcgccgaaggagatgtgccgttgtggcaccgagaagaggggttgctctcttgctcgccgcccgcgcgctctatagcctgtgtgagagcctgagcgccaaagccccctgtggcgctccaccacgccacccccctcataacagccctcggtggcgcttccacatcctcgcgttctgcacccacacacccactccaaaaaggagtcgttgtttttttgttttttataaagaaaaggtgaaaattggctctggtttcttcacatgaagcaccacatttgaataataagctcttttttctgtttttcccttgctccatttccttttggggaagaaaatcttgtacctgtatatgggaattgtaaagacaccatctctcgccacctccagcaccctttcaccagaaataaatagttttttttgtttttccaga

SEQ ID NO: 678856 - DNA, 533 bp, Homo sapiens
  misc_feature (396)..(396): n is a, c, g, or t
atgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcagagactatttctaggcactctgcaagttcccagtgatttccttcggctaattctagaggcgtgcggcggagggtacatgtncctcatctctagctgtagctcttctgtctcgtccaattgtcatatataggtgtacttgtgtggttcttaccccaatgactttacacctgacagttgctgtacaagtgaatttgcaaataaagttattactctgatta

SEQ ID NO: 678857 - DNA, 137 bp, Homo sapiens
tagaggatccccaggcaaagctctacggagcgctaacgatttggtggtgaagctaggaaaaaggatccaggaaagagcgagtgcaatttggtgatgaaggtagcaggcgggttggctttgcaaccacacggaggagg

SEQ ID NO: 678858 - DNA, 138 bp, Homo sapiens
aatatatattgttagttctcataaagcataacatctaattaaggaaagggaaataaaccaccgggattaattaaaggaagatgagccaggcaatattcacatattaccaaggccttgatacagaacagaaggtacagg

SEQ ID NO: 678859 - DNA, 107 bp, Homo sapiens
gggggcgcaggtgatctcagaaagatatagtagtggttcagtctctagtaccttacaatatgaatttatatggaacaacaaattcgttaagtaattagttaagatga

SEQ ID NO: 678860 - DNA, 343 bp, Homo sapiens
  misc_feature (28)..(28): n is a, c, g, or t
  misc_feature (244)..(244): n is a, c, g, or t
  misc_feature (248)..(248): n is a, c, g, or t
  misc_feature (250)..(250): n is a, c, g, or t
  misc_feature (298)..(298): n is a, c, g, or t
tctgattccaggtatccagttcatacgntccggttcccaccggataaaaaccaatctccttgccatatttttccagcgctgccggtgaaatcatcgcggtcgccggatgggcagaatattaataaacgctgagaacggctgtttgagggtaatctttaccgttgtcggatcgatcgcttccgttttagcaatattcttatacaggttatagcgtttaagatgattcgccggatcgctggcccgntccngnttcgctttcaccgccgcggcgttgaaatcggtgccatcctggaatttnatgccttcccgcaatttcacgggtgtaagtcaatgccgtcatcgg

SEQ ID NO: 678861 - DNA, 453 bp, Homo sapiens
tggtgtaccgtgtacatgagtagttcttttaccactatcactgtttgcttgactaacctgcccagatgtgagagtagcaaccttgtttggagagctccccatgtggttttagttctcctgcggtaatatttgagtttctgaccctaaaaactcaattacttaggcacaatagcattgggttgattcctttcattccagagagaagtcgtggtcccatagaaaagacaaaccgtaacaatcagttcccgtactgactagctgcaggaacacttgatcctaaccagaccatgatcaccctctggtacgtgactccctttctcagaatagttctgtcataggtacccgaatacatgctacatatagactactgtcaggctgggctcaacgcaggccttataactatggctgcctgcagcgcataaatactggtaccaccacagtacggggcacgac

SEQ ID NO: 678862 - DNA, 953 bp, Homo sapiens
ggacacggaagtagctccgaacaggaagcaggacgaagaaaaataacctgtcctgcgacgcctgagactaaacctggaccctgcaaccaccatgaacagcaaaggtcaatatccaagcaacagccaagctaccctgtgcagcctcctgggaatccagtataccctcagaccttgcatcttcctcaggctccaacctataccgatgctccagctgcctactcagaggtgcttccagtgttgccagatttgaactagactgggaatactcttaggagttggtcactttaggtccttagcgtaaatctgacttcacatatttactcttcacaaagtgctaacatgaataatctaaaacactatataattaggcaaataaaagatcggagatagaaagtgcatatatatgagtgagttaagatgtaataatggcacaggctaaggtgcagaagatgcaatctgcgtactgtgagcccaacaattagctatcagcagacagtgatccatgagactattgacggcagtgtcaatggccacttgttactcaattcttacaagcaaggtataaacctgcactaatggagcacgtgacgcagttagctcagatgcacgagatctccaactagggacatgtcgagaagggatacacatgaggcctactctatcgtgacctcataataaggacaaatcagacacgacgagaagatgcaacccagtgggaggcaaaaggaccgacaacaagatcacagcacagaatgcatgaacgccagcacaggaaacgacacaatgggccacagcgggagcaggaggagcagcgaggacccacgaagcaccaagggtacgggaacaagatgggacacagagaacaacatgagcacagtagagaggaagaacgaggagatacaacgagacaacaacagaccacgagaacgagagggagaagcgagcgacaaagg

SEQ ID NO: 678863 - DNA, 478 bp, Homo sapiens
gaaacgaatgtagttctgcaacaaatgactaatgaagacaaatcatttggtggtccatctggtgagagagcaaaacaggagtatgtctgcaggtacagtgtactgtacccttaggcccatgatttgtacaaataaagaaagagaacttagagacagatagtaaacataaatacaaacctaggcagtggcagatagccgattccattaaataagtaagagagtattaacatagacgagggtggtcgaacctagtgtacagaacaggacggagttgcacaaatgctcgtaactgaacacagtgacttgctaagtttgactagagatccgctttcctctgtaagtactcactccaggaggacactaggcgacttcacactccgttgtcatagttggcgcaactgcgaagtctactgctgaatctactcgcactcgcctatatgctcctcagtgtatgactccgatggtttgcattacacgt

SEQ ID NO: 678864 - DNA, 723 bp, Homo sapiens
gtcctcgagcccttgaatctgacttcggagccctcggactacgctctggacctcagcaggtttcctccagcaacacccggccggcttctaactgtgactccctcgcactccccgaaaaagaatcctgaaaatagccacaaagaaacgccacgcgcgtacctggtgcgcgagagcgtatccccaactgggacttccgaggcaagttgaactcagaacactacagcggaagacgccacccggtgcttgaggcgggaccgatgcgcacagagaccgaggcgcatagagaccgaggcacagcccagactggtggctatgtgccctgtgctgggcacatggacgagtcgtcgttaagtttattctcttacttgtctcactaagttcacatactttatactgtatttatgtacgtcctcctaggtgactggatgactgtgtacgtacattatttattttaaccttatgcaaggttgtgagatgttccccctgctgtatacatgctaggtctctctggtatttattgacgcttctgtgcggactggtggaagcaggacacctggaactgcggccaacgtaggagaagaaatggggaggactcgggtgggggaggacgtcccggctgggatgaacgtctggtggtgggtcgtaagtttaggaggtgactgcatcctccagcatctcaactccgtctgtctactgtgtgagacttcggcggaccattaggaa

SEQ ID NO: 678865 - DNA, 248 bp, Homo sapiens
  misc_feature (196)..(196): n is a, c, g, or t
ccagtcctcctggggcggcagaggggcatctggaaaaacccgtgccagaagccccagcgcaagggcggccctcccctgcccagaacggacacctcagggaccgcagggaatagaaggcacctgaagggtggcacaggcaatcgtggaagatcagatacacaagcaattcgcagacagttcctggtgagaaattacncacggcttcccatggaaaagacaggcaacgccgaaagcttgagggcgaggga

SEQ ID NO: 678866 - DNA, 407 bp, Homo sapiens
ggctgcatcattagaagtgtattcctatggtcagataaaggatgcatttgatcgaaacgcggaacttcaagaatctcctactggactgacttctttaagtcagcggttgaaaactgccaggactcctggcggtgggcagtcatgacgtggggtccaggctggcaattcccatgccctgttttaccacttgccctctccattctatgaccgggtacagacactgagatgcctccatgccaacctcatccaggctcaacgggattacttcaggggctcacacctatgaactcttggtcaaaccaagggcaagtttatccacaccaactgagacaggccatggtggcaccgtgtcatcctcgtcatacaatgcctgatcatgctgctcctgtcaaccccctcttccccag

SEQ ID NO: 678867 - DNA, 935 bp, Homo sapiens
  misc_feature (285)..(285): n is a, c, g, or t
  misc_feature (473)..(473): n is a, c, g, or t
ggactaggtataagaaaggtgaatccgtgacttacgcctgtctgttgaccacatcctgtaggcatcctacgatgtggtgcataatcccctgtaagatcatacggcctattatagtttggtcacttggatcagggatcactcccattcacttaatcgaagactcttatccccgatatagatagatattcgggtcgtcggctatatcaaggatagctatatgagtcatcgaagcctgatcctctgtatcacgcgagcctcgaaaaagatagcctcaccgtgtcgtcnctctataaacgacgttttacaacctaaggagcctcatgtgtcctccgactaaaaataatcgcatatcctcatggctatgcattaaggtctcgcttcaccactagagttccaatcgactcaagaaaatacatcaagctagtggataaatataagacactacgacgagcccagagaccttgtgaatcgangaacgtatacgagcttggatcgtcactcgtgtgtgaccgtacactataaccaataatgaactcctctaggttcatccggcatgcacgagacgcttatatcccaagttgtctccactttggcgtggaaaaagaggacggtaagagacctcacgtctgcgcttgtgctgagtctttcaatcacgtatcgattgaatttccgcactcgaaggcatgaggtgtgctacattactattggcactgcaccttcgataggtcagattccatattgagcgagagtccgctatttccgtggcgatttatctcgggatgtgcaattccggtcgaccattaaggcagatcgagatcttatgcctaacaagttcacagaacctttagtagacgacttgacagaccatataataagcaccctgtttcctaccttccggcataaaatccaaagggccgtcaattcgggatataagt

SEQ ID NO: 678868 - DNA, 325 bp, Homo sapiens
ggatcctgacgttctgggaggagaacgaccgtgtacagtgtgcgggaggcctcggaaaggtacatgggtcacctgacaaggagtggccggtgccctggtgcagaacacggagaagggggccaatgcagacgcagttggggtagttgctgaaggagcttgccagtgagcagcaggagcagtgggaagccttcgtatcgggggccccctgggggaagcacaacaagccgaaccatggtggccctggttgaaaacccaaccacctaaaattcctccagttgaggacttgacggacggaccggggctccaagggagttcaaacttcccc

SEQ ID NO: 678869 - DNA, 438 bp, Homo sapiens
caccacccagtcactctagcgtcgctggcctgaccgcccctgcctacagagtcacactccaatcctcccgggcaccttccttgaaggactggctaaggttgcaccaataccaccttccactgccagctgctgtcggggccgtgtttggctcacccaccctgcatcagcgcccatgtcgccgagaagcccgacgacccccctgaactaccttccctccgcgtgtgcgcggaggccctgactctgggagcacgcacgcacaactacgggacttgcgccgccgcctgcgtgtactttgccatagcggcctctcctggtccaagatgggccggctggagggctgggaggtgtttgcaaacacccaaggtgtgagccctgtgctgccgggacctccagccctgcagaatgcgtccagaaataaattctgtgtctgtgtgaaaa

SEQ ID NO: 678870 - DNA, 233 bp, Homo sapiens
tctcatacacggattccccgtaggtcttccatctcgtcgcgatgtgctaattggatgtcttataacaaaaactacacatttctatctgctatttttgctgtgcgcttctggtacctgttttctcactgggacgattgcttctttttcctgggtgacgcttccagaggtctgaaattttcttcccacctttagtctgagatactttatcatgatcgaacctactcgtccaacca

SEQ ID NO: 678871 - DNA, 273 bp, Homo sapiens
agagccacttgatcgattcattctttgcacttgatcatgtcttgacaagtacctatatagatttataaagaagtaagcatcacaactaatggtcagacacgctcatgtccttgatacgacgtgtctatcatcctgagggcattggcgaaacaacacagactatggttcgacgaccggatcctgaccccagcacatcggaagggaatggatccgccacagctctgtttcaagcaaacgaccagaagcacacgcgtgtggctaaagaggtcgagg

SEQ ID NO: 678872 - DNA, 246 bp, Homo sapiens
cgcacaggtggctgctcatggaggctctgggctgctctggctctgtgggcactgctgcttggctggtggtctccgcaccttgaaaccaactccaagcgtgttctcctttggggagaaggctaattgggcatgaaaaggccttttgggcacatgccccatccactcacccttagccaggtattgatgggaaaccgaaggtctatctcagcaacggcacaaaactcgcttctaggagctgcattctgc

SEQ ID NO: 678873 - DNA, 138 bp, Homo sapiens
aggtgttatgccctaggggcatctatcagctcccccaagatgagtgagccccagagagagctctgaacgtcaccaagtaaccaggcccagctccaggccccaactccgccagcctctccccgctctggatacctgcac

SEQ ID NO: 678874 - DNA, 819 bp, Homo sapiens
  misc_feature (40)..(40): n is a, c, g, or t
  misc_feature (84)..(84): n is a, c, g, or t
  misc_feature (87)..(87): n is a, c, g, or t
  misc_feature (113)..(113): n is a, c, g, or t
  misc_feature (180)..(180): n is a, c, g, or t
  misc_feature (185)..(185): n is a, c, g, or t
  misc_feature (215)..(215): n is a, c, g, or t
  misc_feature (217)..(217): n is a, c, g, or t
  misc_feature (223)..(223): n is a, c, g, or t
  misc_feature (247)..(247): n is a, c, g, or t
  misc_feature (252)..(252): n is a, c, g, or t
  misc_feature (260)..(260): n is a, c, g, or t
  misc_feature (264)..(264): n is a, c, g, or t
  misc_feature (304)..(304): n is a, c, g, or t
  misc_feature (311)..(311): n is a, c, g, or t
  misc_feature (313)..(313): n is a, c, g, or t
  misc_feature (328)..(329): n is a, c, g, or t
  misc_feature (333)..(333): n is a, c, g, or t
  misc_feature (340)..(340): n is a, c, g, or t
  misc_feature (342)..(342): n is a, c, g, or t
  misc_feature (349)..(349): n is a, c, g, or t
  misc_feature (359)..(359): n is a, c, g, or t
  misc_feature (378)..(379): n is a, c, g, or t
  misc_feature (382)..(384): n is a, c, g, or t
  misc_feature (419)..(421): n is a, c, g, or t
  misc_feature (424)..(424): n is a, c, g, or t
  misc_feature (450)..(450): n is a, c, g, or t
  misc_feature (479)..(479): n is a, c, g, or t
  misc_feature (484)..(484): n is a, c, g, or t
  misc_feature (497)..(497): n is a, c, g, or t
  misc_feature (733)..(733): n is a, c, g, or t
  misc_feature (750)..(750): n is a, c, g, or t
  misc_feature (815)..(815): n is a, c, g, or t
tgttactattgtttttcttttttgtgttgtgttaagtctnggatggggtaaaggtaaggtatagtatttttcatgttccttganctnttgttgcatgtgtctaggatattganagtttagtaatagcttcatgtccttatcaccagagctcttaaaggagacatggaacagagtcggggnaattnttctgctctggccgcagtgcctgctggtcngngatctnttcctgcatcagccttggctctcntgaangactgggnattncagatgctttacatgttgggtagatgatgtgctgactgtncagattntncttctagcaagcgannaggngcatgcncnccccttntctggtttgngtgtttttttttttttggnnggnnnccaccatttgtgcagccatggggttggtgttaggnnngtntttttggagtgggttaggtgtttttntttttttttcgctggtggtgttggttggncagtngtggtttcttttnctttggggcggtgggttgtgttctggtgtcaaaatatccttcacttagcattcgttaaaggcataggagagtgaaagcaacgcctctttatgacctaggctagtgggaaggggaatacgtggattctaagggtaaggggatgaaaaagctaattctatatcaccacaaatgaactgacacataaatgacaccttggctttttccactcatagaaacactcacttcttctagcttanactactaaatctaaggncggcttcatcacagtttgggatatttactgtgctttttaagtaaaggtgaaaagctacatccttnatag

SEQ ID NO: 678875 - DNA, 123 bp, Homo sapiens
gattacagatatagttcatctgtttcctctgagtcccacatagctctcttagagggaacgaatgactcatcatccttgtatcgcctgtgtgtgacagattagtaggcattcacaaaatatttg

SEQ ID NO: 678876 - DNA, 422 bp, Homo sapiens
  misc_feature (6)..(6): n is a, c, g, or t
  misc_feature (33)..(34): n is a, c, g, or t
  misc_feature (63)..(63): n is a, c, g, or t
  misc_feature (73)..(73): n is a, c, g, or t
  misc_feature (212)..(212): n is a, c, g, or t
  misc_feature (285)..(285): n is a, c, g, or t
  misc_feature (313)..(313): n is a, c, g, or t
  misc_feature (332)..(332): n is a, c, g, or t
  misc_feature (389)..(389): n is a, c, g, or t
gaagtncgaagtacggtgtggcgctctaccatnncgctgaacgcgacctcaagcgcctctttntccaagtcgnccctcagaatgtggtggctgctcaaattggctatcgctgacgacgaggccagctgagacgtgatccacaatcgcagctggttgctagagagcctctccggttttgcggtcatcagccggtgtccactgttgaccgcagncgtccgcagttctcggtcacaccactttgggaagtcttgtaggccgccctgcatcattgcggcgatccgctcnacggcgcgttcctcgatctcgttggggntgaaaattgaacataattncgcaattgggccatccgtgacctgactactggaccttaagcggcaaggcttggcatngaagttggccgtttctttgaagcttgacggaaa

SEQ ID NO: 678877 - DNA, 152 bp, Homo sapiens
tgacatcgcgcccatgacatcctgtccagcccctgtgcaatcatcaagctgggttaccttctgagcctcccccacgacacgctcaggagcagaccacctatctccgccactgacctgccatgtgcccaccctcagacagtgcgcctgggtag

SEQ ID NO: 678878 - DNA, 162 bp, Homo sapiens
gacagaggaggctggggcaaagccctagacatgaagacatctcagaaatgaggatctgtactccgagagccgggctcatgcctccctgatgtctgtccaccatctctctgatgcttgtccatccatcctcgtgtgctgtccaagtctccctgggactgtcca

SEQ ID NO: 678879 - DNA, 180 bp, Homo sapiens
tcactatgttgcccaggctggtcttgaactctaggcctcaagcgccttggcctcccaaaatgtcgggattacagatgcgagccactgcatccggcctgaacttcttttcttctttttttttttggagacggagtttggctttggtggcccaggctggagtgcaggggcttgatctcggtg

SEQ ID NO: 678880 - DNA, 100 bp, Homo sapiens
gcgccgcacctacgaccgtgccctccgggcactggccatcacgcagcactctcgaattaggcccctgtatctgcgcttccgtgcgctcacacccactgcc

SEQ ID NO: 678881 - DNA, 247 bp, Homo sapiens
gggaggcgatctagaggatcccgatatgcgtctcacttctcccaaatatactgtgaaaaacctaaggggacaggcacagtggcttacacctgtaatcccagcacgtcgggaggcaaggcaggcagatcacctgaggtcaggagttcaagatcaggctggccaacgtagtgaaaccacatctctactaaatatacaaaaattagccggtgtggtggcacgagcctataatccaatctactcaggaggc

SEQ ID NO: 678882 - DNA, 428 bp, Homo sapiens
cgacctgtggaggctggtcctgaggaaataactgaactggggagactgggctaaagtgaggcttgcagctcacatgggtctctccaaatgaagtatgggagcattctgtccccgcagacacacacaggcagggttgtgtgaaagctaatcaagtgattgtacgaagtggccttgaggtgggggtgagcactgtcgccgttcttaagtttcctcaggcagaaagcagcgatgtagatatctcattcttttatatgtggggctgaggaaggctgggatgcttgtcaaaagctgagacagggcagggtataataggcttgctgcccggggttcttttgtaccccccggggttagggaagtgcaggtatctttggaacagtctggaatgctgcggcgacgcggccgcgaatttagtagtagtaggcggccga

SEQ ID NO: 678883 - DNA, 232 bp, Homo sapiens
tttttttccccccttttttttaaaaaaaagggggggggaggttttccccaagctcccttttccaaaattttttcccgggtttttggggaaaccccccaaaaaaaagcccttttttaaaagggggtttttttttttttaaaagggaggccccccaaaaccggggccaatttttttttttttttttttttgccctgggccccgttaaaggcccctaaaatttttttttggggga

SEQ ID NO: 678884 - DNA, 435 bp, Homo sapiens
ggtgcgcaggcgacgtcctacgacgcgagccagaagaggagccgcaagcccacgaaccaggtagatgacggagagccacagacctcgacccgaggtttacctgggtctacgaattacttgccgctcaccccgatggtgaagcttctgtggcgccctcgaatgaacggagttggcgtgagataccctagccacgctccgcgggggagcgcaccaggggaccttacactgcgagaagagcgacgaccaccgggaggacggacctctatcatgacacaccctaggtcgaccaccacttgcgctggtaaccacagaagacgccgctaacgtccttttttgtcctgtgtggagtgactccgaggtgactggcggcccaatgtggacgaggaaggacctgcgagtgagggaacgagcgatcttatttgacgaaacgcagag

SEQ ID NO: 678885 - DNA, 186 bp, Homo sapiens
  misc_feature (64)..(64): n is a, c, g, or t
  misc_feature (68)..(68): n is a, c, g, or t
  misc_feature (106)..(106): n is a, c, g, or t
  misc_feature (132)..(132): n is a, c, g, or t
  misc_feature (165)..(165): n is a, c, g, or t
cttcaagcctgcggtgatagccgactcaggctcctatttttgcactgccaagggccaggttggntctnagcagcacagcgacattttgaagtttgtggtcaaagantcctcaaagctactcaagaccaagantgaggcacctacaaccatgacataccccttganagcaacatctacagtgaagca

SEQ ID NO: 678886 - DNA, 304 bp, Homo sapiens
ttactgtgagatatgaatagtgtcagagatgttaaggtcatacagaataagaaggtagtggtatatggcttgactaatatttgttgaataattttataaaagaacaggctacctactatttgtgttgaagatattagtgaattaagttccacacccttatgtggagtcctgctaaagtagcgacaataaggaagggtcccgaggttggggagagcccctagttgaggagaatcatgaacaattattgtatgaactattgttagagacagctaatcacaaacgacctgcgggcacaatgacctca

SEQ ID NO: 678887 - DNA, 378 bp, Homo sapiens
agagaagattctcatagaccagtgtgcccacttcactgtgaagaaagatatttgttggtggcattaaacgaagacactgaagaacatcacctagagatattattttgaacagtatggaacaattgaagtgattgatatcatgactgaccgaggcagtggcaagaaaaggggctttgcctttgtaatcctttgacgaccatcactccatgcattatattgtccttcataaataccatactgtgtatcgccactactgttatttttgacaagccctgttatagcgagagatggctagtgcttcatccagccgaagaggttgaagtgtgttctggagactttggtggtggtcgtgtcggtagtttcgtgggagtgtccact

SEQ ID NO: 678888 - DNA, 624 bp, Homo sapiens
atgcttctggcatgataaaatcatggacattaactcaggggttaccattcttgtagagtgtctcttgaaacactctctgcccattttaaaacttgagaatagttcagtatctctgatatttttggccagaatcatcatgtcatgtttgaatgtgttatccctatctaaggaacacccggtgactactgttctcgtatgaactgttcacctgggaaatgtccatggcactggctaactcatattacttctcatgtacattagatttctactattttcattccctgtctcatttaaaccttccttcattcgagtaactcacctacatatttctacttcggcctttcaactgccgactttatatgacttcaacttctttgcactccctctgttccacagagctcctccgtgcttaggaagtgcttcggtcctgccgccctggattctaactcccacctttggtcctactctctaggtagtatctttgctgccgcgttgggccttttaatcctttggtcggcccactcgcgtctccgtcactccgcgaaggcgggtcccggcggccccccaatcagctgactcccgcctcccccggcctgcgcgccctcctcccgttcccgccctcgc

SEQ ID NO: 678889 - DNA, 121 bp, Homo sapiens
gggggggggggggagcccccccgcgggggcggggggggggtttttcctttcccccccccctttttcccctttttttttttaaataaaaaagggggtggggggggttccggtttttccttta

SEQ ID NO: 678890 - DNA, 902 bp, Homo sapiens
gagacgcgtcgttgggttttgtgatgtgccgttgacagacagccgtatttgatggtattggacctgctgcgtgtgcgagtaacgtttgtcgaggtagcccggtcattagaaggaggctccgttctgttgactgatggtgtcgcatgagtttcaaggactggaaccgctattgacctggttctactagtacccggtgctgcggctgtggcctatgtgcgtgccgggacgatcatcctggggacctggttacatggtagtaagacctattgatgggcaattttgctgacgtgtggaagtgactcatccatactccatggccagtctgtcaacattcagttatgaagtcatcggtatgttactatgtcgtctgagagaatggctgagtaatgcctgtgttctttgttgcctgtcatctgtatctacatgtcttataatcagttcaatgctggttcatggagcaactttgcttatcaagatgggttggcgtgattccatgcttctgttaccgactttaatgacttgcgtcctcagttgccgtggttgcctattagttctctcacctatttgccaagaatcgaggaatatctggatcaactacctgattttgcctacgaaagatgacctcctggtcttgtgactccagattgcctcctgtgcattgttcttgtgtactgtgcgttatcatcattcataaggctgtatctaattaactgtgtttggaactggtataagttacatcaacaaccgaaaggtgcgggagaactggtgtgtacccttgcctttgacaccacctcctcagtacgtttggccagctatgcaatgggcgggaaatgcctgaagcacaaccaccactccttaactttacatgccggacgaaatttgccttgaacataacctatacg

SEQ ID NO: 678891 - DNA, 924 bp, Homo sapiens
ctatcatagaagagcttatcacctttcatgatcacgccctcataatcattttccttatctgcttgctagctcctgtatgcccttttcctaacactcacaacaaaactaactgaatactaacatttcagacgctcaggcaaggatagaaaccgtctgaactatcctgcccgccatcatcctaggtcgctcatcgccctcccatccctacgcatcctttatcagtaacatgacgaggtcatactgatcgcctcccgttaccaatcgaaagatcaattggccatcgcaatggtatcttgaacctacgacgtacacccgatgtagcggcggactagatccttcaagttcccgtactatacttccccgccattattcgctagaaccatggcgaccttgctgactccgttgacgttgacgaattcgagtacgtactcccgattgaagcccccattcagtataataattacatcacagaggacgtcttgcactcatagagctgtccccacagttaggcttaaaaacaggatgcagagttgcccggacgtctagaaccaaaccactttcaccgttacacagagccgggggtatactacggtcaatgctctgaaatctgtggagcaaacccacagtttcatgccgcatcggtcctagaaattaaattccccctaatgaaatctttgaaaataggagccccgttagtttacccgttataagcactccccctcctagccccgattacaaacgtcatggccgagccccttaagcctagcctcgcagagcacatcacgtcagcccgtgggaaaaaagtgcgatgtttaaaggggggctcgggctaatagcctggttcttgaaccccacagctttgcgttttcggcacggccagaaacgggcgggcccccacaaagatgggcgggcaatcattcgaag

SEQ ID NO: 678892 - DNA, 405 bp, Homo sapiens
gcaagttgacatcgactaccagaaactgcatgatgccttgttcaagtggcagaccaagccaaagctcgaccatcccatgggggacctcgtgactcatgagggggaaggagttccgagacacgactctaaggagaagaagccaggagatgctgtgctcgatgagctaaggatttcctctgggggatgcccagtaggagcccagatgcccacaagggtcccctccccccatggctgattgccattcagccgatattgaccacccccatcgtatcccaacctgaaaatccctgggctgaactcgcccatccctgagagctgttcctttgggtaccatgctggtggctggggcaaaactccagtggatgagactgggaaaaccctctatggggagggtttggaaccaat

SEQ ID NO: 678893 - DNA, 383 bp, Homo sapiens
  misc_feature (24)..(25): n is a, c, g, or t
  misc_feature (30)..(30): n is a, c, g, or t
  misc_feature (51)..(51): n is a, c, g, or t
  misc_feature (75)..(75): n is a, c, g, or t
  misc_feature (131)..(131): n is a, c, g, or t
  misc_feature (160)..(160): n is a, c, g, or t
  misc_feature (192)..(192): n is a, c, g, or t
  misc_feature (239)..(239): n is a, c, g, or t
  misc_feature (302)..(302): n is a, c, g, or t
  misc_feature (326)..(326): n is a, c, g, or t
  misc_feature (329)..(329): n is a, c, g, or t
  misc_feature (334)..(334): n is a, c, g, or t
  misc_feature (339)..(339): n is a, c, g, or t
  misc_feature (354)..(355): n is a, c, g, or t
  misc_feature (375)..(375): n is a, c, g, or t
gcacgagtttggtcaacaaccttnnttacntgcgcacggccaatcctatgngaactcagcatcccagctcatctnagcagatcctggaagtgatttctgcagctcaggattttttttttaagctacattgnaaatataggtttattttttgcttcaggcnttttcttttatatgtttttttctgcacaatgngtaggaggatttttcacttactcatatcgcggccagatttttaaagnccagctaaggcagcaacagctgtgcgggatttaaagcctatagctcagctgaaaaaaaaggtngggggcagggaaggggagataaanggngaggnagctnggagaagacaagcanncatcttatttgctatgtggnagggacct

SEQ ID NO: 678894 - DNA, 111 bp, Homo sapiens
gatcccccgacactatcgatacgcgagagaagagaagaccccgctatctagtaccaatcacctattactagattaaatcggagtcacctctgagagtaatatatatactat

SEQ ID NO: 678895 - DNA, 919 bp, Homo sapiens
  misc_feature (511)..(511): n is a, c, g, or t
atccaatctttttattggatagatgtatttaatctgtcgtgtatataatggtgtgtcgatccaagttatactgtgaataggaaaaaggatggtgttaaatttgtgtgtatgggtgggagatatattgcgtgacaggatataggagaaaagctgttgttggtaataatttttagcagcgtggccatgatggaaagggacgtctaagcgcttgttaaaagcagttgctgagatgggttaagaggtaacgtaaattgcatggccatgcggggatgtgatggggtcgagaagtttgaacagttgctggtggtggattctccatattatcatgtgattgatggtacataaagggatcgggtagtaaataattgtgtagaattgaagctaaaagattgtgcccacaagatacctggatgggcataatcagggtaccacttaaggggtcagtgctggcactgatctggagctagcaggaagtgggagaattctgctgcagaaagttccctcaatggtncagagatcctgaggagatctattggttttatactggtttttttatcgacataaatgtttggtcggcacaatatgtgttcgataagttaacgattttacagctgatgacaaaagtattaatgggcagtaactttttattaaaattggattggctgtacagtgcttttggttaaaatctgtgacatgtgggacatcctgtgaaagttaacctccacagggagacaacgagtaaagagggggacacagacacatgtgacccatcataagatttcttcgcggaaaatagttactgctgccataaccgttccttctcacacagagcgatgtgcaacaacaaaaacacacacagcagaccacaacacacacacagagaaaacaacacaaaagaaaacacagcagcagacacaga

SEQ ID NO: 678896 - DNA, 480 bp, Homo sapiens
atagatatgagttgtaggaaacatttcagtattcattacgtaggaagagttctctgcactgcatagtattaaagtctccagcgagaggggatttacacaatgccgtgtcgaaggacatagccatcgtggactggtaatagaaggggtatgagtggctccactgtccaaaatcagcccagtagaacgaccattagcaaatgctgtcaaaactgcagtttggcaaaggaagaaggcagggatgttgtagtgttcaaacattaactctgtcagtttctctctcttggctctagtattccacggtgcctctgacatgagaacaggatggagactggcttctgatttgacatgcatttggtaggtatgatccaaaatagctgggaaactatcccagtcttcaaccatcccattttttagaggtgaaatggcctccatattctccctcggaacacgcagagcattagtatctatgtagtaggtggg

SEQ ID NO: 678897 - DNA, 436 bp, Homo sapiens
ctctccctcccacataatttcaaaagatagactttgctgtgatatggcttattgtgatccagatgcagatacgacaccagtcaaataattactgaaagcaacatggcatacagtatgctttctaaacgttgagcattattttgttttgttaatattattaaagtgtatgtatcctgtatcttaacagaagaaagtgatcattgtaggttggaaatttgtaaaattccaaatgtagattggattaaattagtgagaaaatatctaccgaatatacacttcatatatatatagtatgtttactgtttcttttgtataacttccttcgggttacatagttcttttgcacagaacatgtatggcaatctacagactctctctactccctttctatctttattgagccataattgacaaataaaaaatgtgtacaattaaa

SEQ ID NO: 678898 - DNA, 129 bp, Homo sapiens
cactgacacgggggccaatgtccctccttccgccaaggttccgctgggcctctgctgccgaagaccccatggggctgtggagcctggtgccgggggagggggctgtcccttggggttcagctgctgtgt

SEQ ID NO: 678899 - DNA, 367 bp, Homo sapiens
cctggtcatttcagttgcaatgacagtatgctttcagagtggggagaatttaattaaagaaagacatctgggaaatgtactagtggtagaactagagcatgttcatcagattctgatggctctacgtaatgaattctgccaaaagattataatattttagggaaaggttgtgattggataagtcacatttatttattaactgttacccttaaaatatcacttttgtcttattattacgaatggttagaggacagcagggatgcctgacaccaaggccattacccatggattgtgtctatcagaaatcctggaagacgttgatctgccacactctgtgcgtggtgatggaacttgctaagacctgatg

SEQ ID NO: 678900 - DNA, 608 bp, Homo sapiens
cgaacgttcaaggccaggctgggcaatagactctagcaagcccctgtctctacaaagaacatagagattcactgagcatggcggcatgcacctgcagtcccagctgctcgtgggcttacggtcagaggatcactcaagcccatgagctcagggctgcagcgatctatcagagcgtcactgcacttcagtatggacaacatgacaagaccctgactcttagagtacttgtagccagccgatggaacacttgcaattcagtcaccaatgagcatttggccctggctacgtgccaggcagaggtcatggtgcttgtgatacgacagccatcaatccagacaacgactccctgccgaagtgcagctgacattggaatgagagagtgcatacccgcgaagatattgacctgattcagggcggtccagcatagaatcaatgggagccatcgttagagccgatagtctgaatgaagtctgatgaagcctcactgagagactagcacttgggccccgacacgttggagagagaagcaagctaacacctatggtgagcctggcagggaccagctgaggaacatgcttcgccttcaagcttaagtgcacacccatctt

SEQ ID NO: 678901 - DNA, 166 bp, Homo sapiens
ctgtgaggaggaatgaagcggctattacacccagcccagtgacagcttaagccttaacatgcgtgcatcttacaatgaccataaacaatgtagcgaccaagtcagggctggccatcattattttgcgcacagaatgccatgttttcccctggccaacataacgaaa

SEQ ID NO: 678902 - DNA, 743 bp, Homo sapiens
  misc_feature (78)..(78): n is a, c, g, or t
ccgtcccaaagcgaaagccaagtgcacccaagaaggagcaggatcggcagaccaggctgtatgaaacatggcagcacntgatgagaggagcgctttattcggtcagggattatttcaaggatggtggcgacggagacaagattccggaaaccttccaggcaacagtcgattctcgtacccgcggactgaacaattacagcactaagttctggcgccagcaaccttgaaatccttcgtttatccggaggagtgaaggtgggatagcggcactcaggcgccgcccgtgccaaacttccagaccgggatgccaagcttcttcgccttgtcggccagattgtcctggatgccggtgcccgggaagtgcaagaccccgatcggcaaggcctccagcatcgcatcgttacgcttgaacggcgcggctttgttgtgcttcgtccaatcgggcttgaaggcgatttgcggcactttgcggttgtcagcccatttggccgcgatcagctcggcgcctttgggcgatccgccgtgcagcagcaccatgtccgagtgcttggcgtggacctgatcaagcttggcccagatcagccggtggtcgttgaagtcgagcccaccggtcagcgccaccttcgggcccgccggcaggagaacttggttatgcgcgcgcttcttcgcggccaggaaatcgcgactgtcgatcatcgcagaggtcagattgcggtggtgagcttggacccgttgcgcggccg

SEQ ID NO: 678903 - DNA, 170 bp, Homo sapiens
atagagtcgagctgcgtaccctagaatatcatagtggcgagcaacaacttaatatgactagcttaacaatagtttttatagtaaagatacctcttctagagagaccacttatgactccctaaagcccatgtcggagcccatgtgtaggagcctcaggagcctcaggtgta

SEQ ID NO: 678904 - DNA, 112 bp, Homo sapiens
  misc_feature (112)..(112): n is a, c, g, or t
gctgacagcaattcgggccgagaatgtctcgcttccgtggcctaaagctgtgctcggcgcttactctctcttcctggcctcgtaggcatatccacgcgtcactccgaaaggn

SEQ ID NO: 678905 - DNA, 353 bp, Homo sapiens
cctgtctgtcaagaaatgcttcgaatcttctggttcctcagaatagtcacagccctggactactcaagcacacgagtataatggtcaatctgttcaatcttatgtcttgtttcactctcaggctatggaaaaaatacatgcttagtatactcatcacatactgcactgtgacatctgtggtgctggtctataattgtcacttaatttttcatttgtttatgtatgtattagcttatttaaaaagacaccacatgtcatggtactttctttttttttttttggaacctgatttgggctcttttacccaaggcaaaagggcggaaaaaaaacccgggaactctctaaagtcaacc

SEQ ID NO: 678906 - DNA, 312 bp, Homo sapiens
  misc_feature (110)..(110): n is a, c, g, or t
  misc_feature (122)..(122): n is a, c, g, or t
  misc_feature (175)..(175): n is a, c, g, or t
cgactttttttttttgaaaaacagatgcttttatttattgtattggaaacaacttaataatttgcatctctacatattcaaagcagctttctatatgtagagatgcaaantattaagttgtntccaatacatatagaaagctgctttgaataactgggaaaacaactattgcatnggaaaacatatgcaaactagcatcattgtctctagactaggttcttcttattgatctcacgtcatcacaaagcagcaacagcagcttcattgcaggactttactgtttctccattttctagaagctgctggtcgagc

SEQ ID NO: 678907 - DNA, 261 bp, Homo sapiens
  misc_feature (112)..(112): n is a, c, g, or t
cgactttttttttttgaaaaacagatgcttttatttattgtattggaaacaacttaataatttgcatctctacatatctgctttgaataactgggaaaacaactattgcatnggaaaacatatgcaaactagcatcattgtctctagactaggttcttcttattgatctcacgtcatcacaaagcagcaacagcagctctagaatgagaacgtagctgatcgagctatatagtgacatacatcgtatctgcactctactca

SEQ ID NO: 678908 - DNA, 1064 bp, Homo sapiens
atggctggatcgggcctggtttaattggacgagggcaggctggcaggcctcggggcggcttacttcattggcggccgggatgagactatcgagcgcagcggctgcagcctggtgtgggcacagcggaggggcactctccgagcgctgcggccggagtgactggggcgcggtgcaccgcacaccccctgcggcccgctgccggtccgagcgggcgtgctgtctggcccaggattacccttgccccggggcagcgtgatcggaagtgcttgcgagaggccgtgacggcagtgtgaggagcataggaaagcacacgcagggttattggccacgtgacttgtggttgacggcacttcaggaatttctgggcaagaatgaagcattaccggtgtgctcaactttaacagcaatgggggcacaaaggtgggttactgagatgggtttcgcataaaaaagagggccttccgtttaattgttgtgggaattgttagcacgagttgcagttgaggggaaacgtgggtatggggggagttaccacagtgtttgtggggcgcagaaataagtgtttgggggtccacgggaagaaggtgtgcttgcaagaagaatggggctaaaggagaaatgacgggagtaagtggaagaatttctttagcgggagagaaatttaagtttgaattaagtttaatagcgaggaacagagggttggtatttatgaaagcgcagtggagaatattatttagaaatgggaggctaaaatatgaagaggttttataccaacgttggtatcacaggtggtagaaagtggcacagagcctataaagcggcacgatacagtgaacaagcaaaattagatcatagtcgacagaagagttgttgggaacgaaaatatacggaacggggggcagttgagaataatgaatttttcggcacaaaattggcctttgacactgtggtttaacggtggtaacagaattgtgtgcatgcaggaacatgtttaaaaagagggtggcgcacaatagtagcgggagaagttgtataagcccaatggtaagaaagaaagtaggtaa

SEQ ID NO: 678909 - DNA, 992 bp, Homo sapiens
  misc_feature (110)..(110): n is a, c, g, or t
  misc_feature (122)..(122): n is a, c, g, or t
  misc_feature (175)..(175): n is a, c, g, or t
  misc_feature (266)..(266): n is a, c, g, or t
  misc_feature (273)..(273): n is a, c, g, or t
  misc_feature (279)..(279): n is a, c, g, or t
  misc_feature (281)..(281): n is a, c, g, or t
  misc_feature (297)..(297): n is a, c, g, or t
  misc_feature (301)..(301): n is a, c, g, or t
  misc_feature (308)..(308): n is a, c, g, or t
  misc_feature (310)..(310): n is a, c, g, or t
  misc_feature (330)..(330): n is a, c, g, or t
  misc_feature (342)..(342): n is a, c, g, or t
  misc_feature (344)..(344): n is a, c, g, or t
  misc_feature (347)..(347): n is a, c, g, or t
  misc_feature (351)..(351): n is a, c, g, or t
  misc_feature (358)..(359): n is a, c, g, or t
  misc_feature (378)..(378): n is a, c, g, or t
  misc_feature (381)..(382): n is a, c, g, or t
  misc_feature (384)..(384): n is a, c, g, or t
  misc_feature (392)..(392): n is a, c, g, or t
  misc_feature (404)..(404): n is a, c, g, or t
  misc_feature (406)..(407): n is a, c, g, or t
  misc_feature (409)..(409): n is a, c, g, or t
  misc_feature (412)..(412): n is a, c, g, or t
  misc_feature (415)..(415): n is a, c, g, or t
  misc_feature (417)..(418): n is a, c, g, or t
  misc_feature (421)..(421): n is a, c, g, or t
  misc_feature (423)..(423): n is a, c, g, or t
  misc_feature (426)..(426): n is a, c, g, or t
  misc_feature (429)..(430): n is a, c, g, or t
  misc_feature (432)..(433): n is a, c, g, or t
  misc_feature (445)..(445): n is a, c, g, or t
  misc_feature (449)..(449): n is a, c, g, or t
  misc_feature (459)..(459): n is a, c, g, or t
  misc_feature (486)..(486): n is a, c, g, or t
  misc_feature (500)..(500): n is a, c, g, or t
  misc_feature (784)..(784): n is a, c, g, or t
  misc_feature (868)..(868): n is a, c, g, or t
  misc_feature (871)..(871): n is a, c, g, or t
  misc_feature (988)..(988): n is a, c, g, or t
cgactttttttttttgaaaaacagatgcttttatttattgtattggaaacaacttaataatttgcatctctacatattcaaagcagctttctatatgtagagatgcaaantattaagttgtntccaatacatatagaaagctgctttgaataactgggaaaacaactattgcatnggaaaacatatgcaaactagcatcattgtctctagactaggttcttcttattgatctcacgtcatcacaaagcagcaacagcagcatctanaaaaaanagaaanantaaagtcctgcaatgnagcnataattnangctgaaccatacattccgcnaatcctgccacncnccnacantcctttnnctgcctatacaatcctgcntcnnanagggtggncacctagcgaancnntnttnttntnntgntnaanttnntnncaaataaatganagancttaacagancacacagcattaaaagggctagggagngctaggtcttaatncccagtacaataaagccaagagttttctaatgctgaccagtctgaagactgaaattaaatatcagttctttttacttctctaggagtgattctagctcctcttgcaaagagctgagttgctccttttctcggtcttccttttgtttgagcccatccagtacagcctgaaatctgttcttgagagccagattttccactttcatgatgagatcctcttgtcgttttgccctgtcctgggtctcttggagcttgcctttcatgttgtcaatctgcttctgaattcncataaccagctgattggttccttcattttcctggtgctgttcatctgattcatttagcttgtcctgtagctgtctctccagatnttnctccgtgtcaatgatgtttatatcttcttcatcttgatgctgggtctcatcttcatcctcactgctgctgctgaggtcattgaatatctcccgaagctcatcatgttctaatgagtnatgg

SEQ ID NO: 678910 - DNA, 263 bp, Homo sapiens
acatcaagcacatggcaggtgtacctctgcttctgtccagaaggcaccacctctgtcgcccacttatggaaggttccatcccctgcgggcctggtctacacgagctccgtgtcctgcctctggtcctccccatcccgctgccaggtcagtgtgatctccgcagggtagaagctcatggcccagcacctcaaggtggctttatggtcagagacaccgcggtgagtcatatgcgttttgggggcgtccgtgcgctgcagcgtcta

SEQ ID NO: 678911 - DNA, 194 bp, Homo sapiens
atgagcctcttccctatctacccttcctcttctccctcttccaccattccccgttatctaattacaggatgtctagctccacggggtgtactacattatggttactacccacgaggacactgccctctctagataactaacacaaggacattcatcgaaaggagactagatttagctacaagcttttaaggaaa

SEQ ID NO: 678912 - DNA, 928 bp, Homo sapiens
  misc_feature (27)..(27): n is a, c, g, or t
  misc_feature (61)..(62): n is a, c, g, or t
  misc_feature (64)..(64): n is a, c, g, or t
  misc_feature (66)..(67): n is a, c, g, or t
taacacagtatttttctcaaatgaacntgttttttgcagattcttcttttttgaaagaacnncngnnaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacgggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatcta

SEQ ID NO: 678913 - DNA, 964 bp, Homo sapiens
  misc_feature (27)..(27): n is a, c, g, or t
  misc_feature (61)..(62): n is a, c, g, or t
  misc_feature (64)..(64): n is a, c, g, or t
  misc_feature (66)..(67): n is a, c, g, or t
  misc_feature (614)..(614): n is a, c, g, or t
  misc_feature (617)..(617): n is a, c, g, or t
taacacagtatttttctcaaatgaacntgttttttgcagattcttcttttttgaaagaacnncngnnaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacgggagaagtgacatactttatatatgtttatattagcaaggtctgtttttaataccatatactttatatttctatacatttatatttctaataatacagttatcactgatatatgtagacacttttagaatttattaaatccttgacccgcccgtcctgtgtggtgggcggcgnaanttatttattgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatcta

SEQ ID NO: 678914 - DNA, 440 bp, Homo sapiens
gcagataaatatttagtattcattgtatctcatccttcctgtctactcaaaacccagctcacacctattgtgaagcacttccgtggtgaactggtaaagagtatctcttcctttacaggcctatagcagtgtttgttggaaacatttgtaatactttttatcaattgatataatgaacaggtatttcaatattagaatgctgcttatcagaagtttataaaagtgtcttacaaggccagaagtggtggctcacgcctgcaatcccagcaccttgggaggccaaggcgggtggatcacttgaggtcaggagttcgagactggcctggccaacatggtgaaaacctgtctctactaaaaacacaaaactagacgggcgtggtgttgcgtgcctgtaatcccagctactcgggaggccgagacaggagaatcgtctgaacccg

SEQ ID NO: 678915 - DNA, 288 bp, Homo sapiens
aaaaaaaaaaagttcccaatgtcctgggtaaaggttggttttccaggggccccctaagttgttttgccttttaattccggggattccttgggcccataggttcccttttcgttccctttttgttttggttcctctgttaacccgggggggcctaatttctgcccctttgttaaaaccccttttccccaagacccctgaattcccgttccaactggttgttgttgggtaataagggctgttttttctgcccccaaagggctttcccattttggggggtggttttcttta

SEQ ID NO: 678916 - DNA, 1058 bp, Homo sapiens
tgggcatcggcgtcttccccctaccccctctcgcccctataagctcgctccctccgtccctctcggactcggactcggtgccggtgcgcgactgagctggcgcctctagccgactttgccaagagggcgcctcctgcccgatccgcgctgaccctgcgcgggacgcagcccaggcggtgccatagccgaggcgggagacccgagctgagtcagagctcgcccggagcaggtctgtgctggatgcactggaggaacaaggaggccatccagatcccatcttctgcctaatcccccacttggaagaccctccagagaccccagcttcagaaggcaacatggcggacaagctgaaggaccccagacaacccagaggcttccatgaaggacggccgtgaagatcagaaaacacgtaccccagatctcccagactgagagtgcagatgatcggtcaaggagcaaaaatcaatgacgatacacacccggaatgaccagcggaacacatacaagagacacagcgtacaatccaccaggcaacaacgtccattcaagacgaccaacctgacaaggaacagaatgcaatgtctccagtgtacgactactggcaaaatgagctaaacaccaagacagaccagacgccagcccaaccaaagcaataaggccagaaagtcaacagccctgaagcgtctaccacagcacgaaagtcgggagacactgagcggaagagacagcaacagataccagagagaccacacaacaagctgcagcgaaaagacatccaaacaaaacaccaaacgcgtaacaaccaaccgaagaccgaaaacacctagaatagaacaggtaatccccgagcacgaagaaaccagcaaccaaccaccaggaacacaaaggcacataaaaagagaaaacaagaaaaacagaaaacacaacacagatccacagaataaaaaaccaacaaaacacgaaacccgcaaacacaaggacacaagcagcaccaacaacacgaaaagaaaaccacaagacaaaccagagacacacccacaacagaaaagaaagagaaa

SEQ ID NO: 678917 - DNA, 299 bp, Homo sapiens
cacctcagtaatgagtattttggcctcacgggagcgacatatgcctatgaaggctgtagctatagttcgaaaagcaggaggataatgccgatgttgcaggttcctgattagagaaatgatccgtacatatagtgcctcgccccgatgtgtacgaagaggcagatacagaatattgagtgcgccagttgtgcgtgaaggttgcggatgagtctcaggccacttactttacgtctcgcagtgatgctgggcggatggagtgacacaaggctgggtgatgggcggtctgggggagtagttgc

SEQ ID NO: 678918 - DNA, 1074 bp, Homo sapiens
  misc_feature (216)..(216): n is a, c, g, or t
  misc_feature (499)..(499): n is a, c, g, or t
  misc_feature (956)..(956): n is a, c, g, or t
gccgcgtgcgccccgggagcacagagcctcgtcctttgccgatccgccgcccgtccacacccgccgtcagctcaccatggatgatgatatcgccgcgactcggatcgtcggacatactggcttccgggcaatgtgctaaggtccgggcgttcgccggggcggacggatgccctcctcgggccagtcgttcgcccgtccatcagttggggcggcccncaggctgcctaggggcgtgatcggtgggcgatgggtcaggaaggtattccgtactgtgggcgactgaaggcccagatgcaaggagaggcattcgcttcagcccttgaagtacgcccatcggacgctacggctatctgtctagcgcaaagcgtggagacgatcgatggacgatacaattcgtggtcactctacacccaattctaacgaactgtacgctgctgctgtgtgctcccggatggaggtcaccaccgatacttgcttgatcgcgagggccgctcgcgcntgaagcccccaaaaggggctaactcggcagagtacagtatgacgcgcgagaatcattggtctgaagagcgtttcgaagcacgccgcagccaatgttacccgtcttggctatcgcaggactgctgctgaagtccccttggtaacgcacttcctgggcctggtgaccacgtgagcaatgcggtgaattgggcactgccggttgaacgggggatctacccgaaaagctggtggcgccaatctgaccgtagggggttagtgtccctcccgctcatgaccagtccttgcggtctggggagcctgcgacgtggctcgggacggctgtaactggactacgctcattgaacgatcctcagcgcgaagcggcggttacgaagcgttctaccatcaacggccagaagcgcggtagaaatccgtgacgttgacatttaaagggacgaaagcttggttggctagcgtcnggcctggggaagttgcgaagcaaggagactggcccaccgggccttgctttgcgaagttccttcccctgggaggaaagagcgtagcgaaggctgccctgtgcgggccaagggttccact

SEQ ID NO: 678919 - DNA, 326 bp, Homo sapiens
tttttggtttttttggttttggttttttttttttcacgccagaatctaacacagtgggaatgtttgacatcttgaatgcagagggctcctaattgagtttttagctactatggagccagacagcagccctgaactgcaggagaaagcagggttactgaagaaaacccttgaaaatttggaataaattagaaggggaagaaacaaacaagtcccatgttcattgggggttgaagtgggggtgttttttgaaaaaccaagtgggaaaaagtaaagattaatttgtagcatgcatcattccttggctgaaataaaaagaaaaaccctta

SEQ ID NO: 678920 - DNA, 132 bp, Homo sapiens
ggcatattattatgaatattttcatttatacttactgaaaacaaacagaaaaacttatatttaaacatcttgattgaaaataatttggattgatagttctgctaaattccaacatcgtacgcgatgggttgt

SEQ ID NO: 678921 - DNA, 230 bp, Homo sapiens
tgtgttgcacggcaggcccagggctgagcggtgatgggcatacaggtcataagtgcactgtgggccctctccggaccagaccctgggacgcagtgcctcgtgggaccggcgcccgcaggccggagccccgtgcaggctccttgcctgcgcaatgtccgcggggccgcccatcccgtggcctgcttcggcctcgctggggacgtccttggctgcaatctctcgccgagcac

SEQ ID NO: 678922 - DNA, 470 bp, Homo sapiens
tggaaacagagttcttgctcctgtcgcccaggctggagttgcaggggccacaattctcggctcactgtaagctctgcctcacgaggttcaccccattctccgtgcctcagcctcctgagttagctggaactacaggcgcccgccaccacagctgtggctataattttttggatatttttaacgataaaaacagaggttttcaccatgtgtttacgccaggagtggctcgtggatctcctcctgtgaccctcgtgtgactccacctgtgcctgttggcccctcccaaaaggtgcgtggaaataacatgtgcgtgtgacgccaccgaaccccgggcctctcccccttaacttataatttttataaacacccaatttcctcttctcctccagctttcacaacgtggactgaacatttgcctcaacgtgcctcaacaacatttaccttaattgtcaaacgtgaaaaaaaaaaag

SEQ ID NO: 678923 - DNA, 207 bp, Homo sapiens
atccccaacatcatagccaccatcaccctcctctcagctctacttctaccatacgcgctattctactccaccatcaatcacactactcaccatatataacaacgtaaaaataagatgacagtttgaacatacaaaccccagcccattccaccccacacacatcgccctaaccacgcacctcgcacgcccccagcgggggatcctctc

SEQ ID NO: 678924 - DNA, 1480 bp, Homo sapiens
  misc_feature (733)..(733): n is a, c, g, or t
cggaacgcgtgtgtgcatgaaatagtcgtcttaatagttagcgacattgggtacctacagcgtaggcactctgatcgggttatggtgcagcaacatacacaggcttattgcagtcacatatataggcatgctggcactcttcttcaatggcaggttgacatgggcacagcttcagatggttcgtcctcagtgtgccatctaaacacgtgagtaatccagaagctgacatgcgcatagtacactggacaatcgcatacatctagacaggcaattttcaactgtcaaacattgattagagtgatagcgtgtgagcatagatatgttagtaaaccttgtgtatactaagtattaaggtagattgcgacatatggttaacaactagatattatagaagagataagtatatcatacatgtgttaagtcaactagacatattcgatatctgtgcatatacaccaccaaacaattacgtgtacatacgcccccaatgtactacgtatggtggaccgcactggcaccgtgggttacatgactgtttcagggttagtgagacttcctataactgtgcaccccgaaacgtggagcggtatagacctccgttgtagtgaggcagatttacaaataccctcatacaacgcttcctgtatactgtaatgcccttatgtcgccacctaaatataccatcgtaggagcatttgggaggagatcggaccctgggcgcattatcggtacncaaattgttttgcgcacaaagttcacacaagtggccattccccctgtacccacagaggtggtcacattccacgaatatagggcatcgccgcaccacactacggtaacgaaacctgcaatggactggatctatctggacctcaggatactccactgaagacaccatgagtttaatcactcccgggcgaatgagcaaaacaatcgacctcccattagtggaaacaggccacgtggagccaccaagacgaatcgtaggaccaagggggggaaacaacacacaccacagtaaatgcaaagggaacgggacccaccacatggcgggacgggaccgtttcatacggcacatcccaccccgtagaaaaagacgatatcgaagaagggaacaccctatgggactgcaaacagacccacgagggataaaacaacaccgcgcagttaataccctgcgcacaaattcatggcgggcgaacagccgtccccccggcagaatgccgggacaccacaacatcagacaacggcaccgggacagacaacggccctaaccgccgaacgcggagcatcaaacagagccactagggagcacacagaaaatcagccgacaacatcccaacaaagcgcaaattaccggcgccacgccattaacaagaacacatgagcaggagcgcacccacacgacaaaggtgagagcagaaacctcgcagcacgaccccaagcactagtgtaccagcaagaccccattgggggacca

SEQ ID NO: 678925 - DNA, 1148 bp, Homo sapiens
agattacgcatacgataggatacgaggacgcggatagagtgtaatgaagataacactgagtcacgatgaccgttgtacaaaatgctatctcctgtgatcatatgtcgtgatgttggtattgcgaattctgcatgcaggatagtgctgagagtctgggtcctgaacacccgatctggttacagtgacacaggagtcgacaagatgcgtcgtactgttgactcgatctgtgacctggtgatctcatgtgtcacgatggcaagtccgccgtcatagagctaatagaactagttctaccgagacacaatcagagacacatgatattcctgcagacacacgagaagacactgatactgaccattggcaggccgtaccacggtgagggacaggacacaggagttactagattaagtcaccaaggatgactacattgttgggcaccttcgaggcactggtgacccttatttaagatacgcctagggagtgatccttgtgagaagccatctccgaattcttcaggaggacgttggaacgcgagaaacaacattctgatcacggccaagtccgacgttattacacccggcattcatgccgtcccaaaacttcatcccacaggcgcttaccccggactcctttcgatcgtccacacaagaaatcaaacccggctaacccaccagcggtatgtccacacacacagatgggaaatggcttaattcacacacacacggaaagatccacagagcaacacatgtacagttctcccatgtgggaccagtaaacagcaataaaaccgactagcacgccgagctgaaaaacacgcacacaagaagattggggcaacaaacgtgtgaagccattagtagcgtccactcaaaaatacaactgatactacacacgagtacaaatgaaccacggcagtgaatgtacaggaagcacaagtcacaactggcccgtagcggacagcacaaattcatagcataagaatacaagcccccttttgtgaaactgcctatatgtgaactaactaactcccattggagacagtgagatacttgacaagcttacccggaaccctaccgcacagaactagcgtccacgagacaaagtagctcccaaaacacttctcactcgcaccaccacacgactaccaa

SEQ ID NO: 678926 - DNA, 430 bp, Homo sapiens
atctagagtatccccctggcatccacgcatggcggagctttgctcttgttagcccaagctggatctgcagtggatgcaatttcggctcactgtcaacctccacctcccaggttcaagcgattctcctgcctcaggctcccgagtggctggaattacaggcacctgccaccatgcccagctaatttttgtatttttggtagagacggggtttcaccatcttggccaccctggtcttgaactcctgatctcgtgatccacccgcctcagcctcccaaaatgctgggattacaggcgtgagccactgtgcctggccaattagaaaagtgccttttttttttttttttggacataattttccgctcttttgccccttccttgtttggccgggggtccggggctcaatttcgttttcttggtcgtggttgtaccc

SEQ ID NO: 678927 - DNA, 227 bp, Homo sapiens
  misc_feature (162)..(162): n is a, c, g, or t
  misc_feature (181)..(181): n is a, c, g, or t
  misc_feature (198)..(198): n is a, c, g, or t
  misc_feature (211)..(211): n is a, c, g, or t
tgtaagcagcatgaagttgggtcgtaaggtaagtgtcattccagcaagtctcacctctccttctctatgccatggtcttccattagggatgtatttgttgtgggttctagtctactttttcgtgtcctccactcagcaacacttacacacataaacggttcntcgtgggggcagaacacantcctggtggtgtcttanataacgttttccnattaaaagtgaccacg

SEQ ID NO: 678928 - DNA, 387 bp, Homo sapiens
acatctcttgggggccaaaatttactccccctgcttgacaggtactcctgcttacacgaagtccaaggaaaacctaccctgtaacagacacagattcccctacaaccacaactcaaatcctcagtcattacccaaatcccaactctttccacaaaccactgctttgtgcacagttattccagtatcatattggcaaattcacatgtgccaccgtgtcagcttcattgtaactcagcacaaaaacaacaagcttggcaattccattccttcaaccattcccaacaatggtgttccataccatcttttcccacattcatttttgtcaccattccagctcaatcactcctccatcctgttcaacttgctaacccattcagcatttgtcac

SEQ ID NO: 678929 - DNA, 165 bp, Homo sapiens
cccagtagatccgaatgtgactagtgtcttagtccgttttcacactggtagataaaaacatatcccgagcatggtcaatttacaacaggaaagtggtttcactggagaactcacagttgccatgttgcttggggaagcctcacaaacatacaggaagggtctgca

SEQ ID NO: 678930 - DNA, 977 bp, Homo sapiens
ggcgacagatggagctaggagaggagaacggggccgcggggtgcggccgactcgggcccgatggaggaggaggaggccgctcggaagacgagaacggtgacgatcagggtttccaggaatggggaagatgagctcgtgggacgaagaggaaggcgcggggcgacgagaactgggcacggtgggatgcaggcagcctcaacctgcccggctgacgcagcgatgcaacagccccaacagcagctgctggtggccgccaaggagggccgctgggtaagagcatgcgtgccccacctcgctgttctgctggtgactgtgtggcgcctgcccaggggctgagttgcagggccagcaagcagtgctgggagtgggacggcaaaaacagaacagaaaaggcggagatagagcaaagagggggttgttaaaaaagaccacgaggaaggatcaatggccgtggcatatttatctgacgtacactttgaaggcacgaaaccagaggttacttagccaatgaatgacccaaaattcgttccctcaggacaagccttgtttgaagcacagcagcgactggaaccaaccttccgggactggatcaccacgcagggcttggtgtcgtactgagtaactttcattaaatttgctggaatcctaaccaatttttttaaaacataattcacaagagaatccggtctaccagatgcctatctttccccccttttaccacatgggcagcaggcatttgcgcactttattcaccttttggagggacctgggaagcgaaaaggaggcccaattccttattgggttggttgttcagacacagcggcacacaagacggatgactttcaggacggacttgtgaagcggtatacacgagcagagaagaatcccgagaggctaaagggacacattgtgacacatacccagaaaaacgtgactacttggacacaatcaccaatggcacaacatacgcaacatag

SEQ ID NO: 678931 - DNA, 778 bp, Homo sapiens
ggcagggtcttctccacatccccagtccaacagacacgccgttagactttgaggacgttccatggtatctcctcagtgtgttcagttgactcacgtcacgccagcacatcgagagtcccgattcatgccgttccgcatcttcagaatgtgcatgatgacggaaccttgcacagagaagatctgagccgggtggtgatctgactcacgggagagggcttaggtacacatcggatttcttgcagtctgcaagatgaagcggctcagtcgagaacatcctggaggtaggtctgacgatgcgacagggtagtggaacgcatcgaagcctcatctcgagcttccaggcgagagtgcgtcgtcccgtttctgcgccagaacgttattgaccatggttcgctttataggattggtgccttggtgacaaggctagggcccagacgatgtggttccgtggacatcccactgtacgcagcaagaatctgtatgctaacttgcctgcagcctggaggagagcggaaggtcaaggcctgttgttgaccagctggcgggtccaagaatgggcccagctgctgggagtctggctgctttgtgctaggcctcaaccctcagggccaggggccgggaccctcgtagcacaaggggccctcttccgtctacgtggggattggtgatgtgctccgtgttggatgtcctgtgacgtaatccagtcaagtagagaggttggagcaaagttggacccgtatgtggtgacagtgagatacactgggtatgagagcaaagg

SEQ ID NO: 678932 - DNA, 168 bp, Homo sapiens
aggggccacgctctgaaggtccggtcaatggacctcctggaaggcaaggagggaccagaatttggacagtcctctaaggccattcggcttttgaatgttgaccggagagtgccagagacatctgtctgtagcttggttcctccacctccaaagagtgacagactggag

SEQ ID NO: 678933 - DNA, 158 bp, Homo sapiens
tggctgctgtgtccacaaacacctgaatgaccaccccaagaagctgaatgctttagcaactgaggcaaagaggcttgggacctcaagacaagatgttctgtacaaagctgggaccagaatactctcatcaaggtttgcttgcaatagcatgagctcat

SEQ ID NO: 678934 - DNA, 973 bp, Homo sapiens
ttttttaaccaaatcaacaacaacctatttagctgttcccccaacctttcgctccgatccccctaacaaccgcccctcgctaatagctaactagctgactcctagcccctcacaatcatggcaagccaacgccacttatccagtgaacccactatcacgaaaaaaacgctaactctctatactaatctccctacaaatctccttacttataacatgcacagccacagaactaatcatatgtatatatcttcttcgaaaccacaacttataacgccacaccttggctagttacagtacacccgatgaggcaagtcagccagaacggctgaacgcaggcacataccttcctatgctacaccctagtaggctcccttccccataatcatcgcactaaatttacgaactcagcaacacccctacggctcactaaagacgattgcgtaatacatcaagtcatacaactgccgccaaggaactatcaaactccctgagaacaaacgacttaagatatgaagtagctgaacaaatagcctgtgactaggtaagaggatacctcttttacggggactccaggttgatggatccctaacaggcccatgtggaaagcccccaatcgtgggatcccattaagtagttgagcggcactaactgtttaatagttaggcggctaatggtatgagaaagcgtaacttcattttccaagcgcccaggaacaaaagtcgatagcatagccctttcgtggtaaatgtgccgaagagcggaaagacgtaaaacacagagcaatcctgcgtagaataagagacctaaagagagacatggcatacagtagcgaccacattacactcgaggaacagaatttccacagagcctgaggccaccggcagactttattaatgccgaatacccacagcagtggcaggcgacaacgagcgccaggcggataccaagggaaatatccacaatgaacaaccgc

SEQ ID NO: 678935 - DNA, 112 bp, Homo sapiens
tacaagaagaagtatattggtatcgaatgatgtcactcacgtccagcaaagccaaagagctgaattgacctggcacctgggacttcccagacgtgatctcagtgagcggtgg

SEQ ID NO: 678936 - DNA, 163 bp, Homo sapiens
ctcgtggtaccgatcgaaatggggtttctggacttcgtgacggagcgccgccaggccgaaggcccggatgctctgcttttttcagagctgcgctttgacgagaaacacctctactcgcgtgctgcgagccgcttcttctgtggccccgaaacaggcgccggat

SEQ ID NO: 678937 - DNA, 462 bp, Homo sapiens
agggagactctcaagaagaagccttcggttcaggtctcagataggaaatgtctgctgataggagtagtacatagggaagttaaaaagcctcacaaattacatttataagtaacaggatacatcactttaaagatgaaaacctccaggatttgtggcgcctttctttgttctcgttaatcctattttactttttgagtgttagatattctgtaaatatcggcatttgaattcaaacaatagatgttgataactagttctctaacttggtacaaaaacattattattgtctgtcagcagattttgtattctgagagttaaccttctgtatttgatgttttctttgtccatcactattattctagcccgaatactgtcttcctcattccgttttaaaacctttagcagttgttagcacagcgtggcctggtttcaaaaggaatggagaagtcgaattcgggaaag

SEQ ID NO: 678938 - DNA, 530 bp, Homo sapiens
agtcgacggagactctcaagaaagctttcggtttcaggttcttcttgagagctcaatcactgggattcttcttttaacgacttggaaaatgtctgcttgattaggaagttagtcatttcacattttgacatctaaaacaatgggaagttaaaaagcctcacaaattacatttataagtaacaggatacatcactttaaagatgaaaacctccaggatttgtggcgcctttctttgttctcgttaatcctattttactttttgagtgttagatattctgtaaatatcggcatttgaattcaaacaatagatgttgataactagttctctaacttggtacaaaaacattattattgtctgtcagcagattttgtattctgagagttaaccttctgtatttgatgttttctttgtccatcactattattctagcccgaatactgtcttcctcattccgttttaaaacctttagcagttgttagcacagcgtggcctggtttcaaaaggaatggagaagtcgaattcgggaaag

SEQ ID NO: 678939 - DNA, 335 bp, Homo sapiens
  misc_feature (118)..(120): n is a, c, g, or t
  misc_feature (124)..(125): n is a, c, g, or t
  misc_feature (288)..(288): n is a, c, g, or t
  misc_feature (290)..(290): n is a, c, g, or t
gcacgagctaggaggcaacagggaagcttccatctgctgtcctctcgtcctcaggcatgggcctaacatggctcctgtctgtaatcccagtgccttgggaggctggagtgggaggatnnngggnntcctaggagttcgagaccagcctaggcgacacagtaagactctgtctctgcaaaagatttaaaaattagctgggcttggtggcacgcacctgtagtctcagctgctcaggaggctgaggcacgaggattgtttgagcccaggagtttaagattgcagtgattntnacactgcactccagcctgagcaagagtgaggccccatctctttaa

SEQ ID NO: 678940 - DNA, 327 bp, Homo sapiens
atccttccctcttcacggatctacccccaccccacgaaatgcttaaaaggtagcttgactttttgttcaaggctcagtcctttggatgttaatctgactgggttgatgcacctaaacaattaaataattcctcctcaacccctccggtctctctgattccttaattatcccgctgcagtgtctctactaaaaatgcaaaaaattagccaggcatggtggcacgtgctgtagtcctagctacttgggaggctgaggcagaagaatcgcttgaaccccggaggtggaggctgtaaaaaaatcatgccactgtactctagcctgggcgca

SEQ ID NO: 678941 - DNA, 510 bp, Homo sapiens
ggggctgctcagctgcaaggacgctgtaagcaggaggagatgcctcagcgcttcagcacatgagtgggacagggtatcacatgccgtatctagagaggctgtaacatgatatccacgagatcatgaaagccgattaaggcaaggtatccaggcacattctacttccgattttgtaacctatgggaagccaacgatcggaacgaaacttggctgtgcttcaccgtggcagggtatacatggcgccgactcagatgttctccttggatatgacggggtcgtcttcgcgaagaccctaggtggattactgtagaccgcattgtctatgcaagataacggtgcgttccttctgctcggttgtctgcgacgtacatacatgtcatcctaacaaaaaaggtaccggggtcactctggttactgcaatcgttggagacccattgactcagcatggtgtgtccagggggagagtggccagagataccatgggtcagggggaggagccaacgatggaag

SEQ ID NO: 678942 - DNA, 2384 bp, Homo sapiens
aaacaagggaagcaagccgtccaaaatccagggttcctagagccgtatctcagaattttatgcacacaggttgcagttaagtcttgctcaaagttttctgggagaactaagaactttcattgttaatggaagtgtggcaattggagcaggtgacaaagaacaagccctttcgagtccccccttcattcactccacacatgggttgcctttggcgtctgggccacttggtctccaatggtagcagaacacagcaagaatccatgtgttctgcctggtggctgtgtgtggttggcctcctgggggcctgcgggctgggcatggacgccgtggaggacactccctgtgctagactggctggagcgagggcagatagagtggacagggcttggacattctggatgaagagccagtggcctcagggcagaaatgacaccagggtaactcatcaaaatgtgcctcccaggctctagaaaatccctggtagggtctgtgtggcctttgcaggagcatctggcccatctggaggtgggtttgaggggacggggccacaaggaaatggaaacagtagtggggttcacatgtgcgaacattcacagatgccaaagtaggcactcggcacaatccgcttaatagctctcatccagaccacgtgcaaccaatgatgaaggctaggatgggggatgcggtcagggcactagccttgaaaagggggacagggagaaccttcaaaaacaagtggaggaaaggcatcagcagggtgctttcaaccacattcttcctgttgttcttgaggaagtcctgtgtgtgtgcccgatgcctgtgttgcggaagttctcactgtgaactttacagcaatgctgaagcaggaattagcatgcctgattagtggtgatgggacccacgtctttctatccttttacctttaccttgtctttgtcattgtatttgcagtgagcctccttaggcagcatattaatgggtggggttatctttatccaatttcacaatttctatgtttgaattggcacatttataccgttacattttatgtaattatgtgtttggacttattctttgtttcctttccctcctctgttttttgttcatttcccctcccttagctaccttcttttggattattggaatattttttagtgttccatttaaatttactggctttgggccattgttttctaattttttattggtcgccctggagattacagtatacttaggatttttgacagtcttcttagagtctccgctctgccacttcatgtgaggtgtggtctcttcctccacatcccccaccccccattctatctttgtcatgttatcagatttacatgcattgaaaatcctaccaggtaatgtggcaattttgttttcaacagtatagattttttttttctttttggagatagagccttgctctgccacccaggctggagtgcagtggtgcaatcttggctcattgcaacctccgcctccctcccaggttcaagcgattttcgtgcctcagcttgccaagcagctgggactacaggtgcgcaccaccatgcccggcttttttgtgttttagtctctactcagtggtgtttcatcatgtttcccaggctggtctcaaactcctgagctcgggcggatcacttgaggtcaggagttcaagaccagtatggccagcatggtgagaccctgtctctgctagaaatgcaaaaattagctgggcgtgatgttgcttataatcacgggaggatgaggtgggagaatcactcgagcccaggaagtggaggttgcagtgagccgagatcacaccattgcactccagcctgagcaacagagtgagtgtccaccttggctcgtgggtgggaactcatgagcgcccactccaagctgtgtcctctcaaaaaaagtaaataaagtctgctggtgaggaattttacacatataaatacataaaatatttgatttgagtttatcccatctggagttggccaaactttttgattttcataagtttatatctttcactaaattagagaacttttctgccattatttcttcaaaataaatgttttatgtactaatatctttccattccccttctggaacttcaaatacaaaagtgatagatgttttgatattgtttcacagctctctgaagctttgttcatttttttaaaaaatcttttctcctgtttttcagattagataatttctattgatctctttgtaagtttactgactccttcctctgtaatcccagctactcaggaggctgaggcgggagaatcgcttgagcccggtaggcggagcttgcagtgagctgagatcccgccactgcactccagactgggcgacagagtctctgtctcaaaaaaaag

SEQ ID NO: 678943 - DNA, 126 bp, Homo sapiens
ggtgggtccttggcagatgccaagagaactggaagagtccttctctgatcattataaaaggaaagagctgggagtcggatgaagagaagagctaacaccagcgttctcctcctctctggtttctac

SEQ ID NO: 678944 - DNA, 121 bp, Homo sapiens
  misc_feature (71)..(71): n is a, c, g, or t
gtcccgtgcgagtatgtgccacaaacagcgagcaggcgtctggacgtctcaggtgtttgaggcatccaccngcctacgacaagaaaaagcggatggtggttcctgctgcccttcaaggtcg

SEQ ID NO: 678945 - DNA, 206 bp, Homo sapiens
gaattcctgcaatttccacctgaatgtcttctgaagcaaaacagaatgtacctattccttctttcacaataactctttgtcacatagtagggattaacggaatattttattaaaaaataaaaacctgtgaagagcattctggttcttacatttatttccaagctagacattatttctcaattattcacatgacatttcattatatg

SEQ ID NO: 678946 - DNA, 757 bp, Homo sapiens
gggaacgggctgatcgtggaggagggacaacgctgacaccgtcttcggctgcaaaacacgtggccccttacgtgcggctacatcacccgcaaggtaacaaatcggaagtagcccagaaactgaaagaagtggatgatgtgcttggtggagctagctgcctgggagaatgttgactctactgcaaagtctgtgtcccaaatgcgaacatcctccttgcttccttcatgcagcttcagacccggctctgcccaatgagcctgatgaccaccttctacaagtgctgcaatgctcaggtgtggacaccgacgttggcagggattaagggcgcatggatggcgccagtctgccctagctgtgtgccttgccttgttccccttcggggtagatgcttagtctggcagtctgagttgtgtgtcctgtagggtctttgctagctgtggtggatagagatacaacctatttgcatgtgtgaaggacgccagagggtgtcacgggaagactagtggcccctatctcgtcgcaggcgagggctggcatgagcgtcatgaatgtctgggagttgtctctgtgctggaggcaggagtacagtagcacccataactagaatatgctctgtgtaagagtcctattctgttcatcattccacattgattggcagtatgacaattccctttactcccaatcaacaactctttcaatatttgtactgttttgtcaccactgtaggtgacatgtaccttaatatgtaagctgttaa

SEQ ID NO: 678947 - DNA, 753 bp, Homo sapiens
ctctttcccgggaacattccccaacccggttaccccggtccacccgcttttccgggccaaccctttggagatctggtcacctctttatttaaagaggttcccaccgcggggaaaaagggggaaaaaaactcccgagggaaatgtcccaagtccaatggagaagaaaaaaatttcacaaaaggggggtccccacaggggcgcgcaaaaaacgccccaggggtgttaaccgaagcctctcccaaaatttccaccacggggtgtttacggaggaatatccggaggaagaacgcggttttcccacccccggagcctctctccccgggaaacccgccaacacaccccacgccccactgtggtttccttcaattggacgccccgagataggagtttcccatgtccacccacccacggagggccccccctcttcctcggtggtgggccacagttggcaagagggcttggttcatggcgattcccccacggtgggggatcttgccccccacccctccttctagcacctttagagggtgccctctctggggcagaacacccctggctaggtgttttcttttccacaatccctcgtgtggttctggcaagtgagcacgagtcatttttcacctaaacttaatcacgtaggtcacacccgaaacactttctaaactgtccccccattccttttagccccaggtgcctccccccctgggattattccaaatgggactagattaaattgaaaacttgcccctttta

SEQ ID NO: 678948 - DNA, 402 bp, Homo sapiens
  misc_feature (151)..(151): n is a, c, g, or t
  misc_feature (194)..(194): n is a, c, g, or t
  misc_feature (320)..(320): n is a, c, g, or t
  misc_feature (333)..(333): n is a, c, g, or t
  misc_feature (357)..(357): n is a, c, g, or t
ggcctcagcactttagccactagcatctgtagtacagagatttctctcgttggcttcccatcttctcgcatatatctaataagctatatacgctatactaaaaataacaaaatggccattaaaataacgcgaagcgtgtgttttgcctggnctgtctactctgtttgaacaattcgaacacaaaggatctacangtgaatgcagtaggactacagatatgagaacgcagcaattattgagggatgatgccagtctatgcatgaaatctgacctgatctatggcctttagtaaataactaggccttagtgtgcctgatccnttttgttaatcgnctcgctagtctaggcaatagcatngcttttaatagaacaaaataatttcgaagcgcaacgacttccaat

SEQ ID NO: 678949 - DNA, 343 bp, Homo sapiens
  misc_feature (28)..(29): n is a, c, g, or t
  misc_feature (47)..(49): n is a, c, g, or t
  misc_feature (53)..(54): n is a, c, g, or t
  misc_feature (63)..(65): n is a, c, g, or t
  misc_feature (69)..(70): n is a, c, g, or t
  misc_feature (75)..(75): n is a, c, g, or t
  misc_feature (81)..(81): n is a, c, g, or t
  misc_feature (84)..(84): n is a, c, g, or t
  misc_feature (103)..(103): n is a, c, g, or t
  misc_feature (114)..(114): n is a, c, g, or t
  misc_feature (116)..(116): n is a, c, g, or t
ggccagggggggcccgcttaggggtgannagtttgagtcttaggaannngccnncgaataaannntctnntcgtncccaanaanctctagaaaaaactctctncctcttcatgngnatatacttttgctgcagaaataaaagttttctctttatctcttcatggcagacctaagtgtgagaaaaagttgctggtgatttaccacaccacaggctgagtacacccaggcgcgcatctttaaaacatgcccaaagatatctctgtgaaatgtattcagtagtggattccagtattcacagccttcatttacacaggtgactttatttaatttgtacttactgggg

SEQ ID NO: 678950 - DNA, 412 bp, Homo sapiens
  misc_feature (123)..(123): n is a, c, g, or t
  misc_feature (146)..(146): n is a, c, g, or t
  misc_feature (149)..(149): n is a, c, g, or t
  misc_feature (154)..(154): n is a, c, g, or t
  misc_feature (235)..(235): n is a, c, g, or t
  misc_feature (241)..(242): n is a, c, g, or t
  misc_feature (309)..(309): n is a, c, g, or t
cgtagtaagagcggcggggcgaggcggcggtggcggcatagcgcgcggggcgccttagcagcagcagcagcagcagcagcatcggaggtacccccgtcgtcgcagcccccgcgctggtgcagncaccctcgctccctttgtttttnctnccttngctcgcaccatgttttgtcatgggaccgaagaacagattggtgaattaaaggaagccttcttcctatttgataaagatggngatggnnccattacaacaaaggaacttggtaactgtatgaggtcactgggttagaacccaacagaagctgaatngcaggatatgatcaatgaagtggatgctggtggtgatggtaccatttattttcgtgaatgtgtgactatgatgggtggaagaatgaaagatacaggttgtgta

SEQ ID NO: 678951 - DNA, 812 bp, Homo sapiens
  misc_feature (12)..(14): n is a, c, g, or t
  misc_feature (238)..(238): n is a, c, g, or t
gcgggaagaaannncaaacgacggctaggtaccgaggctgggtgttagctggccacctgcgcagcggccttgcgttctctccgggggcggagcgggtcggcgggcctgacagggaacctccctgaccgaagcccacgtctccccacggccagagaaatctccggcccggcccgcatcgccagcccccaggcccggaggaacggcccgagcccaggagaaccacatcttcgtcccaagnccccccgggagggctccctgtgggcaaagatccggtgagccaacggggttccctgatgggcccctcctgtgccagtgcagggtttccccgcgcgtttccgaggagccctgcctggcctgggctggcttggacaaacaggtcgtagcaccgattcgcgcccgcccccagcagggggttcccctggcaacagggcttgtgcccccttgaccccacagacccaaaagccttgtccttccggctttgcgccccaaaatctaagttgcactttgcccgggcggtccccaaagccacaagccaagggcagcaacaggttgcgaacccatttggaggcgttttggaccagggctcccaggacgaagcgcctcgggtgacttgcaggcgcggagcgtgggcccattgggactgttgcccacatcggttggttgggggcccgtgggccccaccgaggcctggtgggtccccttggaggcggaaggcccaaccctttggtgggccccttttcccccggccgttgggtcccacatgcgcgtgtgtggccctggccaacggtccattggcggcccaagaatctgcc

SEQ ID NO: 678952 - DNA, 919 bp, Homo sapiens
actctcattctctgcttgttactcagtaagctcaaaagtggggttgcctttttagctattagtgctctattttgtgcttctattgtcctctacggcaggtgtctctgagagtagatgtcgattactacattatctgtggcataactttgcaaacaagtttctatattactggatcatcatcgatagtcccgactttggctagtctctgttggctctagctcttcttgtttgtgcagctcttcgaaacaggtgcaaattctactatagcgggatattgcctgacctttatctgtcaagggaatagcataaccatcaaagcgatccctgtaacaaggataatgtcctctttggtttttaaagttgatgtatgctctggcatacatatgaggatacaaactcgtatcattagaaaaaaactcaaaataatcatgctcaggcataggttgaagatgttcctgaagctgctccttggtccaaagtgggaggtaatcttcgaattaccaccttgctcagcgctttctttcttctccttgttgcgatcctgcttatcttcccccttggagctgtcccccgaggtacccaccaacagtgctgtggacccggcagggggttaacaggataactcgcttactccttaggcctgtgctccttctcttccttcattggctacgtaccccgatgaagcggcttggccggaacgggttaccccgagaaggagctgtggggtcttctccatacatgcaaactcgttgactcggagtagagtacacagcaggaagatcacaacgtaggaagcaggtagatgacaacaatccaaaataggcccagaggacagcacgaacacgctgttaccaaaagagaacaccggcacacaaaacacaagaagcaaccccagacggacgaagacacaggaaacacg

SEQ ID NO: 678953 - DNA, 163 bp, Homo sapiens
ctacaggatcttatagcgcggctggtatcacctctgtgccgtggtcgtgaggacaccaggctggtggcacagtgctgctgtccgtggtcgtgctgctccacgcgctcctgagcatggggtggaagttgtatttcttctggcggcatcgtcttgctgagttatg

SEQ ID NO: 678954 - DNA, 246 bp, Homo sapiens
gtgttatgagatcatgtcatagctctgtagtacataggaattgactcttctacaatcagactgtatcacatgacccctgactacatatctttcgtgaataacagactggtatcacagtagcctagggagagattgatccacccttcattacttatacaagctacatctggaagggactcattttaaagagagcacaccattttaaatgaacacccaatctagctcaacatgagctgttgtaactgg

SEQ ID NO: 678955 - DNA, 108 bp, Homo sapiens
ttgaaatgggcacagaaattttcaggatatgacagctaaagggtgtttttgaagaaaagagtttttagaaggaaagagaaagttctaaaatttatcaggtgatagttg

SEQ ID NO: 678956 - DNA, 300 bp, Homo sapiens
cggacctctagacacgtaggataacggacgttgagccggtatcgtgtaatagacacgtgttgatggtgtcactcatgtcacctgccttgtggctgaatagggtatgtgattggcagttgttttaaacacattccaatcgcagtgacgagatataacatattttattcaacaacctgctgagtagaccgaaaagtacgactcctctccagaatcaagtccttgcgaagagctgctataggccgtttacggatcgctatagttttgtctgacccgatttagttcccgaatttacggcatagt

SEQ ID NO: 678957 - DNA, 722 bp, Homo sapiens
  misc_feature (147)..(147): n is a, c, g, or t
  misc_feature (322)..(322): n is a, c, g, or t
  misc_feature (535)..(535): n is a, c, g, or t
  misc_feature (540)..(540): n is a, c, g, or t
  misc_feature (572)..(574): n is a, c, g, or t
agcggagactaggggcgagtttggagcaagtaactgtcagtgaggttgcagttggtctgggctgtttggctgtgagcgaaatagctgccccccacttctcacttgcacaccacgggatactcctcctgaggctccggatgattcagntggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcattttngaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagtnatttnggcagatacttttaatttcaattcccggcttnnnggttaattatatcttagttctttggcatctggcatctgtaaatcaattacttttgaagcctacccaatggttattattttcagctatccttgtgagttcagatcccatgctaaccgcagctgctataagagaccttgggcttctagaa

SEQ ID NO: 678958 - DNA, 1126 bp, Homo sapiens
  misc_feature (1126)..(1126): n is a, c, g, or t
aggaaagctgaagtgctgctgtaagaggtggctcgtatgtaaggtctgtattattgtttttaattccccttctaatgaatgaacactaggggaatttcaggggaccagagagtgggattgggtgtgtatgataaactgtatgtagttgttaagtcttgctggtattgggagaagcaggggttgggggccatttgtgtaacgatggctggctcactcctggttattccctcgatgataaatcaaatttggtccatacactccagtcacaccatgaaactgtgcccctagaagggtagcttgtatacataactttgtgaaacatcattaaaggtctgtgccaagacgttctgcagtaattcaacaccgtgtactacgtggatatatgtaaggcagggacagaacgtgagcttctcgtgtggcaaattacctgtggagcgagaagagtaattgtctaaactatacagagaggtaactgtgactatatatgtggcatccgtggtgcctcccttcatatgaagtatttgataacagattctcaatttatgtcaaaacttcctaacagcagaatcaaagctcctctgggggcacagggccacgtcttcaggataggcaagacccggtatgacatagttaccaacagcttatcgcatggtagagaaacaactcgattaaacactgtaaaatatctgaaacattaaagttgcagttttcagggatggaaaaacaagggttaggctacttggggcactttcttagagggattgcgaagtgtttcaacttatcgacattgtagatgtacatgacatccgggagacgctcatggaaaccggagcaccataaataacgacaggaatactcatcgaagaacccatgtagccaaggggcaacactgggtagaaagggggtatcacagcctaagccaagaacaaaccaccgacagcacctgactaatccgagacgtgacaagcagacaggacgtgtacaccaagcagttgcgcggagactagaagaactgcaaacaccacaacgacagaaacacctgagccgacgaactagtacaacgaatagtacagacagaaacagatacaggtggagctatccccggcccccctcgtcacatcgaggn

SEQ ID NO: 678959 - DNA, 101 bp, Homo sapiens
caggccgtcctagggagaggagggtggatggaatttagatgggtgttagtcatgtcttgcttgctggtgtgagcgagatagtagcaggctcttggtgagga

SEQ ID NO: 678960 - DNA, 1235 bp, Homo sapiens
  misc_feature (820)..(820): n is a, c, g, or t
  misc_feature (1023)..(1023): n is a, c, g, or t
tgtccctcttttttgtggaccaccaggtcccgtccccgcaaattgtttgcccccaaaaggtggaccgctttttagagagtcatttagggggcaacaaacggtcttccaaacggaaagggggccggggtagccacccagcgcgttctttgttttgggcaccccggccccgctcgggggacccactggccacccagggtggagccactgggcgtaccagtgtgcgcccaaacccctctttgggacgttgccaaaccaagctgtgttgcaggaactttgggaagaggttggggttttcttggaggttgccccccccccacacagagggtttgttgggaaagagctgggccccccctggggggatttttctccacgagggcccaaaccactggtgccccacaaacacgcccaccaaagcgcggatatattttcttgctgggcccaagaaatctcccgggggagcccccccccacttttcttgtcaccggccacgctggttctctcactcggtgtggcccctcttcttcgaagggagctttccccccccccccccgcactctcccaccgtgatatgtcttcacattctcgtgcccccgctctctctcctcgggggggctctaaaagtttggggttttgcttttcccacaggcacggagaagcaccgcccacaggagctccagttttcccacggcgacactctttctcgtgaagcccaaattgagactcgtggaagatttaacgagctcttctctcttggccctcttctttctatggcccacgcttctcgtgggcgctcctctctcttctggagaccaccgctgtntggagagggccaccctcgagaagagaaaggcaccaaggggccgctgtctcttctcgtcttggggccgcgggccacgcgagagaaggagagacctcggggccacgttgtggcgcaccactttaataaacccgcttgcacggcgccggagagaaagccacccgcgcacaccccctttccggcctcgagaaacgccctcccctcgnccagagaaggttgtgcacggagagaagaaagagggccccggcactggggattctgggttttatgagggcacatgtgatgagctgtaaaatgttccctgggtgggtatgggagagtggtaatccacgtgttcaagtgcacgaaatctttggctttgctaaccacgttccatatgatgagaaattaacgttcgctgaggttttgtttcaaacca

SEQ ID NO: 678961 - DNA, 113 bp, Homo sapiens
agctgggtctggtgtagggtatcccttctcctgtgcttccatctcgtcatgagctaggtcttggagcttgtgttggaggctgctgtgatgtcaggaacgtgtatctgtctagc

SEQ ID NO: 678962 - DNA, 509 bp, Homo sapiens
ggaaacttacaatcatgtgagaaggcgaaggagaagcaggcacatcttatatggccagagcaggagggagacagaggggaggcaccacacacttggaagcaaccagatgtgatgaggactcaatatcaggagaacagcacggagggggtggtgctaaaccgttcgtgaggactctgccccataatcccatcgcctcccagcgcgagggggcttacatttcaacatgagacgtcggggaggacacagatccaaaccacatcaagtagtgcttgcaggctttggattatctttggtaactatgtgatggaactataatttacataccatacaattcaccaaggtaggggggtgtaatgcaagggtctaaagcatatccagagtggtgtgaccatcgctacagtcaatgtaaggacatttttagtcacggcaaaagaaagacctcaatcttcccattcctcccatcccgaagcaaccactaatctacttcctctatagggagatgtgcttat

SEQ ID NO: 678963 - DNA, 332 bp, Homo sapiens
caggtagagatgaaactacttcatgaagtaaaaaatgtataaaaagaaacattgagagaaaggactacagcgccccgacattcataccactagcagggcactgcttttcgatcaaaatgcaggtgacttaaacagcttaaagtttcgtttataagttgtaggtgattaaaataattagaaggcgatcttttaaaaagagattaaaccgaaggtgattcaaagcacttgaaatccatgacgcagggagaattgcgtcatttacagcctagttaacgcatttactaaacgcagacgaaaatggaaagattacttgggagtggtacggattcacg

SEQ ID NO: 678964 - DNA, 185 bp, Homo sapiens
cggggaaaggaccagagctcacgatgcagaagattggacaggcaaaagggggcacaagggcacaggccaagccttgggggcaggtgcaaatctaccagtcccaggatccccacaggacagaacctgagccctcacagtacttgccttcagccaactggctcccctcctgggaggcctctgctgga

SEQ ID NO: 678965 - DNA, 200 bp, Homo sapiens
accccccccttttattttttcccttaaaaacaattcaggttaaataaggcactgatttgggtttggtttatcggatcccaaaggctttggtggttaaaagaaagggattttgggggttttttttattaaaaccaccagctcttaaaggtggtttttccaaaagaaaagaatattttaaaaaaatattggtttccttggga

SEQ ID NO: 678966 - DNA, 781 bp, Homo sapiens
tgaggctgccggttgatcgctcgagagagagacgagaggttcagggagctgttgctgtatggccgtaagaaggatgctattgtgagtctgccatgaagaatggcctgtggggtcacgctctgctacttgcaagtaagatggacagccggacacacgacccgagtcatgaccaggtttgctaacagcctcccaatcaactgaccctctgcagacagtcataccagctcatgtcctgtgactgttgatgcgctgcctgcagatccacagtgctaatgtgacgactgcagaaatggggagatatggaggcctgcacctcgccatggtcttgtcacaacttgaacaacaacatggacgtcgagtccaggactgatggctaccatgggacgacactctggcttcaaggggcctcttggatgcggaccactactgctacctcatggcccagtgcgggattatggtgtatacacgaagaaaactacaaaagcttgtattaatcggatccaatcacagattatgacattcttaaagttcgcaaccaaacgaaggcataccaagaggactggaagcctatgagtacgcccagtccctggggtgaccgagaactgaccccctgactagttaccaggtgttaaagtacatactaatactgccgcctggcggagatggggctaggaacacgcaagcctaaacaataatgagaggacaacgcgaaaagctctgaagcagacgacctgtattcccgtgtagaaaccaattgtgcaatgtcacaagaaaactaaac

SEQ ID NO: 678967 - DNA, 926 bp, Homo sapiens
  misc_feature (355)..(355): n is a, c, g, or t
  misc_feature (370)..(370): n is a, c, g, or t
  misc_feature (376)..(376): n is a, c, g, or t
  misc_feature (380)..(380): n is a, c, g, or t
  misc_feature (399)..(399): n is a, c, g, or t
  misc_feature (438)..(438): n is a, c, g, or t
  misc_feature (480)..(480): n is a, c, g, or t
  misc_feature (500)..(500): n is a, c, g, or t
  misc_feature (558)..(558): n is a, c, g, or t
  misc_feature (655)..(655): n is a, c, g, or t
ttgagctccggttttgggagccataaagacacaaggcagatacgcagggcaatacctcattaaggaccaaagtgagtcaaccgggcgggcgctctaaataatgagtccccggctgcagaaatcaattgggaagcggcaacataacctgaggccaagagttggagaacaccctggcaaacatggggaaaccccagttctactaaaagatacagaaattagccgggcgtggtggtacatgcctgtaatcccagctacttgggaaactgaggcaggagaattgcttgagcccaggagccggaggttgcggtgaggcgagatcacaatcattgcacttcagcctgggcaataagagcanaactctgtctcaaanaaaaangganatatagtaatccttatttngagagattaggttcacccttttaaataaataaaacctanacacttactacctaagtttattctatttggtcttattctttngtttcatgaatttatatctngcctgttagactagattcattcactcaaatggaactaactttaaagaccatctagttnaactccagttattttgctattcctgaagttccaacagatgaaacaacttgactgaaactacagaatgctttagaggacatttcagctttccatatcnttgccccagctcccagatggagtcttcctctgtcgcccaagctgtaggccgtggaccatcttggctcgctgtagcctccgcttcccaggttcgggcgattctcctgcctcagcctcccaagtagctgtggcgcacgccaccacatccggctaattcttgtatttttagtgaagacggggttttaccatgttggccaggctggtctcaaactccttacctaaggcaggataattgtttgaacctgggaggcggaggttgcagtgagcccaga

SEQ ID NO: 678968 - DNA, 409 bp, Homo sapiens
  misc_feature (6)..(6): n is a, c, g, or t
  misc_feature (16)..(16): n is a, c, g, or t
  misc_feature (39)..(39): n is a, c, g, or t
  misc_feature (56)..(56): n is a, c, g, or t
  misc_feature (331)..(331): n is a, c, g, or t
  misc_feature (333)..(333): n is a, c, g, or t
cattanattgtactgntccccggtatttccaaaatgganatgtggccctactatgncagaatcaaaagatgtgtatcccaaacagaaagatgaaacctttgccttacgacctactgcccagtggtttctttccctattcacgactaagctccccacacgacgtggaaagagttaatctactgataaatccactcccagtaaaaacagccaaccgtatagcattagtagaagttagaataaaaaaagtaaccggaaggttgctgattcgatccccggtgtgtcgaggtgtccctgagcgagactcctcgccccgactgctcccgacgaaggncntgtcgccttggtgcttgactccgccgtcggtgtgtgaatgtgtgcgtgaacggctggatgttgtgaagcgctttga

SEQ ID NO: 678969 - DNA, 164 bp, Homo sapiens
ttagaaattcaggtctttttgtctaatagaaacataagtgacagatacccctaagtataaaattgaattcatggcaggataacacgggtgagcatatagtaccacatagacgtatgcggttgggccatcagcatttgccacgcattcccttctgtcgtcttctc

SEQ ID NO: 678970 - DNA, 197 bp, Homo sapiens
tgctcgacgatgccgacaaccgcaaggggcgctggtcgcggttgcagttctccctcgagggcgaacccgatccctggtatcgagttcgacgaggcgcaggtcgacgcgcgccatttcgaagccgttgtccgtatgagcccgcaaaccgcatcgagacaccggagctgcatcatgagccattggaaaccgatctgccg

SEQ ID NO: 678971 - DNA, 427 bp, Homo sapiens
  misc_feature (427)..(427): n is a, c, g, or t
aaaagcaagtggcacagttatattcagcacagaactgctaagatgtttacaccaggctgaaaaaaaatgtctgaatgcagagatgccttaaatgttcgatggccgatcagttaaaaattcacgcaatttaccctgataaagtgctcaaacaaagcgaatatggtgcgctaacagcgtttaactgccttcggcccgatttgctgccgccacattgtgccactgcccttgggaaactgcgaactgagtaacagggactcataatatacagcttttcatagtcgttgagcgccgccattctccaatgcgcctgtttaggacccctgatatccatatttatgtgctacgactgcccaatagccaccctgttgcataagacgatctgtatgaacgggcgtgcagtcaatggtcaaccagactgtaccatggn

SEQ ID NO: 678972 - DNA, 573 bp, Homo sapiens
  misc_feature (492)..(492): n is a, c, g, or t
accagcatatggttcatatgcaaataatactttccccaaaatcttctggggctaggctattttctggctatgcttccggcacccaaccatgcaaaattcttccagggttggaggaactaatcagctggttctccaacagttctgaagccaacccacaaatcttggaggaaaaggggtcacttggtttactattctctgggagatggaagtgatgctgctctcccattggggtatataatttcaggggtatttcttcttaaaaatctgggaaagcctaggagagttaaaggcatccgggtttggttgcatttggctcggttttaaatccatatgcaattaaaacggcttctctcttacacggctggaactagaaaatcagctttttaaggtaggttaccacttatatgcacaaaagaagcatgtataagaaaccagatttaggtgtcttaaataaaaggtaaacggtttttattgggtagagatgactcaggnaaaaatggtgttggcttggtctgcatgttaaatgatgtgctggtatatcgataagctgtgtcacttttaaataagatgcca

SEQ ID NO: 678973 - DNA, 517 bp, Homo sapiens
  misc_feature (267)..(267): n is a, c, g, or t
aggtgactctagaggacccgcccacggtagatataggtgctcatgtcacaaacagcagagcattctgagcagaatcagtagactattgcacaatgactgtgtctcagggcaagcctgagctctgtgatcagctatagcttttctgatctttgtcatacttccagatttatcatttagtgctgcattgaaagaggaaccaagattggatgggcatgctattgggatgacacaaatctctccatttggaacagatcctctgctatctgncacttcccctgcagtttcccaagaaagcagtaggagaagtagctttagcccagatgatggtgatgaattataagaaataaacagacccaattcatcaactggaaagcaattctatgctggtgctatgcaattatgctctgtgtttcatatgttgctttggcttatttttttttcttaaaggaatgtgttgttcatgaaaaactgatagaagcagcagaagaattcgcaggaagaaaaatctaccgagggc

SEQ ID NO: 678974 - DNA, 133 bp, Homo sapiens
tcatttcgatgaatcctattctacctcttactcgtgatggaaagtgatccccattgctcacatgattggagtaatatctgtggagcctcctggcatacccctttgtgtttgacatcactgggtggtattcggg

SEQ ID NO: 678975 - DNA, 192 bp, Homo sapiens
ggtgtagaaacattccaggtttcactcttagttattgtaactatacaataaattattgttaatttactatagttgccccattgtgctaccaaacactagatcttactccttctatgtaactgtattttttacccactaaccatcccctttctactcccctttccactaccctttccagcctctgctaaccac

SEQ ID NO: 678976 - DNA, 242 bp, Homo sapiens
gggaaaatgttattaagttttaaagaagcccctttttaaaaaattaaaaaaaacataatgggacaaatcatgagcaaacttcttttcaatcattggaaattattcacgggctatggacatttaaatctcaagggaactctttaattaactaaagctaaaaaattaaattaattgtgagccctgttaaaaaaaaaaaacataaaggaaattttgagacttgaggccaaaaaaacctttagtta

SEQ ID NO: 678977 - DNA, 294 bp, Homo sapiens
tcggtcacatgatcgctctcaggaacagctgaattctcccggattagatcactctcctcctctcgacccttgtggcctgtagcatgctggctgggacctgagagcatggaaccgatgagcaggatctcggagctgcagcccatgtcacaggccacgatgagcatcttggacagtggccgtgatccagcgggacatccagcatcagccgcccggtagaggtcaagaccacctgtgttgtccaggggccccgagaatccagaagctgataggtagagttgagcatgttgtcctccg

SEQ ID NO: 678978 - DNA, 614 bp, Homo sapiens
taggaattagtatgagagttgtgtattagcagtgtctgtctgaaacgctgtgatatttgacccgatgcgtcgtacccgactgcgtcgagggatggaagcgtcggagtggggcgggcccgtgattcggacccccggggcgcttcgatccccccaggtggtcaccgaggcacggccgcttcacccatggtagcaccctgatgaaggccatggtcctaatgcgtcagcctggtcgggtgcaggagatcgtgggcgccctcggcaagggcggtggagaccggttacagatttctcaatatggtcatgctgcttcctcatattggacatgaatggctgcccacaccagtacctaggtgccttatcctccccaagcggtccccagtgatttctgattttgacatgaccttgagcaggtttgcatataatggacaagcgatgcccttcttcttacaatattctggataatagcacgatcatcagtgaggagtgtcggaaagagctcacagcgctccttcaccactattacccaattgagatcggaaccgcaaaaaaaccccccgggggggaaaaccccccggggttttccccaaaaaaaggggggggaaaaagggcaaacc

SEQ ID NO: 678979 - DNA, 728 bp, Homo sapiens
tgcccacactgcacggagtgcaccagcgtcttctccagtggagcggcggatagtgagctggcccatggctcgcctgggttgtgcccttcttagtgctccgtgcccctgtgaccctgcgctcattgaggaccctggaggatgggccacggacttcatccagtgagttcccctgggagccccgccttcgctgcatctcacctccatagcccagaatgattcttggacgcgaccgcccgcatgcctcccctgactaaggccaccttgcatgcctgctttccagggccaccaagggctctgctccagcctctcagagaaacagaggcctgtgagctcgtgtaccctggtgccctgcagtggagcagtgcccatggcatgactgtcagcgggagagcttctccccgaccagcccagccccaggatgtgtcgcaccagcagctctgcctggtttggtctgcagtgcctgtggtctgcgtgctctgcagctgtgagacgggggcggctgggctctcttcccatccatgttgcctacctgtgcccctggcagcgcgtgtcaacacagataagcgggagcgcaaggacttctgcagtcctcaggtgacccctgttcctccagaaccctgggtcgctgtcatctgggtaaagctcggtgagtgcccctaagggggcgaacttgacctcaggcatgtttgtaatgtaaggagcctgcataaacgtgtcgtgtgtggaca

SEQ ID NO: 678980 - DNA, 1451 bp, Homo sapiens
agacgcggggtgtgcggtgaccggcgtgagacggacatcgagacttcggcgttggtgggccagacagatgggtgggtgggacggacccgctggggccgcgccgtggggggtgctgtcgctggaagggatgaggatggagtgtggcgtctcgaccaatcgtggtggtcttgcctttgtccatgcgcatgggagcagcgagtagatgatgagagaggtcgcccccctctccggtgtgcgtgggtgtattgagagatagtgggtgttgtgcgccgccgcggccccggaggcagtgcggaggatttggtgttgtggtggagcgcccccggcgctgtggtttgcggcggagcggtgtgggtggcggggctctgtataagggggggacttttctggccgcacgcgcgggtgtggtggtggggagagcgcgccctctgcgctcgacagtggttgggttggagagcgggtgtgttgtgtagacgatgttgtgtgtggacggccgccccccccccgctggttgttttggtgagccccgggtggggcgccccccgacagaggggggtgtgcgccgtgtgtctttcatgcgcggggccagccggtcttttagaagtgtgtggggggggtgtcccgccaccaaaaagggggcgggggttggcagatgttggtgggccccgcggtggtgtgtgatactgtgggtggtgtccacaccgggtgggagcgcacacaccagcaggggtgttcgtccccccccacagagtgtggataatatatgagtggggggggagaaaatttattgtggggtgtttttatagtatagagagacgcgcggggggggggttagttacgctctcagtgccccccctggtgttgggtcgctcccccgcgtaggcgcgccggcgtccgcccgcggggcgcgctctctgtgttgtagtgtctctctgttttcgtcgcccgccgcgcgagagagatctttctctgtcgcacgcacgtggaagtttattacttcgcaggggcccccccttcttgtgtgtggggatacaatagaatattgttgtccgccgcgcgcgggagaaagagttagattatgaggggagaagttgtttaacacacaccccacaagcggggggtgttttctcttctctataataaaaagacacacacactatgtagggcgctcctcttttgttctgttttgtgtgggaaccctggtggtctgtgtgtgtgcggcgcgcttatattgtggtggtgtctgtgatatatgtgaaaacctgtgtggagagaaatatctctctcgcgccttatattgtgtgtgagagcacccacaatatatggaaatttgcgcccggcgtcccccctctctctgtgtgtacacaccgggcccccgccggcggggatttttgtgtgtgtgttaaaaaaaaaacgctcgccctgtttttttttttttaagggtggaaaga

SEQ ID NO: 678981 - DNA, 135 bp, Homo sapiens
aactgaaaaaactaaacagaatagcatggtcaaatcagcactttagaacacctacagttctggagaaagctcttgcagcaatccagcaattgatgatgactttagacaggacagttagtgaagatggactaaaaa

SEQ ID NO: 678982 - DNA, 529 bp, Homo sapiens
gcgtcgacataatgtgcaaagaaaaaggacgagatcagtttgtatcaaggtatccaaaaaaatgttacagggctgtacatccaaggttcataccaacattattctcagtcaccaaaaggtgtaagcaacccgtgtgtctgtcactggatgaatggataaataaaatatggtttataggtacagtggaatatccttcagccttaaaaacgaaggacaggccaggtacggtggctcatgcctgtaatcccagcactttaggaggccgaggtgggaggatcacttgagatcaggcatttgaggccagcctggccaacatggtgaaaccccgtctctacaaaaaatacaaaaattagccaggcatggtggtgggtgcctgtaatcccagctactcaggaggctgaggcaggagaatcacttgaacccaggaggtggaggcagcagtgagccaggatcgcaccattgtactctagcctgggcaacaagagtgaaactcggtctcaaaaagagaataaagaaacagtcgggcggc

SEQ ID NO: 678983 - DNA, 399 bp, Homo sapiens
  misc_feature (9)..(9): n is a, c, g, or t
  misc_feature (14)..(14): n is a, c, g, or t
  misc_feature (320)..(320): n is a, c, g, or t
tatgcaatntctcnaccttcttccttccctttggcgcatgttttcttgtgtatttgacctcatccaaaaccttcttttgcacgagcttgtccaataaaaatatgaggcctgatttgatcgtcagctaccgagtctatgaacttcacaatttcaagtgcgctttctcttaattctgtaaaaataataaccctcgagtcggaaccccttttctgaaaaaagtccattagttcatctctaacacattgtaacttcccatgaccgacaaactttggatcacttaaataattttcgcattgatttttgatgtttttccaaatcgngtggtaataaaactcagctgcaattttattagtagattttttaagattatatttacgtagtgaattcctgcagcccggg

SEQ ID NO: 678984 - DNA, 377 bp, Homo sapiens
caccgaaaaaaaggacttgttgagctcccccagttccgggtctgcttaagctctgtgctcagctctgggggaagccctttcatgagtaagcagtgggtcgtcacgggaagcgaagtggggccagccgaaccaaaggaaatagagcagatccgcaaacccacacccactcccaaagtcagtctactgtcagaaaagctgaagctgctgggcgcggtggctcacacttgtaatcccagcactttgggaggccgaggcgcgcggattacctgaggttgggagtttgcgaccagcttgaccaacagggagaaaccccgtctctactaaaaatacaaaattagctgggtgtggtggcacatgcctgtaattccagctactca

SEQ ID NO: 678985 - DNA, 326 bp, Homo sapiens
gaaaacgccaagaacacttccctccatgttccacacagccaaggtctccaaaccaggcaagacagcagtgacatggcaagatggacaaggaccctgcagtgcactaaagatagtctctgtgtgtggtaacatgtctaacacttgtcttgcttttcataggtttgtgtgtgttctagtgtttccatgagggaccaaggcgcttgtgatctgaatgtgccgtctctgccttgggcaaagctcttgcaaactcctggttcatggccaaatctccaggactttaaactagttatgttatttactgaccttttacaaagagattttccttg

SEQ ID NO: 678986 - DNA, 122 bp, Homo sapiens
atccccgcgtagcccccgcaagacgagaaggaggatttcaggtgaggaggccgaagagaaggccgtaaggcagagcccccatcatctcaggcttctcagttcccttagccgtcttgcgtggg

SEQ ID NO: 678987 - DNA, 331 bp, Homo sapiens
ttttcagtaatgttattttttttaaagtgaaattttaagcctgccctttgatgtcaggtgttccctttgtctttcaaaccccaaggttccattgtggccctctccctacccctgggaagcccttttggagcccttacccctggctgtttggactttgtaaactttaaaaaatttaaccccccttaattacttaaaaaaaaaaaaaaagctttatgatttatataacttattgctgattttaatggattgttaatttcagtccggtagttttattttatgtataaaaagggctgggcaaggaaaaagaaaataaagccacccatatttagca

SEQ ID NO: 678988 - DNA, 194 bp, Homo sapiens
cccccccccgggttttttttttgggggccacaggaaacaaaaaattccctttttttttggggggaaccccagcaaaattttgggggccgggggggggccaaccccccccaattttttaaggggcccccagggggggggggggccccccccccccccctttgggggtttttttttttgggtttttgcccccccca

SEQ ID NO: 678989 - DNA, 297 bp, Homo sapiens
ggtcgcttgcccgcaccattctccatgtctctctctctcttgctgttcctcaagcagcaacgctcttcagccttaaatccttgtatccacaaggcccagtgcaaacgccacccactccgaggcttttctggccctccaggctcaaagcatcagtatcctcaggcgcactcccgactgccttcatttctttttttttggagatggagtctcgctctgtagcccaggctaacgagactttgtctcagaaaaaaagaaaaaggaaaaggaaaaattgtatttgagggaaaaaaccatgac

SEQ ID NO: 678990 - DNA, 421 bp, Homo sapiens
gtcctagaaactgccttgatagtggttttagctcacatgaggtaagtctttattatatgcccaacctctttatgcattacttcatttaattgtatactaatcctttgtcataggttatcagagtgtttgattataagttacaggaagaaaaaaaaaaacaaactccaattgactaaaacaatggggcattttttgactcacataacagagagtctagagagaaggcaccttcaggtttggctgatgaatcctgtatctctgccttgtctccaggcccccaggttctgcctctgtcctgacatccagtgttggattcctcttcacatcaactcctctctgtaggttgggccatcagaccctacctccttatttatgttgagcaaaggagagagaatgcctctacaaactatgaaaaaagtga

SEQ ID NO: 678991 - DNA, 268 bp, Homo sapiens
aggccacccatgcctgacccgaaacaaaggacatcctttctcaccaaaaagacaggaccaggcaacccggaagatcatgagattcctgcagagctggcgacacaggatgagggcactgaagcagaaccaggagctggaagggcttccccatgccgggactggccacatgagctgggcaccgttctttctcaccagcctgggggcgcctcgtgcagtcttaacagggagagggctttctgaggcaggggtagcccctgtcggcagcttt

SEQ ID NO: 678992 - DNA, 364 bp, Homo sapiens
  misc_feature (110)..(110): n is a, c, g, or t
  misc_feature (137)..(137): n is a, c, g, or t
  misc_feature (169)..(169): n is a, c, g, or t
  misc_feature (186)..(186): n is a, c, g, or t
  misc_feature (346)..(346): n is a, c, g, or t
ctagattggaaaaaaagtaactttaaatgaaactagagattcttccccattattagctcctaactgaatttgaatgttttaaatataagtagtaagatcaactctgtaantcaaagatgggctgggtgtgggtgcangcctgtaatcccagcactttgggaggccgaanctggccgatctttgganccctggagttcgagaccagcctggtcaatatggcgaaaccccgtttctacaataaaataaacgggcacggtgacgcacgcctgtagtccaagctacttcggaggctgaatcagtaggatcacttgaacctgggaggcggaggttgcagtgagccgataangctgactccctgagtgac

SEQ ID NO: 678993 - DNA, 439 bp, Homo sapiens
  misc_feature (330)..(330): n is a, c, g, or t
  misc_feature (394)..(394): n is a, c, g, or t
  misc_feature (400)..(400): n is a, c, g, or t
  misc_feature (432)..(432): n is a, c, g, or t
aaaataagcccacatgtaaaacactttcctaattactttttgtttgtttgtttgagtctcgctctgttgcccaggctggagtgtagttgcacgatttcggcttattgcaacatccgccacctgggttcaagcaattctctgcctcagcctgagtagctgggattacaggtgcccgtcaccatgccagggctaatttttgtattttcagtagagacggggtttcaccatcttgggccagggctggtcttaaactcctgacctcacaatccacccgcctcagcctccctattctctgtatcttatggaaggacttcctttttctttctggangagctgccataaagtctttaaacattttaaattcattcaggaaccttttcttgtaggcaggaangtggangtttttcttgaagtacagttacggtttttcanggtacaa

SEQ ID NO: 678994 - DNA, 322 bp, Homo sapiens
gaggatgacaggtactgcagcatcttcgttcgccgtcctccccccatgaatatgtatactgaacaatgtgcattggtcatgaggaattatttagtatgctaccactctaatgaatctcgtaattttgagtaaatgtacctcagtctaatcagactttttatgacctttataactacatttaaaacccttaattcctatatccgggtgtgagcgagcccgattgctactcatgaagtaaaaataataactctatgtatcagtagcgtaagtaaacagtagtacttgttccagcaggcatattgtcgttcacttcagctgtttt

SEQ ID NO: 678995 - DNA, 107 bp, Homo sapiens
tgcaggtgatgtcgtccacatcttcaaggtcacattaggctgaacaagcgtgcacatattccccaaattatcgccatacagtttattttccaaacgtatttttcctt

SEQ ID NO: 678996 - DNA, 492 bp, Homo sapiens
gtctcgattacgttcttgaaaggtcagctctgttagagctaagaacttgtctaagatatctttcagtcaacccataggcgatatgtgctcgaattccgcactagcgaggtcatagcctgtgtgcgggagttaagattttttttaagcctactacatttggttatggctaaaaaatctgaattagtggtcaaggtttcagaggcagtcattaattaactttggaaagctctatcagatactctgacataaaatcatgaatccaggtatcggtgtctggcaacgatgtgtccactaagtagaccactactttccggtcccaagggttagcattttcaatgactgtctgcaccagtgccaccagaggtttcttctccacatgatttcgaaacaccatagaagcctcctcagaccactggttgcacttcactcctgcaagttgagctgtgactgcttggaagggcagctttcggaacatgtccactaggggctgta

SEQ ID NO: 678997 - DNA, 178 bp, Homo sapiens
  misc_feature (145)..(145): n is a, c, g, or t
tctgtcttgttgttcatcactgtatatgctcagcaaagacagcctgaaggtccggaggcctcgaggggtttccacgtagacccacaactgcccacaagccaccagtgggtggatgtctctacaatggtcatagccttttccctcntttaaatgttcaccttggatcctctagagtcga

SEQ ID NO: 678998 - DNA, 530 bp, Homo sapiens
  misc_feature (69)..(69): n is a, c, g, or t
  misc_feature (73)..(73): n is a, c, g, or t
  misc_feature (82)..(82): n is a, c, g, or t
  misc_feature (87)..(87): n is a, c, g, or t
  misc_feature (96)..(96): n is a, c, g, or t
  misc_feature (106)..(106): n is a, c, g, or t
  misc_feature (109)..(109): n is a, c, g, or t
  misc_feature (155)..(155): n is a, c, g, or t
  misc_feature (172)..(172): n is a, c, g, or t
  misc_feature (186)..(186): n is a, c, g, or t
  misc_feature (426)..(426): n is a, c, g, or t
  misc_feature (432)..(433): n is a, c, g, or t
  misc_feature (437)..(437): n is a, c, g, or t
  misc_feature (446)..(446): n is a, c, g, or t
  misc_feature (453)..(453): n is a, c, g, or t
  misc_feature (491)..(491): n is a, c, g, or t
tataagctgaggaagtgcacaggcccggggccagcaaagcagacacagacaaagcgttaggagaagaanagangcagggaanacaanccaggcacnatggccaccntcncaccagcaaccagcgccccccagcagcccccagcccggagacgagnactccagcctggatgantctgacctctatancctggcccattcctacctcggaggtggaggccggaaaggtcgcaccaagagagacgctgctgcccacaccaaccgccccaccttgcgggcacaagaggaaactggtgaccaagctgcagaattcagagagggagaagccaggggcacggcgctcaaacagagctggagatgaggccagaccatggacactacacccagcaatagacacggcactgcggaggaaggaggacccagcacagnatccanncccncttgccacnccccccncccctagcactcattcccgctcactgagtctctcaggngctaccaggaaagcgcctccaaccctacgcaaaacgtgc

SEQ ID NO: 678999 - DNA, 137 bp, Homo sapiens
atttatacttcatacccgggacctgaaatgttaagtgtgaggaagtataagcgttgaggaagtataaagcgttgagtgttgagggagtataaagcgttgaggaagtctaaagcgttgaggaagtataaagcgttgag

SEQ ID NO: 679000 - DNA, 278 bp, Homo sapiens
  misc_feature (172)..(172): n is a, c, g, or t
agacaggttcaccatgtgagccaggatggtctcgatctcctgacttgtgatccgccacctcagtctccaatgtgctgcgattacagatgtgagccattgcttctgaccaagatcttatggttttataagggcctcttcccccttcattcattcactcactccctcctgccancttgtgaagaaggtgcctgctttgacttctgccatgattgtaagtttcctgaggcctcccccagccacatggaactgagtcaattaaacttcttttctttataaat

SEQ ID NO: 679001 - DNA, 192 bp, Homo sapiens
gggggggccccccccccccggggccgccccccccccccttttttaaagggggggcccccccccggggggccgggggggggtggcccggctttttttttcccttggcccgggggggggggggtttttttttgttttttgggcccccccccctttcgggcccccccccaattaacccttttttttgggggggga

SEQ ID NO: 679002 - DNA, 362 bp, Homo sapiens
ctggggctaaatttggaaatttcccaccttccccggattccccttttttccccagttttttggggggggccttaggtcaaccccccccaaggccttgttatttggaggcccttgggttggggtttttttttttttccttgaatttggccgtttggttcccggatcaacctccttaaccctttggtggccctttttttggggggaaggaaaattcttgaaaacccaattccccaccccatgggggtttgtttgtttttttgttttaatttgcccctgtgggttgcttattgaaccagcctttcctgggcccctaatttttgcaaaacccttgtttccctttggattaaaggttgttttttgga

SEQ ID NO: 679003 - DNA, 434 bp, Homo sapiens
tcgatgcaaagtgtccggaaagggggtgctataatgacaatcaaatcgatcagtggaggttgagcacctactgatagtcatgccctctggtcgtgtccttgctgaggacgcaacaatgcctggttccctatgagctcactttgagcctcaatatgttcataatttcactgctggcttctccgcatcgttagcacatctgccagtcatagcctgctgagagaagcctcgagccacatcatacctagagacgctgctggggaaggtcaggacacccaagaagcttcgggagtgtgtgtctgtgttggtttgagagaaagtagctgcccctcattctggccagtgctttccagtagccatggggctggctacaatgaagcaaaactgtccatgcaaaagaggaagacaggtcactttacaggagactttgcatcggg

SEQ ID NO: 679004 - DNA, 104 bp, Homo sapiens
aaccacgaaggtcagaagtcgtgaggcccgtttcacggtctgtattgacgtagcccactgtagtataatatggcaaaggagaattaagattgtataagaaatta

SEQ ID NO: 679005 - DNA, 133 bp, Homo sapiens
aacatcgctttgtctggttagggagtcaggtgaggatagtgggtgtcagggtgagtgagagtgtccaggctggggagtgagggatccaggtgagtgaggcaggcattccaaacctggaccttcatcacctttt

SEQ ID NO: 679006 - DNA, 102 bp, Homo sapiens
ggattcagatcatcatcccacacaattatttttctttctttccctcctccaattaataacatcccatttctcatctgacaaaatgtaaacacactcccatca

SEQ ID NO: 679007 - DNA, 255 bp, Homo sapiens
  misc_feature (122)..(122): n is a, c, g, or t
  misc_feature (194)..(195): n is a, c, g, or t
tcccaaggaatgaggaattgcgggtcatatggtaattctatgtaacatttgaggaacatcagactgttttccacagcagctacatcattttacatccccactagcaatgtgcgtgggttccnagtttctacatctcttgggaaggatagaggaacgtgaaggaattccgagatcgtgtgtgtgtgatacagtgnntagcatacatatgaactcaacggcacatatcgtgtactcaatttctacatccttgggacg

SEQ ID NO: 679008 - DNA, 475 bp, Homo sapiens
ccatcactcttcacagaactagaaaaaacagttctaaaattcatatggaaccaaaaaagagcctgcattgtcaaagaaagactaagtaaaaagaacaaatctggaggcatcacactacctgattcaaactatactatgaggccaaagtcaccaaaacaggcaggtactagtacaaaaataggtacatagaccaatcgaacagaatagagaacccagaaattaacccaaataattacagccaactgatcttcgacaaagcaaacgaaaacataaagtggggaaaggacacccttttcaacaaatggtgctgggacaatcggctagccacatgtaggagaatgaaactgcatcctcatgtctcaccttatacaaaaataaactcaagatggattacaaatttaaactaatacctgaagctattaaaaactctagaagataacttaggaaatacctttctagacattagcttaggcaa

SEQ ID NO: 679009 - DNA, 222 bp, Homo sapiens
aggtgggagggggagggtggggtaggtcccccagcaaaaaaaagggacaggagccccccaggcaggaccaaggagtcgggaggcccctgccttttgtcctccatggtgagggcacagatgtctccccaaagcccagcgctggcagaatggattttgctcctggctttgcttttgcggcttcggtggagacagttatggaataaaatgttccttgcccccaga

SEQ ID NO: 679010 - DNA, 240 bp, Homo sapiens
actcgctggttttatccaatatcacgaaactcgttggaccgaaatacaggcatctctctatctcaatctgttgaagtacagacgcctatctcttcctgcaatggggtcaatcggcttggagactaccgtgtggtcgatgcaggcacaacgcgcccaacaagcgccatggggatccgttgcttgagggtgcggctgcaagagccaggctgcgagagcttagactgccggcccagagcctct

SEQ ID NO: 679011 - DNA, 432 bp, Homo sapiens
gataattcctaacgtcatcattgcccaaaacgctttgtatttcagcatgacgaatacgtaaggcgttgcgaatggccacccaaatattaagccggtggttgagaataaaacaaaaaaaagtatcactcttttagattttttttgatcctttatcgactgctcgagattttccattcgtgtaccccagtattggaaacaggccggtatagatgcctttattttaagtttcctataggtcgttgtacaagaataactagaatagatatttctatcgttactgcgtttccgtataattgcaatgtacggaatttaaatgcgctaagagtgccggaattacagagctttatcagaacttaatttgtattcttattttgtactcatgtcatagtacaaaagcatcgttagcagccaaaggcgtaatgccaagggggg

SEQ ID NO: 679012 - DNA, 461 bp, Homo sapiens
ggaccccaccttttgatagtgacaggaggcagacaaatcctaggcagacagggacaggttcccagtgaaaccccacctccgagccaaagacagtttaaagcctgaaagccaagctacaaattaaatcctcagcctggattgagaacccatcttcccatttggctgctttcctctgattgatccccacccttcacctattttacatgtacctatcttttcctaattcattttctacactggcatgcccacctttgagtggtacctttgtttaagccttttttgcataatcagaagccaatcagcatgcactcccccattttgagcccataaatgccccggacccagccacactaggagagaaaccacctgacttcaggtcgggaaccacccgtgcatcccctctctgctgagagctgttccgtctctcaataaaattcttctctgcccttctcacaaaaaaa

SEQ ID NO: 679013 - DNA, 441 bp, Homo sapiens
  misc_feature (46)..(46): n is a, c, g, or t
  misc_feature (111)..(111): n is a, c, g, or t
  misc_feature (149)..(149): n is a, c, g, or t
  misc_feature (162)..(162): n is a, c, g, or t
  misc_feature (253)..(253): n is a, c, g, or t
  misc_feature (268)..(268): n is a, c, g, or t
  misc_feature (295)..(295): n is a, c, g, or t
  misc_feature (312)..(312): n is a, c, g, or t
  misc_feature (398)..(398): n is a, c, g, or t
  misc_feature (401)..(401): n is a, c, g, or t
tttattcctgtattaggaagcgttttattgaccagcagagcagggnatattcatttagcagctcagcttcagaccctcctctcccacatccctttaaacaggtgtgtaagntcttttaaatgaaaaaggatttccagagtttccagggnaagaaccaggggnttccctgggccaaagtaatcccattccaatctccccactggtcagacaccatcaccccagcccacagtgaccgtgggccttagtcctgggnatcggttttcagagnggtttggtacttccccctcatctcctngggtaatggaaccaggntggggaagggaacctgcccttccacttcacagatgaactcccgcaggcagtactttcgagggccgaagttggctgggtgagaaagntgntttttcttcctcccccctcttccctgagagtagattcagt

SEQ ID NO: 679014 - DNA, 825 bp, Homo sapiens
tcggcacgaggatctccgcagagagatgagttgaccacctgaccattccttcatctgctgtgggaagggatccttgcaccggatttctgaagtgtttgactgttggtttgagagtggcatgtatgccctatgctacaggttcattacccgtttgataacaaggagggagttgtgaggatgcttttcactggcaggattttgcattcgtcgcgtacgggcaattcagtagctcaatagccagcaggatggttttttatacccctggctagggtgactgtgccacgtggcacctcattgtgtggacaactcagcacattctcaatgcatacgctatagtatgtcgagagtgtggactatgttccatggccacagttgtatgcgccaacaaaactgagccaatacgggaatagacatgacattgatgccagagttccaggtatatgccatcgatgccatgaaggtatggatgctgatgacacctgcagaattatgatctgagttaagctcgcgcccgtgttgggtgaagaggcagaatatacctcgcgtcttggaaaggaagagtggtgtgcgggagcgtcctataaggatgctagcgtgctcgccatggtgacaagtgccgtatcgcgttgcgttatatcccacgtaacagttctcgcatggctccggcatatggtagcgacatgaaatcacgacattactcgtagaatgaggagcgacggttgaggaggaagaggccccaactaattaacaggagcgggttggatcctggtcccgttccagtgcaaggtctctccatggggttcctttgggcacgtgacatgggcg

SEQ ID NO: 679015 - DNA, 581 bp, Homo sapiens
  misc_feature (223)..(223): n is a, c, g, or t
  misc_feature (237)..(237): n is a, c, g, or t
  misc_feature (307)..(307): n is a, c, g, or t
  misc_feature (315)..(316): n is a, c, g, or t
  misc_feature (322)..(322): n is a, c, g, or t
  misc_feature (325)..(326): n is a, c, g, or t
  misc_feature (363)..(363): n is a, c, g, or t
  misc_feature (366)..(367): n is a, c, g, or t
  misc_feature (373)..(374): n is a, c, g, or t
  misc_feature (377)..(378): n is a, c, g, or t
  misc_feature (380)..(380): n is a, c, g, or t
  misc_feature (386)..(387): n is a, c, g, or t
  misc_feature (389)..(389): n is a, c, g, or t
  misc_feature (391)..(391): n is a, c, g, or t
tcctgactaaatgccagatgacagaggctatacagctgcttacttgttgtatgccttcactagcatcaggtctatcgcacgtctggccaatattgatgcagacatgctcccttaagctgctcgagaaccccagattcttttggatcatgagacggaatggaactagccggtgcattcacgttccctgagattctgccaagattttagatgacttatttctccncactctctgtgatnatatatatgagctggcaactgctttcacagagttctatgatagctgctactgtgtggagaaagatagacngactggannaatatnganngtgaacatgtggcgtatgctgctatgtgaagcagtancannctgtcnnggnnanaggggnncnanatcctgcgcgaataaaacctgtccaaacggcatcgtaatccttcataggtttgaacactgtgtcgtctctaccaaagctggccattggcactgtatgctttctggacaactcaatgtgagactactaagctatacagttaagagaagaattctgtcaaacgcaataacaagacaagaataacagaacatt

SEQ ID NO: 679016 - DNA, 112 bp, Homo sapiens
aaagctttcacttacactgtagcagcgtctggtaagaggaggtgtgaatatggggtccccatcaaaaatgggaaggttcggcggaaattagaggtttgaaggggcttattga

SEQ ID NO: 679017 - DNA, 490 bp, Homo sapiens
agagcggccgcctactactactaaattcgcggccgcgtcgacataaaaaatgggctgggcatggaggctcatgcctgtaatcccagcactttgggcggctgaggcgggcaaaccacctgaggtcgtaagttcgggaccagccttgccaacatggtgagaccccatttctacttaaaaatacaaaaattaggcgggtatggtggcacatgcctggaatcgcagctactcgggaggctgaggcgggagggtcgcttgaacccaggaggcacagattgcagtgagccgagatctgaccactgtactccatcctggacaacagagcaagactctttcaaaaaaaaaaaaaaaaaaaagtcgacgcgggtcgcgaatttagttgtagaaagtcgaacccggaaattccggacccggtatccggcaggcgtaccacttttatctaatgagagtcatgatagagtcttggcgtttatatgggtattagctgtgtcct

SEQ ID NO: 679018 - DNA, 737 bp, Homo sapiens
cccacgggtgctctgcgatggtctccacaagagtgtgttagaatatattgtgttgcactttcggggggggctattcctcttcgatttttgtggggtctaagatttctcctcacggcgtgtcaccatcgtgagaagttgttgggtctgtgtccccttttatagggcgcccaccgctgtgggccccacggggaggtgacccgtgtttggtgggcctctgttgtgcgaggcgctcgggcgttcttagcatagcgttttgccgcccccacttgtgttgtgaaaccgcttgtgtattgttttaactagtgacgctgcggttgtgctggtgacactcttctagggatacacaggggtgttcacacatgctgagtgctctctgcccaattctttcaggttcctgataacttctttttcccacgaagaaccttggtttctggtggccaccccaagaagtcccctgggttcacagcttctctttctgtttctggagactgagagacagctgatgcagcctgaggagactactttcagaccccattcattctgaaagtgcccacgagagcaccacatggcagagtaaagttcttcatccacgagaataacagcattcctgcatccttccacgagttcctggttccttcaggttcatcccctttttttccttccatggattatgtaatacatgtgtaaagttttaattcaactttaaaattggaaattttgaaaaagaaaaataaaaa

SEQ ID NO: 679019 - DNA, 454 bp, Homo sapiens
  misc_feature (125)..(125): n is a, c, g, or t
gctggtttttgcctctttgacatctgtcatcagtatttagaggcgtgagcaagtgaatgctaacagcgtataacataacatttcttaaaaaacaattaacttgtgcttataatcacagtgtgttnccagagcactggtcagatcacattctaaatgaccaagaactggtttaaaaaacagaaaatacaaccatgggaaggaaatcttaaatgaaaaagcatctcattgtaggcattttgtgcctcaatattttttaaccttggggggccccaattgtttggtttcctggtactcatgtattttttttccagatctctttccccaagtggctatggtaagagtattctgctgcgtgtggatgcagttatacacattaaagcagatctggagtctgaagtagctataaagcagctataaaacagaaatacatgcatagttgcagaaaccatgatag

SEQ ID NO: 679020 - DNA, 161 bp, Homo sapiens
ttgcggtgactctacaggatcccccagcaagaatggcatatcagactaggaagcagataggaaaatgattatgcgggcgtgatcataaaggtgatagctcttctatataggggaagtagcgtcttgtatgacctacttgcgctgatatgccattcttgctg

SEQ ID NO: 679021 - DNA, 292 bp, Homo sapiens
gagtaggggactaccatcatggacggttcggctggcttacagagctccgcactgcatgtcttgtgtcccgaaaagacctttgccatatagggcctaattataatacatttaaatgttaagtctccaccccaaagtgaccatgggtgtatgttgcatgcatgtttgttcaatatgcatgtgtcagaaccactttcatgaatattcatagctcctcatgtaacctgttgaatgtgtatgtttagtcaatccattgagcatgaagctcctaccctccccaccttctcagacactg

SEQ ID NO: 679022 - DNA, 267 bp, Homo sapiens
  misc_feature (14)..(14): n is a, c, g, or t
  misc_feature (27)..(27): n is a, c, g, or t
  misc_feature (35)..(35): n is a, c, g, or t
  misc_feature (37)..(37): n is a, c, g, or t
  misc_feature (45)..(45): n is a, c, g, or t
  misc_feature (87)..(88): n is a, c, g, or t
  misc_feature (104)..(104): n is a, c, g, or t
  misc_feature (116)..(116): n is a, c, g, or t
  misc_feature (142)..(142): n is a, c, g, or t
  misc_feature (145)..(145): n is a, c, g, or t
  misc_feature (163)..(163): n is a, c, g, or t
  misc_feature (166)..(166): n is a, c, g, or t
  misc_feature (188)..(189): n is a, c, g, or t
  misc_feature (200)..(200): n is a, c, g, or t
  misc_feature (209)..(209): n is a, c, g, or t
  misc_feature (216)..(216): n is a, c, g, or t
  misc_feature (220)..(220): n is a, c, g, or t
  misc_feature (222)..(222): n is a, c, g, or t
  misc_feature (235)..(235): n is a, c, g, or t
  misc_feature (263)..(263): n is a, c, g, or t
  misc_feature (267)..(267): n is a, c, g, or t
cttcgggtggaccnggtcaacttcaanctcctaancnactgcctnctggtgaccctggccgcccacctccccgccgagttcaacccnncggtgcacgcctcccnggacaagttccnggcttctgtgagcaccgtgctgaccnccnaataccgttaagctgganccncggtggccatgcttcttgcccnntgggcctcccncgagccccncctcccngtcntncacccgtaccccngtggtctttgaataaagtctgagtgggngggn

SEQ ID NO: 679023 - DNA, 1007 bp, Homo sapiens
ggtttgtcttccattatgatttggcagtttacttttgtcttcccatcgtctactaaataatacaatagaattagcgtggtgggtggtggtgtaccccttgtgatcccagctactcgggaggctgagacaggtagaatcacttgtaacccaggaggcggaggctgcagtgagctgagatcacgccattgcactcaacgtcctggcgagcagagcgagactccgtctcactacaaaggaacagttcaatgacttgagtacccagaagaaatgtcgtgaccgtgcaaagtagcgttgctcatgtgtcctttgagacaatgatgtagctagtgcaggtgtgctcacaatttcagtttcttctactacatgtgtggtaccatttgtatttaagactggtgtcttagcaggaaactttagaggtggtgtttctataaggaaaatacgaaatgtcagtgctgtggggggactcgctgactagacactgcgttagcgaacggtgaattcttcaggattctgctccccgggatagaagggtactggcatggggatgacttgtgagctcgtttaccatctaaaaatcagttattgtccagatgcttggcgccaggtgcttccttggaaaagctcaaaccttcttaatccttggaatagtacttaacagaaagggcaccttggcggtgaatacaatggtcggttgaagcaacgagatttttacacctgatgggcttgaggcatttcgacaacgccctaaggatgagccaggcaccaccaatgggttgaccacctgggaacccaaactgaggcggctgggtaacaaaaagaacatggagtaagaaaaacaggccaagacatggggaaaataccaaagggccacgcaccacagacgtgtaccatgtcacacagcggggccacgtagatcggcgggtccccgaaatacaacgagatgaaataaatataacgacaagagaattgcaccatgattaacagctacagagagaacggacagcggg

SEQ ID NO: 679024 - DNA, 629 bp, Homo sapiens
  misc_feature (183)..(184): n is a, c, g, or t
  misc_feature (189)..(189): n is a, c, g, or t
  misc_feature (221)..(221): n is a, c, g, or t
  misc_feature (226)..(226): n is a, c, g, or t
  misc_feature (323)..(323): n is a, c, g, or t
  misc_feature (360)..(360): n is a, c, g, or t
  misc_feature (468)..(468): n is a, c, g, or t
  misc_feature (472)..(473): n is a, c, g, or t
  misc_feature (482)..(482): n is a, c, g, or t
  misc_feature (492)..(492): n is a, c, g, or t
  misc_feature (498)..(498): n is a, c, g, or t
  misc_feature (502)..(503): n is a, c, g, or t
  misc_feature (516)..(516): n is a, c, g, or t
  misc_feature (519)..(519): n is a, c, g, or t
  misc_feature (534)..(534): n is a, c, g, or t
  misc_feature (582)..(582): n is a, c, g, or t
  misc_feature (609)..(609): n is a, c, g, or t
tgggtggcctttttgaggccacccttgtggtctcttccattgccaacctgtaaccattatgcccaaagacaccaggttagcccgcgccatctgtggagaacgtgttttaagatcccctatgtggggaaactttcttttccaaaaaaaaaaaaaaaatttctcttctccctgttattggtagtnngacgntagaatattttttttcatggggtcaaaaggtncctangtatatgattgcgagtggaaaaataggggccagaaatcaggtattggcagtttttcccttttcatttgtgtgtgaatttttaatataaatgcggagncgtaaagccttaatgcaagttaaaatgtttcagtgancaagtttcagcggttcccctttataataattataaataaccctgttaaatttttttggccaacgccagcctttgggttttttttaaaacaagtaaattttttattganggcnnctaaatggngtttggagcntttttntcanncagtagattcccnccnttccctatacttttntaactgagttgtcctccatgcaaggacatgtttttaatgttgtctgtnttttgggctgttcctgtaagtttgctnttaaaatacattaaactata

SEQ ID NO: 679025 - DNA, 445 bp, Homo sapiens
caatttcaagcaagagatccattagggcggcgatgctgtggtgttttcctgtgcggaccattcattctaaagggagtcggtgcaggatcccgcttctgctttggggccaaactcttctgtcactatcagtgtccatctttactggctccctcagcatcagagcatgcatcaggggtccacacagggtcagctctctccaccacccagctcttccctgaccttcacgaagggatggctctccagtccttgggtcccgtagcacacagttacagtgtcctaagatactgctatcattcttcgctaatttgtatttggattcccttccccctacaagattatgagaccccagagggggaaggtttgggtcaaattttttttttgtatgtccagtttcctgcccagcccctgcagccttgtaactgcttaataaatgacctttccctga

SEQ ID NO: 679026 - DNA, 467 bp, Homo sapiens
aatatagctacatgtctggctctttggaatgattgtctcctctggatcttctgcccctcattcctgccctcaaactcagcctttctcaaccctctttctgcccttctttatcctttgcctgagtgttgacatggactggcctgtacctaaccactttcacgtgaattatttatgaccaatctcctatctacctgatagccttcccatctaccactatcccattagttattccaaagcatctttattatcttcaaattttactttccctttgccaataaaactctaagtttccatatgaatttcccagcaaaatttttcttcccttgaatcttctttactgactaaatcgtttggcttatcatccttgtcattctttccataatgaatctatcttccctgaccactctcagaccccttcgagatccagatattagctggctgaagaaagaatgcccaacaaaacttct

SEQ ID NO: 679027 - DNA, 168 bp, Homo sapiens
tcgtatttctgccaacgactcgtttcttccccacgaccgtatctaagtcccgcagccacgaaacattttttgaacatcagtaccaccctcccatgggtattggcctcatccttttacagggcaagtctagggcgaaaagtagaaaggatgaaaatccctgagagaggt

SEQ ID NO: 679028 - DNA, 160 bp, Homo sapiens
ggtgatggcggcgatgatcggctgcagcatgtcgctgacaggccgcggccgttgcggttgaactggaaccaggccattgccaggccgatcagcgcatagatggcacacgggtgcaggccccagtggaagaacgcatagcgcattgaggcgcgcgcggcat

SEQ ID NO: 679029 - DNA, 367 bp, Homo sapiens
atggccacttgggttcaccgtctgggggggctgcttattagtactcctggactaggggggcaaagagatcacaggtgtcatccaacgtaagcagtgtactctgacttcctacctacttgagagatatccacttcactgcccagctctaaactaaaggaacgatctggagtggaggacaggacccctggggaaaggggaagaggttgtaagaaggtgaagggggcaacctggtcgggttttgttaaactttctgggagatggccaattgggttcaccgtctgggggggctgcttattagtctcctggactaggggggcaaagagatcacaagtgtcatccaacgtggtcagtggccgtgtaccgagct

SEQ ID NO: 679030 - DNA, 105 bp, Homo sapiens
tatccagatgtattcacactcaaagggctggttcttggaatgatcctgtgaggacactaggactataagtatgccacacgataatggccactggccttagactta

SEQ ID NO: 679031 - DNA, 780 bp, Homo sapiens
gatcagaaacatttgtgtggctcagattaaagattaaactgaaaaagtgggcaatattggggaaagatgctactatcacttttaaaagttaaaaagttaatctcttaatacctattcagtttcaactgtctttggcaagaatactttataaagaatgtgctggttaattgatattgtatcccatcaaaaggctcatggtatatggttttgtaccttcagagatgcctagattgatcaacgagtttaggtggtgagattgcaagattctctgttaacctctcactcattaataatctttccataatcagaggttttttttttttttgtttttgtttttgggagaaagaccccctcttgtaaaatataatttaattattataatataatataccccttttggggtttttttctcgcccactgttgtgtttcccccggctccatttgggttcccgtaaatttaagggagaggggtttccatataaaaaccgttaatttttgggaaagtgtacgacgcgctttctccttttttttacattgggcgaccttttgtgtacggggggagattctccacagaatttggggcttaataccttttctcctaaggggacccgtggttttcctttccaacaggacgcatcttcatggggcgcggggtatcccggaatggggcggctggacggcaggggcgggtggtttctggaccactttccttcttgccccggtggtccatgggcgtttgggtcagatcccgcccctgttaggggtctcgcatggaatcta

SEQ ID NO: 679032 - DNA, 342 bp, Homo sapiens
agacccagtaaataatcctggcgcaagccaagaggaagaagtgctcaaagacaaagttcgggacaggttgattattcttgtcctgtccgacaaagcgacatacgacaagctctgtaaggaggttccgaactataagctcattactccagccgtggtctctgagagactgaagattcgcggttccttggccagggcagcccttcaggagctccttagtaaaggacttatcaagctggtttcaaagcacagagcccaagtaatttacaccagaaacacaaagggtggggacgctccagctgctggcgaagatgcatgaacaggttcaatcagctgtacatttgg

SEQ ID NO: 679033 - DNA, 186 bp, Homo sapiens
  misc_feature (96)..(96): n is a, c, g, or t
tgaaaaaaaaacactgatgaatagttttaggaatataaaaatatccaaccttcaataaggtaaaattcacaatgtttggcacctatgaaaaaattnccagggccacacgcagttgttcactcctgtaatcccagcactttggaggccaaggaaagaggattgcttaaggccaaacaccagcctggg

SEQ ID NO: 679034 - DNA, 831 bp, Homo sapiens
cagcagcgacggtagcagcagcattgcctgtagatctatggtggtgtagagtggtgtggaggcacacgatccgaggtccttttagtctcagaggattggaagatcctggcagaagcagacggactgagcacaaaccactggctgatctggtgacatgacaagtgtgtggagatgtgatcaatgagatggtgaacagggccaaactggaaagcaggggtggatcctctggtacctgctgcgaaggcttggagcctatctctgagcggtggtggaccagtgagtgactgctgtgggagtgatcctgatctgaggagctgagggaccgatttccctacctgagtgaaagctacttaatcacacaccgatgcctgcctggctccatcgccacagctacacctggatggtggagtatgtgctcatatcttggaacaggctccaactgcaggctcatacaacgcctgatggctccgagagtggctgcgtgcggctggtggccatatgattgggtgatgagggttcaggttgaggctcactgactggcccaagctcacgagggtacctaggatctagctacctatacgcttacagtaccgactagtactagagctactaagcttaagcctatgggtacagttgaggaccctatgggggtatcacatgggggacaactcctgaacctggccattccatgtggcaggatcatgagctgagaatataagagtgtgcaaaatgctggacgaagctgcatgagccgtgggtctccaggcagagatactgtgaacccaggaactccagatacatcgctcaggaaaagggcctggcatggtgtgg

SEQ ID NO: 679035 - DNA, 495 bp, Homo sapiens
  misc_feature (44)..(44): n is a, c, g, or t
  misc_feature (69)..(69): n is a, c, g, or t
  misc_feature (73)..(73): n is a, c, g, or t
  misc_feature (117)..(117): n is a, c, g, or t
  misc_feature (131)..(131): n is a, c, g, or t
  misc_feature (176)..(176): n is a, c, g, or t
ttttttttcctaatttattttaagttatcctgctgcaaaggagnatgtggttttttcattgcttgaaanctgnatattttcatatctagagttatgtcctgtccaggcaattcaaanaagcagaggccagnctgcctagtgcagtgtgcttggatttttcacttagtgtaaagagnccgtcagatactgaactgcatgaacgtagattttaattcttcatgtagtgctcttctgtctggttaaaggagtgtataggcactgaggcttcattgccttctgaacagtttttaaaagtttggctctggtgaagattgcattatgttatcttcatattccagtgagttattgtcttatggaatatttatcttaattactcatctgctgctaggaatatttcagtcttgttactggatataattactctaaaattctaacccttttggatgttacaaaagtcagatatgtaaaggttatactttgggtactgctgctcta

SEQ ID NO: 679036 - DNA, 934 bp, Homo sapiens
tgggaaaatgacaaagggaattcctcttttggaaagcgtccaaaaaaacccccactttgggcccccgtggggttctagggcctacccctcttcaaaagtcccctggggcaaatggtgggcccacccctggccaaggccgcaaagaagcaacgtaataacggggagctggccacgggctaaacacacgagaaataccaccggagaacagtgccacaatgagaggcgcaccataaaaatggtataccggaagattcagcgcatgggatcccggggaaggagacacaacaccctaaacccaaagaagggcacgctggtgcgacgcatcccagatctcatcctataaaaaagtgatccacccgagtctagcgcagtgccaacacaaagtgctcgcgtgggttgtaacaaaacaataacaacaacccaaacaaaaacaaacaaacaacgcaagacaaacaaaacacaacacaacaaacgcaaccaccaccacagacaaccacacaacaccaccaacgcctactgcaccaactagcagcgacgaagggccgacggcgccactaacaaccaccacctccccaccaacgacgcgaccgacaccaacaaccgcaccacacaccaccccacccttgaccttgcgtagacgctgagccacgcccccacccacacacagacaccgccacccacaatacaacacgacgcaccaccgcgcggagcgctgatgacccaacaacacgccgcccgacgaaccaaacaccccacgcctcggccacccgtgcgcgtcatctcccggacgaccaacacccacgcacgtgtggccggaccaccaaacaccgaagcacacccccaccaccaacaaaccacacgccaccacgccctgacaacaaaacacccccaccgggccacacgcgcagacaccaccacaccacagggcgcacca

SEQ ID NO: 679037 - DNA, 150 bp, Homo sapiens
ccgctcccggtagttcctggacttcctcacgcggccggtactgcgcgaggctttcggctgctgcgggccggccagtacccgcgcgccctggagctgctctgcgcgtctgccgctgcaggagaagctcaccgcccactgccctgcggccgc

SEQ ID NO: 679038 - DNA, 950 bp, Homo sapiens
  misc_feature (849)..(849): n is a, c, g, or t
aatgctgataggagctcggagactctgactccggctgtacaccccaattattgatgcgtctagcctctgcctagtgagtatgaagagggcgactcgcacctgactccagatgatgtatgctctaagcagacatggatgagccgtaatccgagtcagaagagtcacgcgaaacttccaactagtctcccttacatagtgaagggaactctgttatagagaatgaggcttcgctatcgaaaggagttgcacactgaacttccttgagctgtggtgggggccaagtcggagacaatttggaggcgttgcccacggtgtagaggcaagtgtcgcgcgactagtcacactagctatgtctaaacgcaacgtaggcacacgtactcccttattgtgaatggcatctgtgagttacagtacaattgacagaaatgcagttcacccgtcacacagacacatcccatccagagggtcctctaagacaggtgacacttatacactctctgcggagtcttcaacaacttttcagtgcaaaggtccgtctgcaccctttcagagccagacgcgaggcacaagctcttaatatcctcaccgaacaccacagttgacccaatgacggtccaacgaaagggttttggagacccaaaccgcctgaattaacgactgcacatacgatcctaattaaccatactagactcctgtgaatttcccaatagtcaatagcgtttcgcatttgctacaaacgcgcataacccaaacggtaattatcccccatacaaggggagcacttaaagagcaaggactgtcccacaaattcggctttgactctttcctaatggaaggttaccctaggtnaacttaccaccttggagaattcaccggtggtgtctccacgtgaaaattccttcccatagtgcttcggcggcattccagtggaaacaaatcgctggatcagg

SEQ ID NO: 679039 - DNA, 384 bp, Homo sapiens
ccgtaggtatatcagtgaggtccaaatacctcccaagaagatgataatcctgaaaagcgaagcttcgcttccgaagagtttagtacttttaataattataatgacgacaatctctttacttactcggatgtctactatcctacaaagtacaccacatacgtagccccatcaggctcattgcagccccgtaaggcctatccggctctttcacaacacccttctttcaatctaaatgcggctacttatactatcactttacctaaaaccgcatccaaaccagatcccacatcggactcttatcccctttagtcacttacttcggaggatactaccgtttatgtcgaggataactatcctgtatcaccttcacccgatgttgcatca

SEQ ID NO: 679040 - DNA, 153 bp, Homo sapiens
ggccagggtaatgatgtgggcctttggaaattgacaggatggaggtgagctgtctcagctcgtctgctatccagctcttactggattatgtcacctggctggtagaaaggtggcatctgtagcctgaccaggcttcagtgccaggcactgaag

SEQ ID NO: 679041 - DNA, 447 bp, Homo sapiens
cggatgctgactatttgatcagtagatatagacatcttcttgtagtttaacttcttcagtgactaatgagcttaagcaccttatcttatatctattggtctttagcatatcttatttgtaaaacgtctgttaatctttctctcatttttccaccaggctgcctgatgtttgatcaaattcataatatatttgaggcatatgtgtttttaattttcatatagcttatttttatcagtcttacggttgatgctttttgtgtgttgttcagtaaatcctttccatttcaagatcatgaagagatatctcttgtattataggtttgctttttagatctttattttttattttattttattttattttggtcctgtcgcccaggctggagtgtagtgagctgagatcacttcattgcactccaggctgggcagcagagcgagactctgtctc

SEQ ID NO: 679042 - DNA, 472 bp, Homo sapiens
ggagtgcatggccacagccacctccacccccaagaaacctccatcctgccaggagcagcctccaagaaacttttaaaaaatagatttgcaaaaagtgaacagattgctacacacacacacacacacacacacacacacacacacagactacttcagtcgtgggcgtggcagagggggacagatgcttcaggggagggggcgtgatgtcgtggctaggggcgcctgatgctccagggacgccaccagccagcctctttcccaggccgagcgaggacgaggcgtgctctcgtggtgtgatgtggcgtgacagacgcaggtgtcctgcagggccaccgagcgtgtgtggagtgtcaccagagagagggggctctgatgtgccctctgcgggggaggggtccatcctctccgggtgtgagcccactctctgtccgctgttctcctatttcgtgctcttcttgccacacatgtgggc

SEQ ID NO: 679043 - DNA, 437 bp, Homo sapiens
tctcgattccgtgggtggtgtatgcatggccgtacatagttggtggagcaataggtggtgatgtcgatcggcgagtttatcgattacagaacatgttcctctacaggagatatgaaggcaccgccaggtcctttgagttatgaggctgtggcatcgtattgtgctggcgagcaggttggtggatttagctgtaccatgagttgagggccaaacatagtggggtatctaatcccagtgtgggtctataattattgtgtgtccatatatgtaaaagccactttcgtagtctattttgtgtcaactggagttaattacaactcaggtgagttttcgcttcattaggggagggggtgatctagaccactcttgacgccggtttctcttgacttgggttaatcgtgtgaccgcgttggtaggcacgaaattgaccaaccctg

SEQ ID NO: 679044 - DNA, 80 bp, Homo sapiens
ttaaaatgacaaatgcaaaatggaaacacctatgagccaaaaatttgtcacagaattttgagacccattaaaaaagttaa

SEQ ID NO: 679045 - DNA, 2993 bp, Homo sapiens
  misc_feature (1041)..(1043): n is a, c, g, or t
  misc_feature (1894)..(1894): n is a, c, g, or t
  misc_feature (1903)..(1903): n is a, c, g, or t
  misc_feature (1921)..(1921): n is a, c, g, or t
  misc_feature (1930)..(1930): n is a, c, g, or t
  misc_feature (1937)..(1937): n is a, c, g, or t
  misc_feature (1939)..(1939): n is a, c, g, or t
  misc_feature (1966)..(1966): n is a, c, g, or t
  misc_feature (1975)..(1975): n is a, c, g, or t
  misc_feature (2008)..(2008): n is a, c, g, or t
  misc_feature (2026)..(2026): n is a, c, g, or t
  misc_feature (2044)..(2044): n is a, c, g, or t
gtgtcaagttacagaggcgcgggaatcggcccctgcgctcctcgccagccgccacgacccacctctgcccatgggccctgcatgtgcgccccttcgcccggggactgaaactgactggcccgggagacaccccgaggcgcccagaaggactgacagcgcggcaccaactgctctgcagacacttgaagggaaagactgggcggagagaaggagagccggtcagattcccctaactttcctggacttggaacgttcttcgaaataacttttttctccacctaggttgtaccccaattaccgctggttgtgctttttcggcacttcctctcctactgctaattttccgtcctctttgccgggagcagcggaaagggacgttttccagcgatacaagccctttccccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacagctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggcactagaggtttccctggatttccgggtcccattgggctggacggcnnnccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccagataattgccctgaagctgctgcctctcctcaattcagtgcgactggctccacccccggtcataaaaaggcggacattccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgcgcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcntggtcttcntgggcaaattggcccacntggagctcnagggatncnaggccagaagggggagattggactgcnaggccctcnaggacacgatgggaaaggacctcgcggtaaacnaggagacatgggccctcntggtccccaaggcccccnaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggacaagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaaccgttgcatattttgtacagaaaatatcaacctcttcccttttgtttacaagatgttttgtataagcctatgtctctaatacattttttgtttggtcgtaatgtctgcatgatatttgtgcacatttattaagtatcgaaggttaataaattgttgtgtcctggtgccaaggggggccagccagaactgaggtgctggctagctcatgtgtgaattcg

SEQ ID NO: 679046 - DNA, 2927 bp, Homo sapiens
  misc_feature (1041)..(1043): n is a, c, g, or t
  misc_feature (1828)..(1828): n is a, c, g, or t
  misc_feature (1837)..(1837): n is a, c, g, or t
  misc_feature (1855)..(1855): n is a, c, g, or t
  misc_feature (1864)..(1864): n is a, c, g, or t
  misc_feature (1871)..(1871): n is a, c, g, or t
  misc_feature (1873)..(1873): n is a, c, g, or t
  misc_feature (1900)..(1900): n is a, c, g, or t
  misc_feature (1909)..(1909): n is a, c, g, or t
  misc_feature (1942)..(1942): n is a, c, g, or t
  misc_feature (1960)..(1960): n is a, c, g, or t
  misc_feature (1978)..(1978): n is a, c, g, or t
gtgtcaagttacagaggcgcgggaatcggcccctgcgctcctcgccagccgccacgacccacctctgcccatgggccctgcatgtgcgccccttcgcccggggactgaaactgactggcccgggagacaccccgaggcgcccagaaggactgacagcgcggcaccaactgctctgcagacacttgaagggaaagactgggcggagagaaggagagccggtcagattcccctaactttcctggacttggaacgttcttcgaaataacttttttctccacctaggttgtaccccaattaccgctggttgtgctttttcggcacttcctctcctactgctaattttccgtcctctttgccgggagcagcggaaagggacgttttccagcgatacaagccctttccccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacagctattttgggacgagtcaatcaactgctggacgagaaatggaagctccactcaaggaggcgccgggaggccccaaagacatctccaggatgtaactgcccaccaggacctcctggtcccactggaagacccggactcccaggggacaaaggtgccattgggatgcctggacgtgtggggtcccccggagacgctgggctgtccatcattggtccccgcggcccccctggtcaaccaggcactagaggtttccctggatttccgggtcccattgggctggacggcnnnccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccagataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgcgcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcntggtcttcntgggcaaattggcccacntggagctcnagggatncnaggccagaagggggagattggactgcnaggccctcnaggacacgatgggaaaggacctcgcggtaaacnaggagacatgggccctcntggtccccaaggcccccnaggaaaggatggacctccaggagtgaagggagaaaacgggcacccagggagcccaggagagaagggggaaaaaggggagacaggacaagcaggctcaccgggagagaaaggagaagccggggagaagggcaatccaggagcagaggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggacaagggagaccaaggagcgcctggattagatgccccctgcccattgggcgaagatggcttaccagtccaaggctgctggaacaagtgatgcctctaaccttggattggcctgtgtgtgtgtttgtacatagaatatttatttttatacagttttcactttttgaaaatgccagaagtatgatgcatcttacagattattaaaaaagaaagaaaaaccgttgcatattttgtacagaaaatatcaacctcttcccttttgtttacaagatgttttgtataagcctatgtctctaatacattttttgtttggtcgtaatgtctgcatgatatttgtgcacatttattaagtatcgaaggttaataaattgttgtgtcctggtgccaaggggggccagccagaactgaggtgctggctagctcatgtgtgaattcg

SEQ ID NO: 679047 - DNA, 276 bp, Homo sapiens
atataatccgtagaggacatccttatcagaaaaaacagtccttctgctgtttactccatttctaacagcaacctgcagccttcatcccttagtcaacaccatgacagcttctcccatactccccgttcctgcgcagtccgctttctcttgctgccacattctaaaggcttgatattttccaaatagatcctcttgggattatgaatcctattcgcttgaccaacacagttcctttttgtagtactattacttttatccggccggttggctccattt

SEQ ID NO: 679048 - DNA, 496 bp, Homo sapiens
gggtatgacatcgtggtcatcaccgacgactcgcaccacgcctacccggaccaccggaggaaagcaagatcaggcaacaaggactctgcaggagcttggcattgaactggatgaggccacccgctggatctaagggctggatcgcatccacagggtgcggcgcatcagtcactgttttgacctgacgggcacgccctttgcccccacgggcaagaccagcaccgaaacggcactgttcccgtgggtgatttcggacttcgggctgaatgatgcgatcgactccggtctggtgaagacgccacgcgtcgtggtccgcgacaacgcgcttcccaatgcccagacatacaagtcgaagctgtaccacctctaccgggaaccggaggtcggtcaggatctgaaccgccctggcgcagaaccccacgaaccgctaccccagctggtacaggaggcgtataccctgttaggtgccgactggcgtgagacactgaaggcgtgg

SEQ ID NO: 679049 - DNA, 206 bp, Homo sapiens
  misc_feature (132)..(132): n is a, c, g, or t
tgcggtatctagaggatccgggatgaggaagtactaggtcgcacacatgcagtaatatttctatagaaaaggtctcagtgtgttgctagtccggtgtcaaagccctggcttcaagtgatcctccagctcganctcctgaagtgactgtgggccactgcatctgtcgttttttttttggttggttttggttttggttttggagacgg

SEQ ID NO: 679050 - DNA, 307 bp, Homo sapiens
ccccgctggccaatgcattgaggttgttggacgctctcctcactctggcctccagtacaggaaggtgatcccagtgacagcgtgggggcactgtgcggcgcccggcctatgacgcgtcgccatggcattctcctcagtgagacatgttctgacgtgcacgcatggtctggggtgaccatgtcggagttacaggatggtgccttccagctagatagtggtgctcactcagaggcttgtagagggcagcgaggaactccttcttggtcacatacggccagcgttaccaagtcagggggatctcctctag

SEQ ID NO: 679051 - DNA, 110 bp, Homo sapiens
gaaagccaccagacggtgcttcctcatcaaattgtgtgagctgatatttgccagccttgtgagaaagaagaggaaagagcacgaagacagtggccgaaagatgatgcaaa

SEQ ID NO: 679052 - DNA, 236 bp, Homo sapiens
cttgatgaaattcaaagagcgctcattcattgaggtgaagtgctatgaagatgtcacttgctgcattgggagtatatggtatctggtacattagaactactggatttaatgcaatcctgcataaaaatataatttatactatgtgaaaaaataagacaggacttaccactaggaaccacccagaccaatcatcattaacttttttaagattgcggtgtttgcgattgcggtgtttg

SEQ ID NO: 679053 - DNA, 151 bp, Homo sapiens
tctagcaggatcctgaaaatgacatagaggcaggctctgtcctgtgctcaggctggagtgcaatagtgcaatcagagttcagtgcagtttcaacctccagggttcaaagcgatcctcccacctcagcctcccgagtagctgggactacagg

SEQ ID NO: 679054 - DNA, 533 bp, Homo sapiens
ggaccagcgacatttgcacacatatataaattgatacttgaatcttgataacagtcagcacgtttaaatctataagagctaataagatctcattttcagaggtctggccgagatacctccagcctggacaacagagcaagaccctttgtctaaaaaaaaaaaagcatacttttttggacttgactattttcggagtggtacaaccattgccacagtctaattttagaagcatttataatacttcgaaaagttaccctgtaccctttagcagtcacttctcatttattctctttctgtactccccatttctgtccccgatctatgttacctattaatctcatgatttgcctattctggtcatttcacgatcaaattgattgggtctttttaaataattaaatattccccctctttcccctagaaatcttaagtaatggggcgagacgtaaagaccatgtttctaagaaagaattatggtagttgaaatttgggaaacaagtgttagaatttgtataccttgttgtcacatacgg

SEQ ID NO: 679055 - DNA, 291 bp, Homo sapiens
tgttcaaatcatttccgggtcaggcaagaccaccctggagtcattgcatcctccttgtccctgtcacccttgaatcctctcaacaaaatgtgaccagccttttgtctctttgatgtggctataagtaaaaatgcataaatgacctggaatcccacctaaggatttcgaattcaatggtgatttaagccaatcaccaatctaatattgggaaataagcaaatggaggaaccttgtttattaaattacaacccaccatctataattgttttgagaaaggaggggggactcttt

SEQ ID NO: 679056 - DNA, 424 bp, Homo sapiens
  misc_feature (147)..(147): n is a, c, g, or t
  misc_feature (151)..(151): n is a, c, g, or t
  misc_feature (205)..(205): n is a, c, g, or t
  misc_feature (243)..(243): n is a, c, g, or t
aagaaaatgtggtatatatatataatggagtactatttagtgtaaaagaatgagatttagttatttgcaaaatatggatggaactggagattattatgctatatgaaataagttaggtatagaaagttaaatatcataggttcctanttanttaaacaatttaaataattgagtttatggagatagagagtagaaggatggttantaaggccggggaaggggtggttggttgggggtggtggntaggggagttggagaaggttaatggtgccaaaaaaacacataaagaatgggccaggcgtggtggctcatgcctgtaatctcaacactttgggaggccgaggcgggtagatcacttaaggtcaggagttcgagaccaacctggccaacgtggtgaaaccctgtctctactaaaaatacaaaa

SEQ ID NO: 679057 - DNA, 1340 bp, Homo sapiens
gctttaacctcgttgcactgttgagagcaagacgggtcaccatgcagctgtactgtggagccaacctgggaaaattctggccagggatatcatcgctcttgtgtcgttgtctggttcaacacctggcacggggctggatccgggacatatggcctcgaatatgtgccggccatgtggatttccggtacagttacgccgaagggatatcgggttttccataaacgtgggcactaaaattggctcttcctttccagacggattatccggagggccatctactacaatggcacaaacacatggataaattcactttgagtagtattaagagaagttaaacaattttggacaaacaaaggctaaaagaacaataagaaacgaagaaacaacgacgaaaaacaaaataaagtgaatagccggtagagtaatgataagacagaaaagcatcacaacaaaaaattaagaggaagagagctcagaagagacggaaactacaagaacagagaaaacacgaaaggaacgcacgccgaaaaggagaccaacgaaaggaagaaggagggcagaagaagacgagaaagagggggagggtgcagacaacaccacgagacgagcagcggaggagaagacaaggcccgagcgcctcgcaacaagacaaaaggtgccgaaagagagagaggaggagagaaagaagagaagagggaggaggagagggagaggggggaggggggggtagatgggtggttggggaggggcggggaaggaggaaggagggagagtgggggtcgaggatgcgtggaggtgtggtgaggagcgggaggaggagggatgggatggtgcgggaaaatcacaaagacgaacaagaccagagagacaacacaagcacgcaaagagaaagaaagaaaagaagcagaacaggcggcgcaagcgaaacacaagacagaaacgaaggcaaggacgaacgaagacagaccacgctagcgaggcgcagaccgacaagaaaaagaaaacagcaaggcaggaagcagagagggaacagagagagcagagcaagagaggagcagagagggaaggcgaagaagagggggagggaagaaaagaaggaagagaggtaagagaagagacgaaaagagagaatgggaggaaaaggaggagtagatacgtccagagaaaaagagcgcgaagcgtaaacacgaggagcatagaaagagagagagaagagagagcaggaacaggaaaaggtatagagagagaagacagaaaggaagaggaaaagggagaaaaggaagtatacaagaaaaggaggaaagagacgacggacgtgagcagaagaaggaggagaggaa

SEQ ID NO: 679058 - DNA, 497 bp, Homo sapiens
  misc_feature (180)..(180): n is a, c, g, or t
  misc_feature (202)..(202): n is a, c, g, or t
  misc_feature (214)..(214): n is a, c, g, or t
  misc_feature (229)..(230): n is a, c, g, or t
  misc_feature (233)..(233): n is a, c, g, or t
  misc_feature (235)..(235): n is a, c, g, or t
  misc_feature (335)..(335): n is a, c, g, or t
  misc_feature (354)..(354): n is a, c, g, or t
  misc_feature (375)..(375): n is a, c, g, or t
  misc_feature (480)..(480): n is a, c, g, or t
ggcagaggaccttccccatcctccatcatgtgagcagccagagccgggcgctcgaacttgcgcaatggtggctgccgcaccaccggctcgggcgtcaggcagttatctgggagtccccgagggccgagtcggggccatgtgggcgggtcggggtcttgcgtttttggagcactgagtttngatcccctgcctacgttttcanttctggcaagtntaaggaaaagcttcnnagnanagtccctctagccttcctcgtcggttggcctggaagcgtttctgtgtggccaaagggcggggcgaacaggacggagaagggtgcgcacacggattccttnacccactcgagttctcccnacctacgtggctggaggaggntgcgcgtgctctgtgggtttggactgagttggtggttaaaccgcatggccgccgtgctgctcacaagtgctgggctcccttgaatgtacccctaaagaagggtanatttcctcggatgaaat

SEQ ID NO: 679059 - DNA, 1257 bp, Homo sapiens
  misc_feature (279)..(279): n is a, c, g, or t
gagacgttcttcgccgagagtcgtcggggtttccatgcttcaactagtgcttggacggatcccggcgctcgttcccgctaacccaggccagggcgccacattgccggcccttccgctctaccatcttctaccgcgactcctcgagatgtgtcccgaaggttccctcgatcgactgcgtcctagcgcctgatgcgagacaacacgagcagaaccggcgcgaccgtcgcgtcctcacgtataaggtccagccggacacagtgggaactgagcctggcagtntactactcgttcgtcgacgtggtggcagaccgaatagaacatcagcacaaccaagcgaatctccagggatgggccggcactattctaatcccgggcagagagtcaattacccttgggagggcttcagtagcccgctcttgcccttgaaatcggttttggaaccgccgtcgcgttgcccacattgggttgcgttacgcacctttgaactgtggttgagagccctgggcgggacatcgaagttgcggtctggcacttccccggaagagtggaaaactctgtataggcgcaaaacattctagcatttttccccttggtgctaacctccgagaacttcgttaccaatttcgcacggtggaatggatggacagaattatgcgaattggccttggggcaggccatagaaaccttcggtcatttggagaaaacggtcctcgggacgcaggtgacaagccccaaagattggggaaggggagtgagcctcccggtaaaatttcctttttgcctccttttccatagcggagtctctcacttccttacacgtgaggagggccccgaggagaactcttagtgctagaacactagcgacggcttagggtggcagttacggtgagccgcacgcagagcttctaggtggaaacgtagtggcgcaacgcgtgggacaccgcgttgggataggtccaggtttccacaacccaatgtgctgtcgagcgcaaacgaacaccaaaggacggctagttatgacaaaaggttcaacacggattatccgacctttgaaccgattgtgggtataagcacatagtgacccacacagcagaagcgcttggaggacacaaagtcgttggtgagccgactacgagagacaaccgtatggaaacctcatccccccgataggtatatatggcggtaagatgagaaaccggtgtagcaagtttgcaggaagtttaaccagaccatctgttaagcccgtcttgtaacatt

SEQ ID NO: 679060 - DNA, 153 bp, Homo sapiens
aagggtgacaacctctgggtagacatgtcgtgagccctgcccggtgccataaggcgttcagtgttaagagacaccaagctggtttgcaacttccaagagctcacgcgaatagggtttcgtcttggctctatgaggcacaattgcccttcagtt

SEQ ID NO: 679061 - DNA, 121 bp, Homo sapiens
ggaccccctcacttcctgctcttcagaagaaagacttgaggggctcaggcagagtgagagaccaaggcaagttttagagcaggagagaaagtttattaaaaagctttaaaccagtgtggag

SEQ ID NO: 679062 - DNA, 303 bp, Homo sapiens
  misc_feature (280)..(280): n is a, c, g, or t
  misc_feature (283)..(283): n is a, c, g, or t
ggaggacagactgagagaagatcacctgcaaactctctgaagcagatggtgtagtctgtgtagcactagaatgcagatgtccacttcacatgatggtgtgagtttgcacagggccatttccttggtgacctgtgtgtcctaaatccaaggggactctcccagaacattctgttgtgataaagattctagggattttctgattcctgagatgggaagaacttagttcatgtaatggcaagttgggggctcaggatatgattcaattttaataaaaacaatnacngcaattaaaaacaaaaaatt

SEQ ID NO: 679063 - DNA, 484 bp, Homo sapiens
gcagtaccatcaaggaacagaacagagccctcagaaataacgccacatatctacaagtatctgatcttgacaaacctgagaaaaacaagcaaggggaaaggattccctatttaataaatggtgctgggaaaactggctaaccatatgtagaaagctgaaactggatcccttccttacaccttatacaaaaatctacttcacgactggacttaacacgaccttaaatgttacgaccctaaaacccatacaaaaccctagacacgaaacacctacggctttaccacttccggaaactaggcgtgggcaaggaccttcactgtccaaaacacccaaacagcaactggcaaacaaaaggccaaaacttgaccaaactgggatctacattaaactacagagcttctgcccagccaacgacacctccccatcagagtgaaccaggcaacctaccaaaaatgggcgcacacattttcgcaccctactcatc

SEQ ID NO: 679064 - DNA, 183 bp, Homo sapiens
tctacaacgacagagtgctgcggaagaggtgtggtacaggaggcattgctgatcaatcttgaggcgtgttgtcatacgttctcagtggttcacacccgataaccgaacatagagggcgtcagcaagaggggcgcagcagatggtgaccctattgggctccccgcttgcaaatagagccacgag

SEQ ID NO: 679065 - DNA, 989 bp, Homo sapiens
  misc_feature (478)..(478): n is a, c, g, or t
  misc_feature (531)..(531): n is a, c, g, or t
ctctagcagaaaaagtggcggtatttctccgatctggctctcctctacctccaggcaggctcacccgaagatccccgcacctataacgcccacctgcacaactcagacacagggtctgttgctccccagagacggtacgctttctcgtcggtctattctagagcacaccattggatgtcagagtctgagggatgccgggaacatcggctcagcgtgcgaacgaggcatggcccgcgggcgggtgatcttcgagtaagccctgctggatgcatctactgaagcttccgatttgacacacggaggatgcatccgcgtttgtagttatcggcatataccaggaacgtgagaagaaagatccgtgaaagaaatcatccgggtacagggtccgcggtcgatttgtcatcatgcaaaggtctcctaacatagccaacggtttgccgtgatttgggcaccatgcaggacatgtcactcgttagtngcccctgcttgcatcttgacttgtttggctcgagttgtgctacttctactttngaatgcctcgggaaggagtaatcacgaccacttgcacgaaacacttgtacgggcacgcgcattcattgtggcttgtacctttcttggttacgaaaaccaaagcattcctattcgccataccctctacaccaaggttgcataacccaattgtggggcccacgaacgtaggttgactaggaggcgaccaagatccattgcacgagagaagcacgtaatttcctttcctgcataattagattggggcacctaaccaagtttcgtacttgcaagaagctggttgcataagtgtgggaacaagggtggaagctggggttctaggggaaaacgcccgccaagcgacacaatggggtagtcatcgcctggctacccttgggcgagcgcatagcgtagcaacgagggactggtggctgcttgccgtcaggaccactgtggggtaccaccaacggtgttggcattcg

SEQ ID NO: 679066 - DNA, 468 bp, Homo sapiens
  misc_feature (319)..(319): n is a, c, g, or t
  misc_feature (360)..(360): n is a, c, g, or t
acagagtcctcttccatacactactgcacagtgttgctatgtagccagtctgtcagagtgcaatggactgtctgaagagtaaggcagcggcctgtctctctggggcttatgcagctgctaccagcttaccctcatgctgggtgggagtggccagcaggtccagtgcaggcattcaagtgcaccagccccacagctagcgtctccctcccgtgacagcagcacagacctcacgcagacctcctccagcgtgacagtgacgctgcccgccaccatcatgacgtcatccgtgcccacaactgtgggtggccacatgatgtancactagccgcatgcggtgatgtatgccccacctcgtgcctngtgatggcagcccaccgtgctagaatgcttctccaggaccatccacatgcaggttccacagcaggtcaggagcaggtgcgtccccaggtgtcctacagcatcatctgg

SEQ ID NO: 679067 - DNA, 169 bp, Homo sapiens
tgccttctgcccttgtcttcccagccttggagataaacgtggtcccactgaaccacaaagactgtcccattgtcaaatgtaaacaactgtggagttgtgtcatattcctggctaaaaacccagattatgtgactctcctctctccctattcataggctgaagcaggaag

SEQ ID NO: 679068 - DNA, 372 bp, Homo sapiens
gccctggacctgtccctctgtccccaccctgtccctctgtccgtgtccatgccctgtccctctgttcccactctgtccgtctatccctgccctgtccctctgtccccgccctgtccctctgtccatctccactctgtccctctgtccctctctcccccatccctctgtccctctgtctctctgtcccccgtccctctgtccctctgtccctgccagtctatgccctgtgctcatggatttccctcacaggaactttcattttcacacaatgaacaagcgaatgcagctctgggtgagggcagggccccacctctcaaaaggacgactcagtccgtcgacgcggccgcgaatttagtagtagtaggcggccgc

SEQ ID NO: 679069 - DNA, 1117 bp, Homo sapiens
  misc_feature (557)..(557): n is a, c, g, or t
  misc_feature (586)..(586): n is a, c, g, or t
  misc_feature (612)..(612): n is a, c, g, or t
cccagaagtcccgcctgcttggggttccacacgcacgctgatctatatcctggagatcaacatggccaagaccagccagaccgtggcccacctgttcctagtatagacgctaggcagcagaaaggcttgacatcctctggggggagcatggagcgtgcggtgattcttggagctgaagcgtgctgtgtgcgagcgccggggtctgcccttcgacggtcgccatccgtgcctggggacatggcgctactacatgaaccaggtgggaggtagacgcgctactgcgtggaaccagtagacctgctcaagggattacttccccgtgcaggtggtcactgcacggtgctgctgtggcatctaccaggagctcctggggctggccttccaccatcgaggagggcgcctagtgcctgtgcactgaggacgtgcggctctacaccgcgagggacgcggcctcgggggaggtggtcggcaagttctacctggacctgtacccgcgggaaggaaagtacgggcacgcggctgctttggcctgcagcccggctgcctgcggcaggatnggagccgccagatcgccatcgcggccatngtggccaacttcaccaagcccacagncgacgcgccctcgctgctgcagcatgacgaggtggagacctacttccatgagtttggccacgtgattgcaccagctctggtcccaggcggagttcgccatgtttccggggggacccacgttgagcggggactttgtgggaggcgccgtcgcagatgctggagaactgggttgtgggagccggaagcgctgctgcgggatttccggactaccgacaggcagcgccgtgccccgggagctcctggaggaagtcattgagtccccgggaggccacaacagggcctttttaacattggccggaattgtcctctcccacgggtggaccacgggcccgttcacagagaaaggaagctgaccccgcgagagtatttgcgcgctgttcggaaaacactcaggtccggcacgccggaaacaattctgtggaccctgccactggagggtattataccccaactggacagtgttgcgagagacagaaactaataacacacacaaggtgctagctaa

SEQ ID NO: 679070 - DNA, 1480 bp, Homo sapiens
  misc_feature (2)..(2): n is a, c, g, or t
  misc_feature (5)..(5): n is a, c, g, or t
  misc_feature (26)..(26): n is a, c, g, or t
  misc_feature (58)..(58): n is a, c, g, or t
anagncactgagctttatttacaaanttccacagaatccctcaccctccaccccaggncctccctctctggaactcaggcagcagacaagtttgggccacccacctgtgcccaactcttaggaaccgtcgtggtgcctgtgagctgtgggcgggcaggggatttccattcttccgtgggtgtgccgcctgtgccagaagggagaagaggcttggaaggcggctggaaattgcgtgattcttcccccagagaagtatcagactccttcagggactttcgtgcacgagtgggaaccgttggcggccgcaggggcacctgtgagggacactgtgaccagagtctcgagggtctcagggggcgcaagaatctctgtgcaattgtggtgtgaacgcgcccgggtgtgaacaagagggcgtgcagtggtgtcgccggtacacaggattctcgtgggtgacagtggagcctctcaagcggtgtagataccaataaggctaccagaagggtctcacaagtgtgttcccgtagggagagccgtgacgcctattctctctctacagaaccttttcgagaagcgcacaacacatgtgtctcccacaaggctccacaagacgagggaacagtgtgacacggaggaccaaggggccacagggatgtgtgtctcccagcaggctgcggttcaacagcacggcccttctatatatccgcccgcggtgttgagaacttgcgtggcgaatcaccccgcgagcatagcacagaggaggagggccatccccacaagggggacctcacgaaacaacgagcagagcagacaatcggcgatcaacacacctgttgaaacaccgcgttgccaagcaagtgtgacatttggcgcccccaacggggggttacccccaggaggggcccctctgtgactggggggatacctcaagaccagaggtacggtcacctcttcagcaaccacggcgcacggacgcaaacgagcgagcagaggttaaacccccaggcgagaattcacccaacacacggcgccgaccccgcgggggcaaacaccactggggcagcgcccacggtgtatattagacaccacacggcgggtaaacacacgaagtttcacacaccgcggaccatcattgtttcaacacggtgggggctcacctagttccctgactccaccaaaagagcgccgcgctgttgtcgccaccccaacgatatggggtacatccacactagcaacggtcaacatagcggtcctctgtgtcgatcacacgaatgaggtgggaggacatcacaacgacgaaggtgcgggcatgtggcaagacgagaataccacgcgccaccttccatacatgataaggggaagatatcacaccgagaaagaaacactaccgtggcagtgcgtgtgtctgatgaagcacaataacaaggcgccactacgtggcgcagctcaatagggaaacgatacgacagaaacgatcgtatcg

SEQ ID NO: 679071 - DNA, 497 bp, Homo sapiens
  misc_feature (40)..(40): n is a, c, g, or t
  misc_feature (58)..(58): n is a, c, g, or t
atatgtaatttcctaggtaacgtataattcaccaaaaccngacccccaagggatatanaaactctaaataatctgatttcaacaaatgaattagagaaatgtgccaattattaatactctgaaacctctggccttggaagttttctaggaaaattctaccacatttttaaagaacagtgaattccagcattttaaaatagccccagaacaaggaaaaatttaaaaaaattattctttcctctacaaaaaagagtaacactaatatcaaaactttataaagactgcaggaaacaaaaacagctgacgaatcttaggtatgaatatcggtgaaacattcccagaagcacttgaacaaataattcgttatatgaaatgtgacttattccagggaaagcaagaatggtcaaatattgtaaaaccattaatataatttatatgaatatatctagagatacagcacaagataatttccatagatgaaaaaggtttttgaccaa

SEQ ID NO: 679072 - DNA, 320 bp, Homo sapiens
  misc_feature (2)..(2): n is a, c, g, or t
  misc_feature (5)..(5): n is a, c, g, or t
  misc_feature (26)..(26): n is a, c, g, or t
  misc_feature (58)..(58): n is a, c, g, or t
  misc_feature (227)..(227): n is a, c, g, or t
  misc_feature (252)..(252): n is a, c, g, or t
  misc_feature (316)..(316): n is a, c, g, or t
anagncactgagctttatttacaaanttccacagaatccctcaccctccaccccaggncctccctctctggaactcaggcagcagacaagtttgggccacccacctgcccaacctaggacagctgggctgagctgggcggcaggggattcatctcctgggtgcgctgcagaggggagaggctggaggggcgggaatgctgttctccccaggagtcagtcctcagggnttctgcgtgggacgtggggcgaggnactggggcactgaccaggtcggggtcgggggagcatctcattggtgaggcgggtgaaaaggctnctgg

SEQ ID NO: 679073 - DNA, 1129 bp, Homo sapiens
gttatggtaattgttcttataattttgtatattagtaatagaggttagacatgttcaatacagagcctgaaaaatcccagaaaagcattacctatctattgattagatgaaccacgtgtatagacattttggatgcatagtccgtttcgatgcttttttataatatatagcatgtaactatatcctattttccctctactaataagtggaattcttaagcatactgctcaagtagtcctacttttagagtctatctaagctattcatttagtttccgtgttttgcttatatatcattgtgtttgcttgattgaggacagggtgacactattggtgaggaaacccacgtgggtagcccaaccgtggagaacaaatcgcagtgctatctaggcccaacgaaggtgcgtgtctgttggagagagccctaatgggtttgaagagtttgtgctagaacataggcttgtgccaaagaaattattgtatacccttgaagaataacattgaaactgctgtacataagacatattacttcaaatggcatggagcgagagcgcgcattaaaacatacaacgctcgatctgatgataggaaggatccaatgaaaagggatacaggaacatggctggaattgtttgcgagctttgacatcacagtacaagttggatgcagagcggcaaattacgacaagttcgtccccgcacatatatgttagttacatttagatacataggacgagtttgaccccacgtaagcaggaaccctttcctttttaacgattgttaattgccccacggagaagaaatacacattctttcgtccatggcattaaccacaaaaaggtcgtgactttccaacatgacttggcattgtgtagcgcgaacacaaattgcttttcgtcccacaacgacgtgagttcggaactaaacaagccctgcccattggacactggatagggagcaaaacaggtattcctgtattcggacaccctttcccggcggcactcgaacaagggggaaacgggcgtgatcacagatcctcgtgacgcacccaccacgcgaggcacctcacaacgatcggatcgcacacagttatttctcagcaactcattctgggacgaacacacacgaatc

SEQ ID NO: 679074 - DNA, 725 bp, Homo sapiens
  misc_feature (7)..(8): n is a, c, g, or t
  misc_feature (41)..(41): n is a, c, g, or t
  misc_feature (53)..(53): n is a, c, g, or t
  misc_feature (82)..(82): n is a, c, g, or t
  misc_feature (226)..(226): n is a, c, g, or t
gactttnnattttttagcaattttatgttcacagcaaattngatttcctgtanctctgttcccccacacgtgcacaggtctncccccattatcaccatcccccatcacagtggtacatttgttaaaattgataaacctacattgacacatcattatcaccccaagtccatagtcgatgttgggttcactctatgtatatgctttgggtttgggcaaatatataatngacatatatcctccataatagtatcttacaggaataattacactgccctaaaaaatctgtgctctgtctgttcatctcttccttccccccagcacctggcaaccactgatctctttactgtctccatagatttgcctttttcagaatgtcatatagttggaaccatatagtatatggccttttcagattggcttctttcacttaataatatgcatttcaatttctagggctgggcgtggtggctcacgcctgtaatcccagcactttgggaggccgaggccggcggatcacgaggtcaggagatcaagacgatcctggctaacatggtgaaaccccgtctctactaaaaatacaaaaattagccgggtgtgttggcgcatgcctgtaataccagctgctcgggaggctgaggcaggagagttgcttgaacccgagaggcagaggttgtggtgagccgagatcactccagcctgggcaacaagagcgaaactccatctca

SEQ ID NO: 679075 - DNA, 108 bp, Homo sapiens
gggatgtacaaacatcccaaaggcagctggaacatggacttaggaggtaggcatcagaggaggagcaagtacgggagggaagtgaaataaccagccacaggtaaagtt

SEQ ID NO: 679076 - DNA, 187 bp, Homo sapiens
ttagtcataagggatgggacaaaagaaggcccatgttggcatagagtgacaacgaagagaaaaagggaagggagggaactcaatatgaacgaggtgagctgagttgaagatgtagaaatgagtttgacaaaaggcacgcttatttattatctcggttatattagtttggactgtttgtcccatccaa

SEQ ID NO: 679077 - DNA, 187 bp, Homo sapiens
ctcggtaccattatttaccctcatatgtagtcaggcaagcctgttgctaatggtcaaaaatcttacaattgcttagtgagaacttttggttcaagtcatgttcttcagtgagagagaaaaaaataataataatcaggacttgagttacattatttaagagaccaggttctggactgggtttaaatcc

SEQ ID NO: 679078 - DNA, 609 bp, Homo sapiens
  misc_feature (4)..(4): n is a, c, g, or t
  misc_feature (10)..(10): n is a, c, g, or t
  misc_feature (61)..(61): n is a, c, g, or t
  misc_feature (85)..(85): n is a, c, g, or t
  misc_feature (125)..(125): n is a, c, g, or t
  misc_feature (136)..(136): n is a, c, g, or t
  misc_feature (155)..(155): n is a, c, g, or t
  misc_feature (299)..(299): n is a, c, g, or t
taanaagcanaggctcaggctgagcccaggtttattatccaaaatcaaaatgaaatgcagngattaaaggacacaaggcctcagngtgcatcattctcattgtggctttcaggcggctgtggaanacagggtgggnatggtggcttcgggaggtnaggtgctcgtgggactggggcaagtcttaggcaagccattccgtgctattctgggccgtggctcccagtgggccattagaaaatgtgaacaagtgcttgtggtggacgtgctgaggacgggtgcaagggttgaggttctcccangttcaccggaatcagtggccagcacccaggggcatcagctatcgtgcttaagtgggggggctctgcaggttgggaagtcctgaggccttcagaaagtgacctcagtgggcctccgtggaaggaggtcctcccccatgtggttgcctccagcgcgcgtgccgaccagtgtggccagtttgggttcggccttcgaaaacttggcagccagcacccacgggatgcactcagcctccggtgagtggcctacgaggctcagcataaggaaatgtgaggcaccagtaaggaaggcctagatctggaggaacttttc

SEQ ID NO: 679079 - DNA, 351 bp, Homo sapiens
  misc_feature (4)..(4): n is a, c, g, or t
  misc_feature (10)..(10): n is a, c, g, or t
  misc_feature (61)..(61): n is a, c, g, or t
  misc_feature (85)..(85): n is a, c, g, or t
  misc_feature (125)..(125): n is a, c, g, or t
  misc_feature (136)..(136): n is a, c, g, or t
  misc_feature (155)..(155): n is a, c, g, or t
taanaagcanaggctcaggctgagcccaggtttattatccaaaatcaaaatgaaatgcagngattaaaggacacaaggcctcagngtgcatcattctcattgtggctttcaggcggctgtggaanacagggtgggnatggtggcttcgggaggtnaggtgctctatgacttgtactaggattactcatgccattccttgttaactggtgcctggatcccatgtgctgttataaccatacatgctttgtggactgctaaggaccctgcaagggttaggtttcctagctaaccgaataatgggcatgacccaaggcatttgcttctgctctatggtgggatctgcctgcggaa

SEQ ID NO: 679080 - DNA, 783 bp, Homo sapiens
  misc_feature (16)..(16): n is a, c, g, or t
  misc_feature (70)..(70): n is a, c, g, or t
  misc_feature (96)..(99): n is a, c, g, or t
  misc_feature (160)..(160): n is a, c, g, or t
  misc_feature (291)..(291): n is a, c, g, or t
  misc_feature (297)..(297): n is a, c, g, or t
  misc_feature (323)..(323): n is a, c, g, or t
  misc_feature (329)..(329): n is a, c, g, or t
  misc_feature (356)..(356): n is a, c, g, or t
  misc_feature (362)..(362): n is a, c, g, or t
  misc_feature (387)..(387): n is a, c, g, or t
  misc_feature (412)..(412): n is a, c, g, or t
  misc_feature (417)..(417): n is a, c, g, or t
  misc_feature (423)..(423): n is a, c, g, or t
  misc_feature (478)..(478): n is a, c, g, or t
  misc_feature (708)..(708): n is a, c, g, or t
  misc_feature (769)..(769): n is a, c, g, or t
ttatgaaaaaatttgngtcatttccctctagaccatttcatttcaaacttatactttgtttagtctagcnagttgtccaaaaagaaagaaaatatnnnntaaaagatactcggccagatgagatagagagagaatgctaacacaaggttcaatgtatgcngttctcggttgctctgttccatatgcccacacagtgtcatgacgtattggtgtacccctaaacagaacgccagatcagtccattcttactaggctgaagaaaattctctatcagagcatcattgagtttcnggggtncttcctccagtaaagcagtgtgactntggggnggggggggggagatctctgcataatantttatntttgggtctgttccgcttgtgcganggttagcaacacagtccattttganaagtnaatgtnatcatttggttgtttttactcacaggcagcactgatttcttattaggctggctantgtcatatccagtggtaatgtcccgtacatgcaatatagcaaatgttccacaaaattttggatattcttttggagaatcataattacgaagcctttcaaatatacttttgatggtaggtggttcataacacaagaaataggaagtttttgaaatatgataaccatatttttcataaaccttaaccagttgctgtttcaatgttatattcatggtttccaggtaagatgcnatctcagcaaccacaacagctgcactcaccccatctttatcaaaactgaagttcacagagnaaccaatagactct

SEQ ID NO: 679081 - DNA, 412 bp, Homo sapiens
  misc_feature (166)..(166): n is a, c, g, or t
  misc_feature (168)..(168): n is a, c, g, or t
  misc_feature (170)..(170): n is a, c, g, or t
  misc_feature (172)..(172): n is a, c, g, or t
ttaaacctaaaggcgatgacaaggatccttccaagaacaattcatgccaaagttcctgggcgtattggtttgtccccatcgtgggcgctattcttataggtttcttgtatcgtcacttctgggctgacagcaaatcctcctgaggagacctcgttgaagtgcggcntngncntcctgcgatgagaggaggagacttgtgtggaggctgcagggtgttccctccttggaacctgccagttgttttctttccccttggagccaagatggttgaccaagatatctatcctccttcaagtgtacgaccagagtctttcatccgccagagcctgacgcccaaagcacctgctcactctgtgtccttgccagggtttctctcattggttcccactccttcctttcatttcaaaagttg

SEQ ID NO: 679082 - DNA, 462 bp, Homo sapiens
gttatgtctcgatgattctcttgtctacttcagtcactatgtaaactattccacaccctctacggccaaaccgtccaccgtcgaccgattctgtggattaatctcccctgattgggttcgtaggtcatacttttttccttttttaaacctgctgcacatcaatgcctctcgccagcgggtcagtgcctaatcaaaactctgctagagcctgaacgatagtccctcataatcacgtctcgttccttttggtcgcaatatctccgtgcagtggcggatacagtgaaatctcgagcatgcatcttctcggtgagccagtccaccttcctccgggtgttgatgaagatgactgcctgggtaatggtcagggtttcatacaagtcacatagtgtgtccagcttccactcctctcgttccacgttgatgtagaactggcggataccctccagggtcaactcttccttc

SEQ ID NO: 679083 - DNA, 121 bp, Homo sapiens
ataaagggcatttgaaaggtgtagtaatgacaatgctattgccatattccacaacatcccccttgttctgtgtatattgctcagtgttcattcatattctgtacaacttattcttgtatat

SEQ ID NO: 679084 - DNA, 798 bp, Homo sapiens
gtgatctggatactccatctatatttaattcatgattgacgatgactaactgtttatctagtgtttaatcagcctctctgtggatatatgctataatttgaaatagcagatttacattataatataatcattggaaagcataacaactatgtgttaataataaatagatattacagagcagtcaacagctcaacaatccaatcggtctatggccctatcaggcaatcatcatgaatcttgccagttccagtgctatttatcacaggagcaaggcaaaggcattccactcaccaagcagcacaggttctcttcattgacaatctccaagcacaaggccatgcagcatttatcatctattatttagcattcaaccaccagcagcgcacttcataacaacaatagggataaaccattagcacggtcaagatagtcacacgtcctcaggtgcagtaagtcggagaaatagtagacagcaacatgcatcaatattagagggcccatgttacatcaaaagtcctagcggattaagcctaagaactgcacaccattgtgcggtttgacacaggggtctggtcactctcatagccaccaggcaccataccaaacggggaatttgtagatccaatagtccaaccaagacctgggacatcactttggccaaaccaaatgggtttagaaagcggggaggcaacttcaattgcaaggccaggagtggatcaccaaggacagttgaaccagttggccaacgatggaagggcacaattcggccaacattaaacatttcgggacatagcaaaa

SEQ ID NO: 679085 - DNA, 446 bp, Homo sapiens
  misc_feature (48)..(49): n is a, c, g, or t
  misc_feature (60)..(60): n is a, c, g, or t
  misc_feature (98)..(98): n is a, c, g, or t
  misc_feature (103)..(103): n is a, c, g, or t
  misc_feature (149)..(149): n is a, c, g, or t
cgcttgggtggtgcacagatggatactcactggtacactcagtcatanngccagtgcccntgcctttcttaggaagtcagctccggtgtctgtgtccnagatncccagcctccacctcagtcaggagacactgctgcctttacctgganaagtctgcggccatcttcgctgctcaccacagagccgcacagaaatgccggctgctttgctaacctgcggtgttgttctcacaaatgctgccagcgaagtgggtccccagagcgcccgcagctaagatgaggtcctgctctgtgcagtggcctccgaccaggccccgctcacaagaggggcttctgtgctccttcgggccttcctgagaaggctgcgtccagagccctcccactgaccccaggcgcacacccagaacctgacccgcacccagaaccaggcgcacacccagaccgtgt

SEQ ID NO: 679086 - DNA, 171 bp, Homo sapiens
gtgaggatccccctagtcagaagtttcaatagcataaagttgcctagctgcagagaccttatttctatatcttctttttttagtagaaaagttttacaaaattggtaggaaaatacaataatttttgtatttttggtagagatggggtttctccggtgtgggctcgggtac

SEQ ID NO: 679087 - DNA, 220 bp, Homo sapiens
  misc_feature (156)..(156): n is a, c, g, or t
tcatatctatcccatcgaacgctcagtaggcagcacttgggccagagcttagaccaagtgcatccatttttgggttctccaatagccacctaccgaatcgtcgaatcaaaaggttagtagcgcccctacttgtaatatgtatgttggtctagaatngccttcaccatatctaggagtcgaacgtctaatgtacccacaacgtgcttgctatagacatagg

SEQ ID NO: 679088 - DNA, 206 bp, Homo sapiens
  misc_feature (18)..(18): n is a, c, g, or t
  misc_feature (21)..(21): n is a, c, g, or t
  misc_feature (72)..(72): n is a, c, g, or t
  misc_feature (104)..(104): n is a, c, g, or t
  misc_feature (140)..(140): n is a, c, g, or t
  misc_feature (188)..(188): n is a, c, g, or t
aaattcagaactggatgncanggagagttcaatattagagataaattcagagagtcgcttccagatgtgttngtgttaacgacatggaatatatgtagttcccngaaactgggcctggagactcaaaaaagacccctcantccttggtttgtgggtagctaagggaagagctataaaatgctggactnggggatgggggttccagc

SEQ ID NO: 679089 - DNA, 493 bp, Homo sapiens
tggagggcactaacgcaaagtaagactcgcgtcgtgtgacgagctgtagcatagccacagtctaacttcacatgttcattaaacaggcaaattgaccgctaaaacttcgaaaaaacaagtcatacataaaaaaaagtcttaccccaaaattgcaaacaaatacattaaaagataagaagaggtgatagaaagcaccagacattaaacaaaatacaaataataaaataaattcaactcacaaggtccccatacagcaaatactatagtaaaagtatggactgtatgtacatagtgctaactcacaggacttataagcagaaaatcgctcggttcttatatctaaggcttgaatttgtaaagtgaaggcataaaagttaccaaacattaagtcactcttaaaatggcacacaggttttcaagctatagggtaaacccttcctacactctctgacattttacccatggccctttgtagatcaactatttcacacgt

SEQ ID NO: 679090 - DNA, 282 bp, Homo sapiens
tccaataactgcagccaacggaagcaagtttaccctatcggataacagcgcaatcctattctagagtccatattcaacacatagggttgacgacctcgatgttggatcaggacatcccgactgtgcagccgctattaaaggttcgtttgttcaacgattaaagtcctacgtgatctgagttcagaccggagttactccaggtcggtttctatctacttcatacttcctccccgtacgaaaggacgtctactgtacaggacacgaatggtacacgaatgttca

SEQ ID NO: 679091 - DNA, 126 bp, Homo sapiens
aggaaccaggagtacaggaggaacatgaaagtggacaaggagcatgaccactgaagcacagcaccacgggggaggggtttaggcctccagatgactgcagtcacaccagactcctcatggtgtggg

SEQ ID NO: 679092 - DNA, 475 bp, Homo sapiens
  misc_feature (49)..(49): n is a, c, g, or t
  misc_feature (66)..(66): n is a, c, g, or t
  misc_feature (96)..(96): n is a, c, g, or t
  misc_feature (116)..(116): n is a, c, g, or t
  misc_feature (121)..(121): n is a, c, g, or t
  misc_feature (125)..(125): n is a, c, g, or t
  misc_feature (158)..(158): n is a, c, g, or t
  misc_feature (182)..(182): n is a, c, g, or t
  misc_feature (212)..(212): n is a, c, g, or t
  misc_feature (220)..(220): n is a, c, g, or t
  misc_feature (231)..(231): n is a, c, g, or t
  misc_feature (234)..(234): n is a, c, g, or t
  misc_feature (239)..(239): n is a, c, g, or t
  misc_feature (244)..(244): n is a, c, g, or t
  misc_feature (256)..(256): n is a, c, g, or t
  misc_feature (292)..(292): n is a, c, g, or t
  misc_feature (328)..(328): n is a, c, g, or t
  misc_feature (330)..(330): n is a, c, g, or t
  misc_feature (339)..(339): n is a, c, g, or t
  misc_feature (341)..(341): n is a, c, g, or t
  misc_feature (375)..(375): n is a, c, g, or t
  misc_feature (380)..(380): n is a, c, g, or t
  misc_feature (400)..(400): n is a, c, g, or t
  misc_feature (407)..(407): n is a, c, g, or t
  misc_feature (412)..(412): n is a, c, g, or t
  misc_feature (426)..(426): n is a, c, g, or t
tcttgagaatagttttaaagttttttccttttgtaacattcaaaagtanaaacatatatataattncatcaaggattttctgtatgattaacattntgtacaagttaaacatgacnacatntatnttggaaagagagcactgagaagcaacagcaggngaatgcatcacctgtgcctgtttnaggttgaacagttttgtttagttcagcagntgattgtnacaatgaccanttnttttnaaatncccagatgtttnttactggctcctcactaatcaataacacaagtgttntgttttttgtttttttttaaacaaaagtctgcgggngnctccttctntntggtccctttaccaaagctccaaatcacttatgncattntttataattttttgcactcnaaaaaantttgntaacacaggtttgnttaatttttgttactcagtgaacctactaaattttaaagttgttaaaag

SEQ ID NO: 679093 - DNA, 149 bp, Homo sapiens
  misc_feature (17)..(17): n is a, c, g, or t
catagaatgacaggcantatagcgaatggttagttctgtagagaacgtcactcggtctggggaggtcaaaagagaggaaaaaaattagaaaggtggcacataggctgaggaataagccataactaaacctaaatgcatggtcccgagga

SEQ ID NO: 679094 - DNA, 302 bp, Homo sapiens
  misc_feature (58)..(58): n is a, c, g, or t
  misc_feature (130)..(130): n is a, c, g, or t
tggcctgggctgagctgggctgggctggactgagctggactggcctgggctgggctgngcgggatgggctgaggtggctgctaatgtgggaaagaggccgtgggttgagtgtgattccacctgcagagcnctgagcccagctgtgttcttaggggttctgaggccacgcagctctgttgcaccatgattctgtcttctctcttgcccactgcctgaaggaaatttggagtgggctgggcccagagctcccctgtatagcaggccctgtcctggagggcctggcagggacatggcttagcctg

SEQ ID NO: 679095 - DNA, 850 bp, Homo sapiens
gggccaacctctgcctttggacggtttctggtaccttaccgggcacttgtgagttggggagatgcttgttgggcctcatcaggcctggtgtgactactctggccttcatgctatgcctctttggatcctaaagcaaggtggacagaactctagccttagtgtgttgcccctaaacccaggagttccagcccgacagcaacctctgtggcagccacatggccttcagctctgccccagcccagggctttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggcttgggggccccatcttgatctttgagcccattcttctgggtgtgcatttttgggaccatcactgagacgtcaaggagttttactgcctgtagcaatggaccagagcctctggcccctcacccatccatggaccagtcccagttggccgagctcctggggagctacctgggacacgttggctatgaaaatgagcctctggctcccacctgtttctcgaagagagctccagaccagcaggcctagattaatgagcacatatatctgcctctatacgtcgctagttatcggcgctggggacactcttatgagcaagattcgaggacagagaaaggcctccaatacttgcacactggccggtgaggcgcatagagacttactcatgaatagtaggactgagcagatacgcc

SEQ ID NO: 679096 - DNA, 101 bp, Homo sapiens
aatggaatcatggtctatgactttcagtagaagcattataaggtcgaaagagtatagattcaggcatctcttcttactgactatattaagtattttaggca

SEQ ID NO: 679097 - DNA, 120 bp, Homo sapiens
tcggagaccgtactcattaggacggtggacgctcctgggcgagaaatagttatgcaactggatctattttggtatgaaaaaaaaaatttttttaaagaaaactgttccttccccctttcc

SEQ ID NO: 679098 - DNA, 113 bp, Homo sapiens
gcaaggtctgtcctcaggtggcagtggttcttatagccctggagtgacctactccgcccgtcagtggttataataaagttgggcgagctttagcccctctcctccttctccgt

SEQ ID NO: 679099 - DNA, 331 bp, Homo sapiens
gggggctgggggcttggggtcaggaaacttaaaaaatacttaggacagggctgggcccaatggctcccccctgtaatcccagccttttgggaggcttaggtgggcggatcccttgtggtcaggagtttgtggctaacctggcccacatgattaaaccccttcttttctaaaaatccaaaaattaaccgggcatgggggcccgggcctgttattcccactactcgggagggttaaacaggaaaatggctttaacccgggaggtgggggtcccagttagccccaatggcccccttgccctccagcctggggggcaaagccaggctccctccca

SEQ ID NO: 679100 - DNA, 721 bp, Homo sapiens
cgcttcccccccctctcgtctggcaccatgtcgaactttctcgccagtccccgatgagaagactcatttcataaagtttggctcctgagaagtcctcgccactcaccgaaggggaccttctggagaaggtccgcgtgccttgccccgtgtttgactacgttccccccgagctccttaccctctttatctcccaccttggtgggagattgcacccctcctagcactttaccgccctgatgagtgagacctctacccctcctgatgatcactgttttatgaccgagccaccaccgtgtcctaagcacgattgcttaggcacgatatcccgaatgaagaggagaccttgagtgttgctgctgagagcacactccttgcacaatgtgggaggtgcaccacggagttccaccctataaaaaaaaatcctctgatatctgttgcctcgcctcttttagtgcacccccgtgaaaccagggcaccaccactcccacgcacctgtgtcttgcctcttcagattcttaacacgagcacgcacgggcttaaacttgttgattttggaggcctcttagtgacctggttgcgtctgtgtcaggaacttaaactttctggttcagtagtgtgttaaacataaccctggataccttactgggatacagatttttgctcagaaatggctatgaccctttttttaggctctacccataaaagccccttgaaggttcca

SEQ ID NO: 679101 - DNA, 692 bp, Homo sapiens
ttggtaattcaatcatgacttctgaacggattggtgcccagttctttggcatcatctggtcaagcgcattgacagtatctttccgcacgttggtgatctcattctcatgggcacgcagctcatgcagagtgtgggcatttgctctggcaatgcctccagctaattcttggacagataaagtcgttacagcttctctgaaggtgtcaatgctccaggactaactgtgctaatcatactgttgccaagaacatgtgcgtgaaggttcttcaggatcttatagtctccatctctgatgtcggtcaaagtgctgatctgcaggtctagcagagttgtgtcagagggaagtccatgtggcactttgtccagacgcgaatcagatcactgggctcaggatgatggcattgacagcgtaaggggcactctggctctaggtagggctcgaagtcgcggtcatcaggaacttctgggcctattgcagaagccgcatctactagcatacagtcaaataagcctgtctgatgaaacggttcagcccaggaaacttgtgcaagcagaagtagcatgatagtggccttcatgatgtatctcatgtattttctcaaccagggatccatgcaagagagttgtaaagattgaatcagatagtgggcttctcttctgggagccctggctcatccaggcaagatgctgct

SEQ ID NO: 679102 - DNA, 304 bp, Homo sapiens
atgttgtgtgagcctctttaacgatttgccaatgagccttaacctcactatactacactgtacaacacacgcaatggtattaacattttaatcttagaagaccctgacccactgaggattatgtagatgagaattgagaagccacgtagaagcaccttgaaatatgtaaaaccacaagaaagtactttataaaaggtatcctatatttgaaagtggataaatctagtaactcgaaaagtagtgatttagaagacaggattgtttaagaacattaggaattaaaggactttttctggtccttaaa

SEQ ID NO: 679103 - DNA, 1413 bp, Homo sapiens
gtcctgtgggagggtcagaggcagaatctacttacagtggtgtaattaaagttatttaaccaaaaataggtatgtgtccatctcagcattcacctttatcaagtgactgatttttttttcttttctttcctttcttgtatttgttattttttggaacacggattttccctacttgttggcccaggctggaagtgcaatggcatgatgctgcggctcaccgaaacctgccgcttcccgggtcacaagcgattctcctgcctcagatctcccaagtagctgggataacaggcagcgcgccaccacgccttggactagatttggatatctttaacgtaaaccacgggtttccacccagtgtttggtctcaggcttggatctcaaattgtcccgaccttcaagtagatctgccgtgccttcaacctcccaaaagatgcctgggatatacaggcgttgaccccatgtggggccgtggccggggacactgccattttttgtccacagtgttagacaatgtgtcaacacgagagagaatcacaggtggcacccattttgtgaaagaacccgtctcggtttgtgtttgccacgcaacgccacaacactctctgtgacaacacgccgtgaaacaacagacgggatttgccatgtgggaagctccccaggtgtataactcacgaggggcgcgggccacattttcttggagtgtgaaccagtgtttgcccaaacccgtggacggagttatgacatcctgtgaggaggttcaccaacattagaaacaccctgtggttaacgcggaaaaggcaatcttctcgctgggaaagaggttaaaccacaacacgtcgttttatggagggaaaaaacgccttataggaattatagggggtacgcgcccttttgaggagaacaagcctgtggacaacacgccgcaaagatggagtcagaattatcggggacgatggcccaggagcaattcacacggtgggtagagatcacaaacgcccacgacgaggggagggccccctatatagtgacagaggctgaccccgagactagcacccaagagcccgcagctctccgaacacaactgtgcggctccgtatagacacagcaggaaacaacccggggactttcccgatatgaaccggtgggataaaagcgtttggggagtttcttgacggggatattccacacggagaaattgatgtgcgcgagattatatttcaacgacacgagaaggtagagcacacttttggtgaaaaagtatccccccgcggaaggtggtgttgtgcaaaatttgttgggtactggcccacatggtgttagtccccttctggagttggaaaggaggtcaacactggttggccgttcttcgcccaaaaaactggttagtggatgttacaacccgcgggccccttt

SEQ ID NO: 679104 - DNA, 180 bp, Homo sapiens
cacccttgtcgtagcgggtgcgcaggttggcgatgtcctccacgctgtcgcggaactgggcgtcggactgcgccatcaccttccaggtgcggccactagcggttgccgctcgttgatataagacgaaccgaggtaggtctgcagcgtgctgaacagcgcattgagcggcaccccctgcgc

SEQ ID NO: 679105 - DNA, 288 bp, Homo sapiens
  misc_feature (97)..(97): n is a, c, g, or t
  misc_feature (147)..(147): n is a, c, g, or t
  misc_feature (153)..(153): n is a, c, g, or t
  misc_feature (251)..(251): n is a, c, g, or t
tgagcttgttgtaactgcgtggacttgtctgtctccccggtagaccatgagctccctgacagcagggactgcgtttttagctgtttctatccccagngcccagcacagagctgggcacatagcaggtgtgtcatgatgtttgttggnggaccnagcaggtgtctcatgatcatcactgaatgaatgagtaatggggctgaggcaggagaattgcttgaacccgggaggcggaggttatggtgggccgagancatgccattgcactccagcctgggcaacaagagcgaa

SEQ ID NO: 679106 - DNA, 441 bp, Homo sapiens
cgtgccaggcgacctacgacagcacatctcagtatagtttgtatccaattgggcatccagttcaccacggcctcactacggttgccccctggccagctgcctacccagctgtcacctcctacccacccctgagccagcctgacctgctccccatcccaagatccccgcagccccttggaggctcccaccggacgccatcttcccagcggaatactgatttttccaacagtgtggcgagctacgagaacgaggaaccagcctgtgaggatgcggatgaggatgaagacgaatatcacaaaccaagctacctggtggtgcttcctgacagcaccccggccactagcactgatgccccataagctcctgcactcagcacccctggcatccgagacagtcgcttctccatggagtccattgatgatcacgtgaccattctccggg

SEQ ID NO: 679107 - DNA, 148 bp, Homo sapiens
ccaggctgggtctcaaacatctgggctcaagcagtccgcctgcctcaacctctccgtgtgttggagattacaggcgtacaactacgtcttggccgtcttgatcttttagagaactagctttaggtttcattatttttattgtttctct

SEQ ID NO: 679108 - DNA, 368 bp, Homo sapiens
aatatcattctgaagggcacagctaattacaaacgttactatccgccatcccatacattgggacaaacctagttcaatgaatctgaagaggctactcagtaaacagtcccaccctcacacgattctttacctttcacttcatcttggcccttatcgagataaggggccaatctcggctcactgcaacctctgcctcccaggctcaagtgattctcctgcctcagcctcctgagtagctgggactacaggcatgcgccaccatgcccagctaattttttgtatttttagtagagatggggttttaccatgttggccaggctggtcttgaactcctgacctcgtgatcttcccaccttggccttatcgag

SEQ ID NO: 679109 - DNA, 185 bp, Homo sapiens
  misc_feature (113)..(113): n is a, c, g, or t
  misc_feature (131)..(131): n is a, c, g, or t
acacctgggctccgggttccccgactgcagagtagcacctgagcctcggccagtgtggctgaggtcaccagccaagcactgggtcttgagtgcgaggaggcctgaggcttgtngtctgtcccagtcaattngcactatgtgaaacctactgcatcttaaataaacgtcaggacagaagacccgca

SEQ ID NO: 679110 - DNA, 960 bp, Homo sapiens
ctccacgttaatttagctcgacctatcacattagcggacggcccttgtgagttgtgtggaccagggtaacctgcggctccaggtcagagatgcacctgctagtcctgcctctacaggacccaacccatcagttcctagcttgttcttgtggtgagaattgagcacactatactgtggacataaagacaaaccttgctggaactgactgggggaatgtagcatgaattggagggaaggtgttactgatgattgcaggccagggaccaacgtaggaaatggtagtgagatgtggaggttgtctggttactgggctacttgtagaccgtatgcttgatggaggtaaggcatgctcgcgaccttcgatgttaatgctaaaaacgaggctcactggcaacctgtatccccctgatgatgggcgtgcagagggtaaaacaccacgtgcgggcggcgtccggcgcacagatcgcgcggtatgatgttgtgaagaagcgattggcattagataacactatgacaagcgcataggccggctgcgcggacgtgcaacgaggtgcgcttgggggggcgaagaacgggaataggcggcggccgagggcgtcagagcccaggggccggccccccttctcgcggacctctgcgtgcttggctacggttactggatggtagctctggatgtgcatattgatatgttacttacatgaggcgcttctagattgacaataatagaacaaagccacgactatcgagatcgggaatctcagattgaagaaagtctcaagactctgtctcccattctaaatattattcacctatttaattgttatatatggacgagtattgctgaccgctgggccccgtgttagtcacgctcgagaccgacactgacttaatcaatctgtcacgcatctactcacactgtgtatatcttatagattacatcgcaatgcacattcaagatag

SEQ ID NO: 679111 - DNA, 485 bp, Homo sapiens
aaagatcacatgcttctgagggaacaggacaaagggcaaaagcagaactacttataagagtccaacaaagatcacaagggaaagggcaaaagcagagctactgataagggtctatgttcagcagggcacaaattggcttaataaacatcttaaataacagaaaacagggttcaagagcagagaactggggtgaccacaaatttaccagggcggagtttttccccaccctaaaaagcctgaggggactgcaggagaccaaggcgaatctcagtccttatttgaaccgggtaagaaagacattcccagagcgggtggttatagacctcccaaaagaatgcattcctttcccaggggtaataaaaattaaaattccctggtggggaaaagaaataacaatatctgtctaacttggacatacattaaagggctctctggcagaaaaaaaaaatgggtggttttggccaaaccccacaaggagtcagaac

SEQ ID NO: 679112 - DNA, 1303 bp, Homo sapiens
  misc_feature (359)..(359): n is a, c, g, or t
  misc_feature (485)..(486): n is a, c, g, or t
  misc_feature (502)..(502): n is a, c, g, or t
  misc_feature (526)..(526): n is a, c, g, or t
  misc_feature (548)..(549): n is a, c, g, or t
  misc_feature (556)..(556): n is a, c, g, or t
  misc_feature (598)..(598): n is a, c, g, or t
  misc_feature (647)..(647): n is a, c, g, or t
  misc_feature (659)..(659): n is a, c, g, or t
  misc_feature (709)..(709): n is a, c, g, or t
agaagtgagtgacttgttttcactggcggctcccttaggcagccgctgtatttttccactgcgtggatcacactggagattaattttggttcagccagtgcctgccaagcagaaagcgaaggccctagcccacggggaagtcagccatggcatctgtcacagactcgatgtcgctggtacatttccacggagagagatatttacaatagtaaatttctaggctttgataaaaacactgggtacgatttgttttgataggcatgaacatacttgtaatcggaaacccagctgaggaaatgagcttgccagcccagggtaagttcttagaacttagaacacagggatctttcagaccttgngagtcaagtggcagacagtgagccacaggggcaaagtcaaggacactgattctgcgtaaagaccttgaacaacaggacaggaccagaaccatagcacagggtgctcatggataaggcgaatggganntattcttttctgcttnccatagcactttgtccagaaacanagagtggggtgggcgctaaggnngccgtantcaagagcttcgcttgttcttaaacgccacatatagactggnattatggattggtaagcattacatctcttctgttttttgctgcttgcanaggaagtccaantcaggattatatcctagaacaagtcagggttaaattgctaatctcaacanaactattgaatcagagcagcaagtgccatgaaggaggaactatccaaaatggcatgtctatatgcaaaaatggcaacgtagatggccttccaatgttagcattggtcaagttggccgatgggcttttcccggtgatttctttacacggaaattggctataagggcttggaatttttcctttttttcctttttggccacggtttaaaatttcccaaaccacaggccttttaaaaccaaagaaaggccacggattgggaacacctggccaaatggggaaaccccctttttttcaaaaaccaaaatacccggcatggtgccgccacccgattccctcttttggacatcttgcccaaaagtttaaactctcgcgcatgtgttggtccggtcacaccgtatcttacctggggacaggggatatccgcaaaaaaataataatgaaaaaactggtgcgccctccaacgtttatagtggcttctcacggcctctatatccttgtcctacctaatgagggaacatgcgctgttaaacgtcgggtccgttgtcccttggtgtgccactcttcccggtgatatatacgcgcgcactccccttcct

SEQ ID NO: 679113 - DNA, 127 bp, Homo sapiens
ggtttgtgtacaggagaccagcctacacagtccatcaatacatctgcccctaatagccaggaggtattccacctcctaccgattatattaagggaaatacacttattaggtaatggtggatactata

SEQ ID NO: 679114 - DNA, 1284 bp, Homo sapiens
gatccaacatggcggtgcgaccttcgggtacaaggaggcagttagcgagaaaggagtctactagtagtgcgtagcagtctactatgtggtagcgatgtatggtatcataatattgtctggtctctcaatatgcaagaagagaaaggaagagcagggagttgggtggtttgcagaaaatgtagtgaatgagaacagaagtgaaacctagtgcataggtagtgatcacactgtattcattggaaaggctcgcaagacatactaacaaactagtgtggaccatgcaatcgccgcatggagttttgagcaacggtagatcatacttacagtgcttgaatatgaagctctttccgcggtccaatgcatcgtatctcttcgagctcatatcgtggctcatatgacacatcgtctccataggtacaggatttagtgcggaatctgagatgtgtcccacatcgtttcatgcggcatcgatttccaaccattggcatagacgtgttgcgatttcaaatacgtaatggtctcacatggaatttgcgcttaagatatatcacaaaacactatagaatcgttcgcgaaggggatttaaagtaaaatatgtatccattgggcactcctacggtgaatggagaatttgtgcgcgcttagttttcgtaaggaaatttgtgtatctttaaacatattgttgcattagcaataggtgcaaaagtggggccaaggggttaaaatttcccttggggccctacccaccaaaagtgtgtaggatactaagatccaacgttctggggaaatgtttttaccgtcaaattggcacataatttttcatggggcgagaacgcaatgcagaagcaccacaagccactttttggaagagagttgctaccatttgggtaccatctctctcctccaccttcgtacggccaatacggggcgaagtcatcggacctaccaggtctacaagaactgccttggaggtagaatgacaacatgttgtgaagacgcaaggtggttaggaattaaatttgaacgttaacttccaagccaaaagcatggtgtgtacacttccatagagaaaagccgtggcaacttgtggtgtgtggcctggtgtcacagaaaaggagccacacttgtttcacattgcaatattccgtctaatagtgaatgttgtcgcgtagcggataagattacaagctataaacagttgagggagaaaacaaaagtattcaaggggggggcagcttgtgtccctgaatgtaaattaacaagaaattggtgtgcgtaatgaca

SEQ ID NO: 679115 - DNA, 168 bp, Homo sapiens
accaattccacgcttgcccttaagccttgtgagttttgagaccgaacactcttatctgtgcacagtgacttggtcggctggaaagggaatccaggtggagctctactcattccctagagatccagaaatcgagatgagtggtggcctcgtgaattggagctctgtcac

SEQ ID NO: 679116 - DNA, 147 bp, Homo sapiens
ttattaagacaccaccaggagtctctggcccccacagaacctttagtgtgtaagtttgctgatggaggacagaagaagagacagaacccaaactagatacatccctaatggaagaccatggcactagagcaaggagcaggtgcagac

SEQ ID NO: 679117 - DNA, 181 bp, Homo sapiens
ccccttttttttttaaaaatccaaaaaaaattttttgggggggggggggggggcccttttttcccccccttttgggggggttggggggggggttttcctttccccgggggggggggtttcggttggcccagtttgtttttttgccccccccgggggggggggggggggggttcctttttta

SEQ ID NO: 679118 - DNA, 221 bp, Homo sapiens
cctttttttttttgggaaaaaaagggtttttttggaaaaccaaacggggggtttgggccttttttgggggggcctccccattttgtttttatccggggccggggttttttggttttgggtttttgggggggggggtttttttaccaattggtttttttttttgggaaaataaaggggggaatttttttttttccaaagggtctgtgggcccccccccttta

SEQ ID NO: 679119 - DNA, 123 bp, Homo sapiens
gtgaaagcacaccccttcctgccttgcttgtctataaggcctgcagacagcaattgttcaggaaagtgcaggatcgcatctggaagtctgtaggtgtccttgcaaaggacttttaactccctg

SEQ ID NO: 679120 - DNA, 391 bp, Homo sapiens
ataggcaagtcaaagcttctataccttttcttgcccccttcaagcagagtcccctccgtgctcctctccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatattacacccctatcctccctgttaaaaagtctgatggctcataccgactcgttcacaacctccgagccatcagtcaagctgtcctccctattcatccca

SEQ ID NO: 679121 - DNA, 222 bp, Homo sapiens
ggtgttgcatgtgtgtgtgtgtttgttgttgttgttttgaaacgggtctcactcttcactgaggctggagtgcagtggtatgatcacggctcactgcagccttaccctcccgggtgcaatcagtcctctcacctcagcctcctgaatagttggaactacaagtgtatgccaccatatccagctaattttttttttttttggtcattgcaacagggtctctca

SEQ ID NO: 679122 - DNA, 521 bp, Homo sapiens
ctggtaccagcaccttgccaccctagagtgctagtggacacactggaactcccacacttacttagcaataaaaaggagcaccccatcgtcaggtgtcaacagaggccaaataggaaccttgatttctacctccacctagctgtaatgaggctgcatccttcccttcctgctggagcagtatcagaaaaaccctcaactcaatatgtaaatatccaggttgcaattgaaaaatcacttgtcatattcaaaacaaggaagacctcaaactgaaagaaaaaaagactagcaatatttgccaacaccaagatgtcagagacattagaattatctgacaaagattttaaagcagccatgataaaaatccttcaatgagcaattatgaacatgcttgaaaaaaattttttggctgggcacggtggctcacacctgtactcccagcactttgggaggccaaggcaggaggaatgcttgagcccaggagttcgaagttagcctgagcaacatggcaagaccccatcctt

SEQ ID NO: 679123 - DNA, 262 bp, Homo sapiens
aactttacaacgtaccttactcacgtaacaccacttctactgttactacgacactcacggaactaacacgaactctgctgttaccactgactccacgcaccaatacttcctaaacttcttactacacacataacgactgtgaaaaacgacacacacttactacacgacgtaccttacctataaaaaataaggttaccaaaggctcagtggtcaggtgtccccccaccaaccaactggggcagaatgctagtgggcatcctca

SEQ ID NO: 679124 - DNA, 495 bp, Homo sapiens
atccactctccctactgtatcctatgtacctttctggccttatctcacatgtctcctttccttactcttctccagcaacttcttcgtatatgtcatgcttcatcccacatggagcctttgcacatgcctttctttttatctggaatgctctactccatctcctttttctgagatggagtttcactcttgctgcccaggctggagagcaatggcatgatcttggctcaccacaacctccaccaccggggtttaagcgattctcctgcctcagcctcccgagtagctgggattacaggtgcctgccaccagacgcagctaattttttttgtatttttactagagacgaggtttcacgatgttggccaggctggttttgaactcctgagctcaagtgatccacctgccttggcctcccaaagtgctaggattaaaggtgtgagccactgcaactggcacccggccaattgtggacttttaagagcactagaaaaatat

SEQ ID NO: 679125 - DNA, 492 bp, Homo sapiens
  misc_feature (419)..(419): n is a, c, g, or t
agcaacaccggaatgtcatgctccagttttcgggtgaggatgggatgcaaacggtacgccgggtcttccagtgcgccgggaatagaaaagacgtggacttcgtggcccaggctacccagggcgcgtgccagttcataacaatacagatttgcgccgccgatttccggcataaaaaagggggcgatcagaccgattttcatgggtgttgtcgtcaatattacgtgcgcagtatagcaagtttcaggccgtggaagcggggggatgccgagcgcggcttcagcgttgacacccaatgaggaaggcggcaggcccatgttcatggcctccagatcggcgcaggttccgcataccagttatggtattcggcctggttggggaattccccgcacaaatgccataaagcctcggcccagaaatcnccgagatagcgctcgtatttcaactctttccaggtccacgcacgccgctggtttgcgcgaattgcgcggccgc

SEQ ID NO: 679126 - DNA, 443 bp, Homo sapiens
cagtggtttgatgtggtgatgctggcacgggaatttctgccatgcgtggcaccatttcccgtgaacacccgtgggaggtcatgcctgatctgtacttctacagagatcctgaagagattaaaaaagaagagcagcctcctgctgagaaggcagtaaccaaggattaatttcggggtgaatggactctcccgctcctgagttcactgctacccagcctgaggttgcagactgttctgaaggtaaacaggtcccctctgtgcttattaagcaattccctactgaagacgggagcgctcaccctcccacggaagattgttctgcacctcccactgctcagcccactgaatgggtgggaccaaccactgactggtcttaagcttttcttgcataggctcttaaccagcatggaaaattggttgatggaaaataaacatctgtttcta

SEQ ID NO: 679127 - DNA, 857 bp, Homo sapiens
  misc_feature (405)..(405): n is a, c, g, or t
gtcgtgaaaactacgcctaataggcgataatgggaaagggagatgactgctgtatcaacgactgtcggcatggggacgcgtagattcgggcatagtcgaccacgacgggccatctggatctataaatgcggggcatcgacagaagaaccattggaaaattcgagaaggaggctgctgagagtggtcaaagggcgtccattctaagtatgccatggtgtctaggataaatctgagagctgagcgatgaaccagtggtatcacctattagatatctcctttggtggaaaattggagaaccagctaaggtactcaatgtgacatatctattgatgccccagtgacacagaacgacttttatcataaagacatagattgacatgggagcatcctcaggtctgaactgtngctgttcctgaatagtcagctgtctggtggtgtgcgtgacatttgtaatgctgggtatctctcaagagatgggtcgagaccgcgtagaggcatgatcctgtagtggacttactacagtggggtgtgaaaaaaaactaactttgtgcggtgttaaccaatagtggattccatgtaggccaaccctagatgtctagaaggagatggtggagggggaaaatgtggttaatggaagtgcagtccctgtggcatttccacgaaaactgtgggttacaaactccgcagaatggatggggggcattgtgtggccaaatgttcgtggtgtgggaatggttgtccaaatgtggttggagcacagatgtgttataaatggccttgtgggtccaagggactgggagatgtccactcggtaggggatggacatgccaagggggaccaagacggtgagggaccgg

SEQ ID NO: 679128 - DNA, 504 bp, Homo sapiens
gtaaagtcaatgcacaagtaaaagatgaatgagcacttgtatgggagtacactggcctgggttgaattcagactccctcactaactagctagagtaccttgggcatttctgtataactaagccccagcttcctcatctgtaaacagaaataacagtgaacttataagttgatgcaaagattaaatcagatgaaatacagactgcaaaaggtataatgcctccatgtactttacgttaggtaactgaaaagattagggtaacctccccaaatgccaccttccaaatctgcaaaatgaggataattataccaatgtaataggactgttgtgaggactatgaagatcatgcacagaaagcataaccatgactggcatacgatggtacatatttgcttcttagaaatgagtattggccgggcgcggtggctcacatctgcgatcccagcactttggaaggccgaggcaggtagatcatccttagggcaggagttcgagtccagccttg

SEQ ID NO: 679129 - DNA, 718 bp, Homo sapiens
  misc_feature (28)..(28): n is a, c, g, or t
  misc_feature (113)..(113): n is a, c, g, or t
  misc_feature (207)..(207): n is a, c, g, or t
  misc_feature (490)..(490): n is a, c, g, or t
  misc_feature (494)..(494): n is a, c, g, or t
  misc_feature (512)..(512): n is a, c, g, or t
  misc_feature (522)..(522): n is a, c, g, or t
  misc_feature (528)..(528): n is a, c, g, or t
  misc_feature (533)..(534): n is a, c, g, or t
  misc_feature (579)..(579): n is a, c, g, or t
  misc_feature (587)..(587): n is a, c, g, or t
  misc_feature (661)..(661): n is a, c, g, or t
  misc_feature (717)..(718): n is a, c, g, or t
gtgagcagcgccaagcggagcctgcggngagagctgaagcagcgtctgcgggcgatgagtgccgaggagcggctacgccagtcccgcgtactgagccagaaggtgattgcccncagtgagtatcaaagtccaaaagatttccatctttctgagcatgcaagatgaattgagacagaagagtcatcaaggacattttccaacgaggcnatatctgcttcatccctcggtaccggttccagagcaatcacatggatatggtgagaatagaatcaccagaggaaatttctttacttcccaaaacatcctggaatatccctcagcctggtgagggtgatgttcgggaggaggccttgtccacagggggacttgatctcatcttcatgccaggccttgggtttgacaaacatggcaaccgactggggaggcgcaagggctactatgatgcctatctgaagcgctgtttgcagcatcaggaagtgaagccctacancctngcggttggctttcaaagnacagattttncttcangtccnnagtgatgaaacgacatgaagtagatgaagccttacgaaactcgtnacagctanatctggatactacagcccaatatcagtgttatatagagtaagcaagatgtgattttccttgcaaaatagtgaantgtcatatgtgatcagctgatttaaaatgatatgaatactatttaacatcttaccnn

SEQ ID NO: 679130 - DNA, 191 bp, Homo sapiens
taggcaggaggggctcaggataccagtgctgaaacagagcgggtccaggtggaggggaggcccgtgcagacatgagcaggaggcatagaggagacagaccatgaggcccagggagacccctcactggagactctcccgtagccttcttttcagaagtcgaaagttggttattaatcccttccaaggcttga

SEQ ID NO: 679131 - DNA, 327 bp, Homo sapiens
  misc_feature (144)..(144): n is a, c, g, or t
ggtagcactaggacaatgtatcgaaacttatgcacatattctactcagttctgttcggaactgttacctgacagactcatacagacactacagcagactcactatgctgttacctcaggcaccaacgttggactacctcctttngtgcatagtggcaggtatgaacctgaagtggttaattcagactcatctccaagtaacacagtgacttacctgcactacaggttaaccacaagccagccaagcccagcacattattcttatcccattcaagcttcaagcacaaatgccagcctgatatctacttcttctacaattgccaatatt

SEQ ID NO: 679132 - DNA, 493 bp, Homo sapiens
  misc_feature (30)..(30): n is a, c, g, or t
  misc_feature (84)..(84): n is a, c, g, or t
  misc_feature (138)..(138): n is a, c, g, or t
  misc_feature (143)..(143): n is a, c, g, or t
  misc_feature (187)..(187): n is a, c, g, or t
gcgccattccacaactcctgttatataggnttgtagtatcgctgtgagcatgacttgatctagtttccgtgatccgagcagcantatttgagtgtatgaatggatggtgatcacgtgctatatgtacgaaccaccatnttacngaatatttactactacctctgtagtttctcagagggctatggantagtttgaacgtcaatcccttgcatacttctgtgacaccctgcccttttctgtctttattaaccaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatatt

SEQ ID NO: 679133 - DNA, 432 bp, Homo sapiens
  misc_feature (193)..(193): n is a, c, g, or t
ttttttttgttatttttctgacactttctatttatggaagtgatacttactattcacgatcatggtctgcttttagaaagcactctaggtgaaaaagtgaactcattcaaagaaaacatttagtgactgtcagaatgctggtgtgtgtacaaacagcattggagacggcgctccaggtggggaagcgtgtgcngttgaaaggccaccgctgctcaagtgcaggtgctaagcagaggtcactccctccctctcctcctcacccctccctgtccccttccctccttccttccttagggttggccccagctggacttcgcaatatctgggtccccatggctcagcaggaggccgcgggaaacaatgttttcctctcgcaggcttcggtttctgccactctgctagcagcccgaggttccactcttttctctgctg

SEQ ID NO: 679134 - DNA, 302 bp, Homo sapiens
cagcgcttcccatcataaccctgatgtaggacccaagtatttggaccttctgtaccaaaaccttttgcaggtcaacttagtatatgaaatgatccaatccaacttgaagtcaattgaatataaaggcgctttacttccgtgtacattcagttttaccatcatgagatgaatgagcataactctagataaattacaagacaggatactacagttggcctgctgaggctgccccatatttagaacatgtacaaatggtggtaaggccattaattagtcttccatttgataataccgcaaaatcc

SEQ ID NO: 679135 - DNA, 683 bp, Homo sapiens
  misc_feature (682)..(683): n is a, c, g, or t
ggggaaagggaaagctcccaaagcagctgtgtcatcgtgaaggccaaattcttcagcagaagagctgaggagaagataagagtgtggggggggctggtgtcctgggtgggttgaatgccattgtggagggagtttcattaaatgtgctaaactaatttttccaaaaagaaaaaaacaagaaaaataaagaaaacaaaaatatttgtggggcggggctttgaggcctcttcggaaaaagctgttttaaaaaacacaaatttgacgagagtggggcgcgcggaggcgccccaaagaaggcgtaacagcggcgaacaccaccatgcgcgacaccacaagcgagggtggtcccaaaaaagaacaccacccgggggagccaagcaagacaagagggaggcgaaggagaactcacacaccaaataaaaaaaaaacagagggcgcgggcgggatgggaaacaacaaccggcgatacgacggcgagtatatggagaaacaacaacattactgcaagaaagatgggagagaacaaccacgggggcgacaccacaacagcagcggggggggcatcaaaaaaactaacaaagcgaggggggtgcatcaacaaagagcgagacatcgtctgagacaataaaacacagaaatattataaacgcgcccccgccgaggtcggtggtggggggcatgnn

SEQ ID NO: 679136 - DNA, 369 bp, Homo sapiens
attggcccagtagtgggttttagctttaaatgtttgccccgccatccctttccacaggatcctttttccctcctcccctgtttttgggtgtttcgagcagtttaaaaaagggcatttccagcctatgaaacaggtgggtctttggccataaaaagtaaagatttgaagacaaaaggaagaaactccggagtaagggtttttagaccccttcaggttttacacccttttgccctttttccattgcctgcaccccaccccagccactcaaatcctggttgtttttcctttggccaaaggaaggtttaccagtaaaatccttggtaggttgatgtgggccaaacattcctttaataaaccattgggtacata

SEQ ID NO: 679137 - DNA, 100 bp, Homo sapiens
agtcggtacctgcttgttgtttaacttttgggtagaggggggggtctcaccacgtttgcccaggtgggtcacaaactccggggctcaagccatcctcccg

SEQ ID NO: 679138 - DNA, 404 bp, Homo sapiens
  misc_feature (331)..(331): n is a, c, g, or t
  misc_feature (374)..(374): n is a, c, g, or t
  misc_feature (383)..(383): n is a, c, g, or t
cacctatcaagaattgttcccacttccttcaactttggtggtaggatctaggagcaatctgattgtctcaaggttgcccaaattgcccacttgttcctactcagtggctaatacattcacatcttttctaaaagactcagatctccatggtggtgtgtgcatactgttaatgaattaacagtgtttatggcctctggatgaaatcgttcttaaggaatatcctaaaaggaacttgctaactgctactgggatattttaggtaattaggagtctggggagctaggctgtaggatttggggtctcaggatccaggccactttacttaggctcntatggacagtggggtccatatttattttaaggttatggaaccntcaggcttncattattttggcagggatagg

SEQ ID NO: 679139 - DNA, 412 bp, Homo sapiens
gcagaggtcgcaatgagacgagatcacgccactgcactccagcctgggccacagagagaggctccatctcaaaaaaaaaaagaaagagagagagaaagaaagaaagaaaaagaaagaaagaaagagaaagaaaaagaaagagagaaagagaaaggaagaaagagagaaagagagaaagaagaaagaagaaagagaaaggaaagaaagaaagaaagaaagaaagaaagaaagtaagaaagaaagaaagaaagaaagggaaaaaagaagaaataaagaaaaagaaagaaagaaagagaaagaaaaagaaagagagaaagagaaaggaagaaagagagaaagagagaaagaagaaagaagaaagagaaaggaaagaaagaaagaaagaaagaaagaaagaaagaaagaaagaaag

SEQ ID NO: 679140 - DNA, 403 bp, Homo sapiens
ccgcgacgtggctccctgtgcggcagaaccatgttggacttcgcgagcttcgccgtgaccttcttgctggcgtagatgggagccgtgctctacctctatccggcttccagacaagctgcaggaattccagggattacttcaactgaagaaaaagatggtaatcttccagatattgtgaatagaggcagtttgcatgagttcctggctaatttgcatgacagatatgggcctgtggactccttctcggttggcaggcgcctcgtggatagattgggcactgttgatgtactgaagccgcatatcaatcccaatagagacatcggacccttatgaaaccatgctgaagtcattattaacggatcaatctggaggcggcagtgtgagtgaccacatgaggttgttg

SEQ ID NO: 679141 - DNA, 180 bp, Homo sapiens
agcggggtagagagagtctatagggtaatacggcctatttcaaagatttttagggagaattaattctaggacgatgggtataaaactgtggtttagctccacagatttcagagcattgaccgtagatatacccccggatcgtgataagcggtgaacagtggttaggatttagaccgtccg

SEQ ID NO: 679142 - DNA, 153 bp, Homo sapiens
atcaaggagctcaccaccagacgaggaggacagaaaacctctgcggctgcagacctggtagacaagctgcagctaaaggtcaaggcctacagcgccaggccgaggagcggaggagcaagccaacaccacctgtccagttcccagtgcagcaga

SEQ ID NO: 679143 - DNA, 861 bp, Homo sapiens
  misc_feature (43)..(43): n is a, c, g, or t
  misc_feature (76)..(76): n is a, c, g, or t
  misc_feature (95)..(96): n is a, c, g, or t
  misc_feature (114)..(115): n is a, c, g, or t
  misc_feature (119)..(119): n is a, c, g, or t
  misc_feature (137)..(137): n is a, c, g, or t
  misc_feature (140)..(140): n is a, c, g, or t
  misc_feature (142)..(143): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (175)..(175): n is a, c, g, or t
  misc_feature (178)..(178): n is a, c, g, or t
  misc_feature (187)..(187): n is a, c, g, or t
  misc_feature (203)..(203): n is a, c, g, or t
  misc_feature (206)..(207): n is a, c, g, or t
  misc_feature (219)..(220): n is a, c, g, or t
  misc_feature (224)..(224): n is a, c, g, or t
  misc_feature (226)..(226): n is a, c, g, or t
  misc_feature (228)..(229): n is a, c, g, or t
  misc_feature (232)..(232): n is a, c, g, or t
  misc_feature (241)..(241): n is a, c, g, or t
  misc_feature (249)..(249): n is a, c, g, or t
  misc_feature (252)..(252): n is a, c, g, or t
  misc_feature (258)..(258): n is a, c, g, or t
  misc_feature (260)..(260): n is a, c, g, or t
  misc_feature (262)..(264): n is a, c, g, or t
  misc_feature (273)..(273): n is a, c, g, or t
  misc_feature (460)..(460): n is a, c, g, or t
  misc_feature (500)..(500): n is a, c, g, or t
  misc_feature (543)..(543): n is a, c, g, or t
  misc_feature (560)..(560): n is a, c, g, or t
  misc_feature (706)..(708): n is a, c, g, or t
  misc_feature (710)..(710): n is a, c, g, or t
  misc_feature (744)..(744): n is a, c, g, or t
  misc_feature (752)..(752): n is a, c, g, or t
  misc_feature (777)..(777): n is a, c, g, or t
  misc_feature (787)..(787): n is a, c, g, or t
  misc_feature (811)..(811): n is a, c, g, or t
acaatacacactatgttggaggaacgactttaaaatgtaaaangagaaatgggcactgaacactccatcctcactnccaacagaccacccacacnnctcttcaactgctatccnnacanggaggaactcttgtgganganannctcaacaccaaatanttgancntatgacattnaanactaaaggnaccccagacagatgtntannaagtagggttgnnaatntnannatntcccaacanctgacgtnggnccatcngngnnntgtcagagncatattgctgaggaaagcacagcatacaccagaccccggggtaagggcgagatcaacctatctcatagccataagcaatccactcacacctgtgcattaaacaggctttttcttttcttttttttttgagatggagtcttgcactgtggcccaggctgggtacagcagtgcgatctcgggtcaatgnaacctccgtccccgggttcaagcaattctcccggctcagnctcccaaggggctgggattacaggcctctgccaccacaccagntaacttttgtatttttncgtagagatggggtttcgccatgttggcgaggctggtctcgaactcctgacctcaggtgatccacccacctcagcctcccaaagtgctaggattacaggcatgagccaccgcaaacggcctaaacaggccttgcccaggcaatgcnnntncagttagacaggttcttcaaggcctagtaatagntctctggntacaacggtgctcagcttgtctgcnaggaatgggnctcccatctggacatgtctagggnagtgttccaaaatatggccagtatggaaggaggtcttatcacatgcttct

SEQ ID NO: 679144 - DNA, 213 bp, Homo sapiens
gtgggatgtagatagaaagcacctaatttgtgcttctgaattaaccactccaggacctgctttacctcttggactttttgttatgtgagatattctttatattgttccatttgctttgggaatatgatattgttacttgtggccaaaaggaacctctcttagtagaacaaaggagagttaggttattcaaaattagtatgggacaattgatat

SEQ ID NO: 679145 - DNA, 168 bp, Homo sapiens
tgggagccaaaaatttattttttcattttttgcatttgaaatacttttcaatgacatccttggcctgaaactccttgccatagtccttaactactacacaactggaaccaaccattttacgaggtttcccctttttgtcgtttttttgcaaccgtgttaacgcggccg

SEQ ID NO: 679146 - DNA, 796 bp, Homo sapiens
  misc_feature (246)..(246): n is a, c, g, or t
agcggctgaagcaggagagttgcttgggcccggaaggtggaggttgcagtgggctgagatggcgccattgcactccagcctgggcaacaagagcgagactccatctcaaaaaaaaaaaaaaaaaccggcattattagcactatttaaaaagcctttacatttaattttaattttttctgggagaagagagtatttataaaacagctggcattatggtctggataaaggggtttatccctttagccnttctttcttacttttcttggtatagcttggtactttcatatcaaagagtaaaatccctcaaggttgggagctaaagaaatagaactcttaattaaccggacttagaaatcattacaagtggggctggggcacggggggcttacacctggtaatcccagcacttgggagaggctagaggcaggtgggatcattggagggtcaggagtgggagaccagttggaccaacttgggtgaaacccggtctctactaaaaatacaaaaaaattacccaggtgtggggtgggccatgctggtaatcccccagttactcgggaggctgaggcaggcgaatcatttggaacccgggagggcgggagttggcagtggagccgagatctcaccatgtgtgctcccagccggggcgacagagtgagactctgtctccagggccacacaacaacactctttttaaattggggccaaatgcgaatttaccctttccggggccttaattcattggtgggccctgtttcctcggaaatagttccccttcttcgagattagttaacag

SEQ ID NO: 679147 - DNA, 243 bp, Homo sapiens
ggcccctgggggggcccaaaaaactttttaccctttttttagggggaaaaaaaaacccggggggggcccctttcccccccaccaaaaggggggcccccaaaagggggcctgggttggggaccccaaattccggccccggggggcaaaaaaaaaaggggaatgccccccaagggggtgggggggcccccccccccccccccccccctttttttttaaggttggggaaaaatttttttttttcca

SEQ ID NO: 679148 - DNA, 382 bp, Homo sapiens
ctttgggtgaccaaggcaggaggatctcttgaggccaggagttgcagaccagcctgggtaacatagtgagaccttgtctctgcaacaaaatttaaaaattagccagacttggggttcccacttgcaatcccagctatttgggaggctgaggcgagaggatcacttgagcgcaggaatttaaggctgctgtgagctatgattgtgccactgcactccagcctgggtaacagtgagaggcctcatttcaacaataaaacccagcttgggccgggcgcggtgctcatgcctttaatcccagcactttgggaggccaagacgggcagatcacgaggtcaggagatagagaccatcctggttaacacggtgaaaccctgtctctaca

SEQ ID NO: 679149 - DNA, 156 bp, Homo sapiens
  misc_feature (1)..(1): n is a, c, g, or t
  misc_feature (138)..(139): n is a, c, g, or t
ngctctaggctagatctcttcttctgagtctctgcctcctcctccaagcagatgcgggctgtcatcttcagatggcttctgctcctcctcacttcccagcggtctagggagcgttttgtgccccgctaggcttggaannactgctagtgccgtact

SEQ ID NO: 679150 - DNA, 156 bp, Homo sapiens
acagactcgagtcgagctcggtaccagttcatagcacctagttttagaagtcaatagtcctagttttagacagtttcaatagcaccttatatagtatttcgtcactgaagactttattcagaaaagaaaaacctctttttaattgggatggaaact

SEQ ID NO: 679151 - DNA, 247 bp, Homo sapiens
agcacgaggcaggcttgcaaattctgggccgtaaagaatttagactcagacgcgaacgcggatctggcggattcgagggtcaaacaccagaggcacaatgttctactatcccaacgtgcttcatcgccacaccggctgctttgccaccatctggctggcggcgactcgcggcagccggttggtgaagcgcgaatacctgacggcgaatgtggtgaaaacctgcgaggaaatcctcaattacgtgctg

SEQ ID NO: 679152 - DNA, 136 bp, Homo sapiens
gccatggctcgtggtcccaagaagcattttaagcgggtggcagctccaaagcatttgattctggataaattaccggtgtgtttgctctcgtcatccaccggtcccacaagttgagagagtttctcccctcatcatt

SEQ ID NO: 679153 - DNA, 850 bp, Homo sapiens
gctgggacgactatgggttggcaaaaactgtgtaaaaatgggccctttcgtcacatggtgcgccagccacctggggggcataacccggttttgggacgtattttcccccgcagtgttcccggcgtatattatcccggccgtctatgggccggcttgatgagccctcatgcgggcgcgcgcacaacagtattgttgcgtccgccgccccgccacgtcgtgtctgtcagcgtcccccctcgcaggtgtcgtgttatggctcgcccctccccttcaatgtgtatggggggcacccccagccgcacaggtcgtttgtatccgcgtcctcgcgcttttggtggagacacaaacactcccgggcttgggcttggggccccaacaaaaaagttcatgccgcccgccccggtgttatggctagtagcaccggcggcagcacctggcgtcacgaggaggccgcactactttatcggctggaccagagtgtggtttgtttctcgccgaacccccagagtcgccgccttttctttgtagttaggcaggcctgtgagtgtcgccaccacaaaacagacatcgggttacattgggaggcctcgaaagcaaaaatctaatcaccttggagagctatgagactagaggccgtgtatcgcccctcccgccgccccgccgtctagtttccacaaggcaatatatgggcccaagggccccgggaatgagaagaagtcttccacaggggcggctagatccaatgtctgtaatttctcccacaaaaagggaaaactcgcccgccgggaaggacatcctacaataatcgcgtgcaggtttacgttcttacccccccccccccaacataaca

SEQ ID NO: 679154 - DNA, 357 bp, Homo sapiens
tattaatctactgggtaagagatagggtgaggaggaggaggagggctactggtttcttatcttccggtgtgtagtagggaggtggcggggctggctcgtgcgcattgtatgaaccgttgtgaaggagttgcctggggttgtaataaggcgctggcggctgcttcttgggccttggcttcggctgcaggagtggaggggacatcggggccgctgaccggaggttccatgggcccagggtagggcggtggtgggggctgcacgtatcccattgccccgtcccatcatggggggtcctggatagaactcaaggtgggggcggtgcgataggggtacccaggagcccggggattggggtac

SEQ ID NO: 679155 - DNA, 136 bp, Homo sapiens
atggacaactacagcgaggaccaagtgactgagaaggagtggagtgacgtaatccgatccctgtccctaagcctggctcaggacgtcctcgtgcggttggaggaggggcctcctcactgccaagaagtggcggccg

SEQ ID NO: 679156 - DNA, 427 bp, Homo sapiens
  misc_feature (128)..(128): n is a, c, g, or t
cagagaagctcttcaaccagagggtataggtcagagggatataagagccagcatccatccctgggttctcagtaggaatgctggtgctgtctaaagacctggcattaatggaggcggaggagcagctntacgggagggatggacgcacccccccccccacgaccaccccattagactcaggccccatttaattctggccttagccttattagaataagactttatacattaactaaagtggagctttaatcactataaaaagcaaaagtatctatagacacagacacttgcctatacagagacataaccacacacactcagaggatagtgaacaaatctgtctttgacttacgacccattttgcaagacttaaagccggaagaacacattttcagattgttaaataaagtctgattctgactaaaaa

SEQ ID NO: 679157 - DNA, 129 bp, Homo sapiens
atatcagtctggggatgtgcctgttaccggctatccaggatcccagagtcacccaaagcatgaccgttatcctacccctcgtggctggcagcctctcagagaccccccacccaacctgccttactttgt

SEQ ID NO: 679158 - DNA, 819 bp, Homo sapiens
tggcgtgcggtaggtggcgcgcgggatcggacgggcggttggacttgagcgggacctgtgagctgagtgcagtgaagagccggtgccatggtggagaaggaggagtgctaggctgtgcggcattagccgaggaggagtgcggcacagtcatgacctgagccagatcctgcctgtgtgaggactggatggcccagcaaactgtgctgcgcggcctctctgtggtgcttctatgtcaggcttgacaatggacttgaggtgctgaacttgccaagaatctcatcttggcaggacgtgaacggactgaccatgctggatcacgaacaggtaactccagaagatcccggagctcagttctatgattcgtactgggtctgtttggccgaaatagaggctgcaagcctcttatggagcgagctccagcaatctcaaccccaataggtaggatgtgcaagtgtggacaactgcaggatatcagcagaagacaccgagagtatcatatttaccacgtcaaattccgcatgcatgatggatgtctgaatttgactagcatcacagggatgtcaataggttcacgcttgacccagactctgtacaccacaaacatacggcctacaagatactaaacaggcagcatgataaaacatggagtcaccccaggggctacaacattgtgacccaagatctacgggagaacgccatgacagggggtccgaagggcgaagagagctagaggtagcgacgaagggtaagcccaaggacggtctaaggaactggggcccggacaacccaagaggagcaaaaaaatgagaaactacatca

SEQ ID NO: 679159 - DNA, 295 bp, Homo sapiens
ggacaagaagcataatatcacacacgtgacctgaaaaactactatggaattatttataagtggttgcatagacttagtattatagacttgtataacttttcccaaaaagttgtactcagtatgtatcaaaggctaagacaacgttgtcgtcttccttttcacatagctcacgcaaggaaacactgatagatttaatggtgagagcaaaatccttcaacaaataataagcatctccttcattcatcctgttatcctggactaatcctatcaaggaaccatgtttgtagaaatccag

SEQ ID NO: 679160 - DNA, 550 bp, Homo sapiens
tgaatattcgaggctcacacctataattcccagcacttgggaggctgaggtgggcagatcacttcaggtcaggagtataagaccagcctggccaacatggcaaaaccttgtctctactaaaagtacaaaaattagccaggcgtgatggtgcacgcttgtaatcccagctattcaggagaatcgcttgaacccgggaggcggaggttgcagtgagccgaggtcgcgccactgctctccagcctgtgcaacagagcgagacagtgtctcaaaaaaaaaaaaccaaccaatttgttaaatacagggtgttacttccgaagttaccacctagtgtgcaaggggggtccttggaagatgccacctgttgctcaccaggctgcaaatgaatttcttaccatctcaggtgtagattcagggattcaaggctagatttaactaggaaagggggagttacctattttttctttatttaatggataattcttgggtgtcccccacagagggggatttggcagggtcatgggacaataggtgggggaagtcagccgataac

SEQ ID NO: 679161 - DNA, 2141 bp, Homo sapiens
tgttgcgtctgctgtgctgccgtgttggttaggagttagtcgcggtgggcgtggtgtgtataggagagtggtggcttcgtgtagtgatgttctgtcttgttttgtcgttgcgtggttgtttcggtgggtgtggttcgctcgggttgtgtggttgtcgtggcgtagtggttgccacgaacgtgatggtcgtacggtgtgggtttctgtttggttttgctagtcacctacacggcttgaggtgtgttggggagcatcgcagttgggtggtcgtccgtctgcgtggttgttttcgcggctgtgtttggttcggtgtttgtgtttccttcgctgcgaattgtttgcactcgactcaaggtttaggggagtggatcgtttgttggtggatggttgaggatggtgatcggagagagaatggtggatgggttgttgtcatgtaggttggtggttgtcgctctttcggtgttccggattttgttggttttcttgttctgtcttttgctgcgatgagttggtcttgtgtgctcgatgtgattgactacgttagttgtgtggtctgtgtggtagtgatactctctagtgcttgtgttgaggtgtgtgtgtgtctgtcctcgcgctcgcatctgctctgctgctttgatgctgtcatgtagtgtgttttgttgtgtatatgtgctgctcgtgatctgggtcgttgggaggtgctgtgatcgtcatatcctgatttgtggttatctgtttgtctgtctggtgtgtgctcttcttttacatcttcctcatcactgaggctgttttgtctcctctatttttggtttgttgttgttttgttcttagtgacgtctttgttgtgtgtgtgtcacgggcgctcgggttctctcgcgtgcgcggcgggtctgcgttgtctggtgtgttttttccctccacacatcgccgtgtgtcggggctgcggtcgcgtgggcgttgggtagggtgtctccgcccggcctctagctggtggtttcgtcttctcaggtgtttgtgtgtgtggttgtgtgtttgtttcgggtttatgttgagttgtgggttgtagtagtgtgtagtgggttgggtaggattgacttcgagcggcacgcctcggcgcgccttcgtctgttgagtgtgtccgccttctccgtcacgtctgcttgctgcggcggcggctgcggttgttgggtatgctgaggatgagttgtggtgggcatcggctgttggggtgggcgtgctcgcccttgtttttgtgtcgtcgttctgttggtgtgtgagtagtgtgttgtgtgttctttggctgttgtgtggtagtgtccgcggtggttcgtcgtctgctcctcctctgcgttgcgttcgccgccttcttctgtgatttgtgccggcccacgcagtgggtgcgcggcgcgctcccggcgctgctgctctctctcttctgcgtgtagaggagggtgagtcgcgtcgcgcgcgctcgtctcagcacagcgcgctgtgtgtgtctccgcgcgcgtggggtcgtgttctctctgttcgtctgctctctcgctcgctccgcgcgctcgctcgcgtgcgtcgtgtctgtttgttgtgttgtgtagtatctcttctgctcttcgttgtgtgttttgtctctctctctctctctcacgcgcgcgcgacagcacagagtggtatttatataggagtgcagggcgccacggctcgatgctcgcttctctctctctctctctctcgtcgtactactgagcgtgtgtgtgtgtgtgtgactagatgatgtgttgagagagagacacctagtataataaagaagatttagtgtcgctccgccgctggtgtcggcgtggtgtgtgttgtagatagatatagatgaggtgttcgcgcgtgcgtgtgtgtagtgcgagcaaaaagggcatatcgatgcgatagttcgttgttttgtgtcactcacctcctgtgtaataaatgaacagacgcgcggtgtgtgtgtgctgttttgtttgggtgtttttgtgtgttgttctcgccgccccccctgatccgaatagagaatgatcatctatatcatatctctatgtatatatatatatatatataataataataaaaaaaaaataatataaaataaatataaataatataaa

SEQ ID NO: 679162 - DNA, 352 bp, Homo sapiens
  misc_feature (5)..(5): n is a, c, g, or t
  misc_feature (26)..(26): n is a, c, g, or t
  misc_feature (43)..(43): n is a, c, g, or t
  misc_feature (73)..(73): n is a, c, g, or t
  misc_feature (84)..(84): n is a, c, g, or t
  misc_feature (140)..(140): n is a, c, g, or t
  misc_feature (187)..(187): n is a, c, g, or t
  misc_feature (203)..(203): n is a, c, g, or t
  misc_feature (242)..(242): n is a, c, g, or t
  misc_feature (306)..(306): n is a, c, g, or t
  misc_feature (313)..(313): n is a, c, g, or t
tgtanaagaaacccaacttgcttaancccaaaaacagggtganccccttgtgaaagccggaaaacatgtccanacagtcctgcnaaccgtggatgcttctgtagctcttctttagctctcccctccctggcatgaaaccnagaccacagactacccagaagatgaactgagcactctgcaatgggcnccagcacgctgctgcnctctgagaccatcttcccggccctaacaaccctggcagnctcttctccctggtggggaaattggccttacggaaaggacatctttaggacagtcatcctaccnagtaganctgactctatgcagccctgaatactgtttccctgggagg

SEQ ID NO: 679163 - DNA, 949 bp, Homo sapiens
  misc_feature (668)..(668): n is a, c, g, or t
agagaggcgagcaccgggaaggggagcgtggggcccgctggaatgggtgaatttacaggtccattcgagatacgatgtcatttaattatgttccatcaggaatccgctgtgtggcttacaataaccagtcaaacagattgggtgttttcagcgatacagtatggctactgttgcgaaatttatagaacgttgtccatgcaagactactttcaggagaaaattttttcccagtgtcagtgacggatctcgcgtggctacagtacacggcttcgctgtctggcgtcacgaacgtgacctagctgacctcgtttaggtgtatgtggcatctaatggccgagcagttagtggacgtagtgacttctagctagggcgttagaaacattcaaggtactgctatgggagtgacctgttgggagcgacctagtgtttgggacatcagtggccgtgcgcaaaccaccagctggacgtctcagagctatgttggcattgcgtcgtgcaaggaatggacgtactgatgaaaagcatattatacaacagtatagcaccacagaacgaagagatcgcagctgttggaaaagacacaattttggatcggcccgggaagaaggtcgcagtccatgagttcctcagggcgtggacatcccgtcgtgggtacgcgcacaagttgnccgccgtgggtgtccactagtactacactgtaggtggtgttgtatgatgatcaacaagtcgaagtgcgacggccgctggtatccataaaggaactggaaattgtagagacccaggggccatgttaatactgggggtcagatagtacttacaggccgggaagtgatgcgattcgtggttgagagggaagtcagccatttcccttgatccccgaatggccacctacgtcaattaaggtggttgggcaatgctgcctggaggaaagggtagcaggaccattggc

SEQ ID NO: 679164 - DNA, 298 bp, Homo sapiens
gtcttgccaaaaagggtaacctgaatttaatcatgagaaattatcagacaaacccaaattgaaggatattatataaaataactagctggctgggcacggtgactcatgcctggggtcccagcactttggtaggctgaggctgcctagtgaatcatatgaggctgtcctcgaaccccatacctccagtgatctgcccacctggccctccaaaagtgcttgaattacaggcgtgggctgctgcgcccagccaagaatgggtgtcttgaatatatgaattccctagtttaaagcccttcag

SEQ ID NO: 679165 - DNA, 273 bp, Homo sapiens
  misc_feature (2)..(3): n is a, c, g, or t
  misc_feature (80)..(80): n is a, c, g, or t
  misc_feature (133)..(133): n is a, c, g, or t
cnnccacttttgtggctgggctggggggaggaggcaatcgattgaacatatctgtaattctaatgcaaaaattttattanccgaagttgttgtcctgtaacaatacaatttttaattagggagcattttcccnttctagtctatttcagcctagaagaaaaggtaatgagtaaaacaaattgcgttgtttaaaggattatagtgctgcattgtctgaagttagcacctcttggactgaatcgtttgtctagactacatgtattacaaagtctc

SEQ ID NO: 679166 - DNA, 338 bp, Homo sapiens
acagctgtgaggcaggagaatcgagggaaatcatgagtacctgatagaaaaaggggtctcatagaaagttttttaaaaacaggcaacatttgatatgacttcattatttagtgaagagtgatgtgtgtactgcatgcatattcaggctcaaaaaaagtctggaagaggtcaggtgtggtggcttatgcctgtaatcccagcactttgggaggccaaggtaggtggatcatctgaggtcacgagtttgagaccagcctggccaacatggtgaaaccccatccctactaaaaatacaaaaattagccgggcatggtggtgggcgcctgtagtcccagcta

SEQ ID NO: 679167 - DNA, 145 bp, Homo sapiens
  misc_feature (85)..(85): n is a, c, g, or t
tcccccttcgtgattcctaccgctgctaagtaggtgagtatgtatgtgatgcccttctcgttcatgacaagtgcaaattcttacnaccaggagaggatgggatgtttgcgaaacttcatcttcactgggcacaccgtcggcaaaa

SEQ ID NO: 679168 - DNA, 1796 bp, Homo sapiens
acctgtgttttagaaacagaggggaaatttaaataatggagtcctggttagcctttccagggcattagggcatttggggtttttattttttctcgctctttttcacatcactcagacatatcgtcagtttttcatcacacacaggtcaagtttaacaatgtttcatggtgcccattctatgttacactgggcatatctgtgcacacagcacaccagtgaggtatgttcgtcccagtgcatcaacacgtgcatctccgaggtcacagcacatttctcaggtcacatcacccaagataagctgtggcacacaggttctatcagagatatcaagtttcacatcagcactcccagaggcagacatcaccagtggccttcgaggtggagaaatcaacacgtgcacccgtttgtatactatcagctctcacacaccttatttatacgcgcaagacagaccacgatcactctgtggtaagacacacgtggtgtctatattctcttaacagagtatcacaacagcattttcaatctgtgggtcgtcctctcccagaagtgtatacaattggtggccatatacaaatcacgagtctatcacccggtgcgggtggctattcagccatttgggcaatcagggccaaacaaacctactttgctgggcaaccagtgtgtagggcgcccccaatctaaagtgcgatttggggtgtcactaagtagttattccatataaaaagggcttatggggattgtggagttatatgttgaaaagtgttgtataaaagtccaatataaaaaagaaaaaatatagttgtgtatcgcaagaggagcaatgaattgatgtatggaggaacacgctgattttagaatatttgacgctaccaaacaatcatcatcagtgtagcggaacaatattattgggggtaaaaacattatatgtaggggggagtatacattcgcccataaaccgcgatggggatctaaattcaaattcaagttaatgatactcagacacacaagaggcttatgtgagccggtctattatcacgagcacactttacaggtgggggtctgtacacaaccacggacagacaatagtatttgtccaacatagcgaccagattaacatcatccgcagtctaccattcaagactacacagcaaggtcgtactgtcacacgcggacaacacgagggttggggctatatacacacgacaaaagttaactacgcacgacggggaaacgcaccacagaccactgtctaccgatatctaacggtttagtgcggtactctgactcaacgaacactattcttgaagtctaacgcggtcacgctatagagcaacgcaccccacaatgaatcgtttgtgcggtggtgacacacaccagtattgtgggacaacggacgcgcaactatcatacacaagcgacgagaatcacacgacggactagctaataagaaggcggtatgactatctaacatctaccagcgacgccacacaactaatcgcattaccctcttatacacagtgtgcagttcttacctagtttcacagagagtggcaaccacattttggtcgagcaaacaacttcgggagcggggtagcagacgcaacgtctagctacgtcagcacctgctagcgtagccttcactaaagtaccaacgaacgcttagacagtagctcagttgtgtcgcgacagcagcctaccagtgcctctcactaacagcgcacttgtgacagcacacaaccacatgagtcgatgtaggtgcgacacaaacggacatagcagacgacgcacacgac

SEQ ID NO: 679169 - DNA, 101 bp, Homo sapiens
gtgccttccactccctggctattgattcctagaagaagggagaaggagggaggtgacctggcgagcgctctccaaggccagctggtgccactgtctgcgga

SEQ ID NO: 679170 - DNA, 343 bp, Homo sapiens
gttgatggtgtacgccgacgattacctgctggaggtgcagccatgaacaaggtgcagaacaacaaggcctggtggctggtgttgccggtgttcctgctggtggcgttcagcgcggtgatcccgatgatgaccgtggtcaactattcggtgcaggacattttcgaccagtccagccgctactttgtcggtgccgactggtataaacaggtgctgctcgacccacgcctgcatgactccttgctgcgtcagttcatctattcggcctgcgtgctgctgatcgaaatcccgccgggcatcgctatcgccctgaccatgccgaccaagggccgctggtcgtcactgg

SEQ ID NO: 679171 - DNA, 631 bp, Homo sapiens
gcatggcatgtttttttttttaattttataaacattttttaaaactgcatttagaggcaagaccctttggatcaaaaaaaaacacggcttcctaagagacaaaaatacttctaggttaactagaccagacctgacttgggactttattcctaaaacaaactgcagaacgcgagaaaaaaagggggtatttacagaagacacaaggtacataagtacttagaggtacaaattgggggccagaaaagactcaagtatatgctggcatctgagaagcaggtctaaaagagcttagttcaattttctcgaattttaagaacgcctaagatcctccttaaccccagaccttgggagccaagtaggatcttaagtgtcccatatccggattttaatactctacaacaaggggaacacttggagacatactgggggtcaccgccgagaagagggagtggcttttggaaagaagtgcaggtcccccaggggaaaaggaagcggaactgggccattcattcccaagggaacagctgtctccacttatgagacaataccagggctggaacaataaaagggcccaacgccaagagtccccctttcgaggaagagcaaccccgcccattacccaaagaaatct

SEQ ID NO: 679172 - DNA, 1321 bp, Homo sapiens
taaattacttttatttaaagtggctggaatttactcccgggccataaagttttgggttttcttcagtttcttctggggatatctttttcttctggggcaacctcctcttctgggtttagggaacaatctggtgccttttccggaaagggatcatctcaatggtgggcagggagagctcatggtatggggttaatccggaccatgagctctggtaggtcccgggggcgctattcttaaggtggtcttgggtgcccatctggggtatatatggctccaatggaccaagaagaaattctcactattctaaaacccttaaatgttccagctattaactcctcctggggtctttaaagctatgtgtggcgagcaaaaatattccgagcaactctcttttgggggccaccggactcttgtgtgtgcccagcccctattggctgggcgcctggggcacaacctggccaattcccacctatgtggtgaacggtccggctctgagaccaggcaccatgggcgggttgggggccaaagaacaagcgcgcgccttacagaaagggcgggccaaaaaggggacgccaaagaaaagaaactgggggtgtgagacccccatttctcctaagagaacacagatcgggtcactcgatgcgtgagaaacgccactcgggctaatgtgtgccaattataacgaaaatttctcggggacaacagaccgctcgtccaaccagggaccccaaggggaaacccaacaattggcgctcctgagaaggggccccaaagggggtcccggggggtctcgagaaagtggaggtccctcgggcgccggatctctcgcccacacattgcactccacagtccgagcatctctcacgacacatattcccaaccgcctggggtctcactgggacaaccttgtccccggggcgtaaaacaaacgtggcgctgggaccataaattttcccaagcgcgcatgggggattctctcatccccgggtggaccacacatctgttgttgccgcattgtggtgcccaaccaacacggggcgacgcgacacaacacggaggtggtagagccccccaggctgcgacagcgccaatcaaaccaccccacgagggggaaccactggcgacacccgcccacggacccagagggggggggagtacccaaaacaaacgccgcacaaacacaatcatcgggcgaacaccacctatagtgcccacgcgcaccacaagggggtcggcacactccgacacaaaagctagttagatcacctacccgcacacggctgccacatgcgccaccaaaagggctacgaccattcatatc

SEQ ID NO: 679173 - DNA, 672 bp, Homo sapiens
  misc_feature (26)..(26): n is a, c, g, or t
ttaatatggcaccttagtatcagtcnatatgtagcactcatgtcaagtaggatcttgctagtccgtgagtgtatcctactcgttaagccactgtactactaagtgtcatacgattactacactgtgacatcacatctcacttgagactgcacaagcagcgttcaactcatacaactgtgtcaggctcctcattggctgccactacaggtgatggatacaactcacggttgagttctagatcatccagcgtatagccatgttggacagcctggttattgaccctaagccgcaacatgttccgagcatgttggcgtcctaaagcgctagtataccagggtgtaagctactgctgctgaaccaattgtcaagtcttgtatgtactagatcaatgaatggtcatctactctgctaatagtctcgtggattatggcacgctgtatgttcagctgtacgcaggcaattggatgtcatgcaagttataacgtcagtcaccgtttaagacgacctcaataatactttgactgtaaatgatcagaccgtgttaggtaagtgttgatcatgggcgtcggtgtatggatcattcacaacagcatctcgccatattgcatagtatggaggttcagaacggacatatctcagcatcaggacgatcgtagagcatgtgcagtcaag

SEQ ID NO: 679174 - DNA, 506 bp, Homo sapiens
  misc_feature (506)..(506): n is a, c, g, or t
accccatggctgggaggggcctctgaacggaacagtgtccccacagagcgaataaagccaaggcttcttcccaaaaaaaaaaaaaaaaaaaaaaaaaaaaaaaaaaaaaaaaaaaaaaaaaaaaaaaaaccagagcttaccaaacaacaaaaaacaaaaaaaaactactgtacgcgggccgcggttctgccgcggaagcattatataaaaaaacaaatcgcttgctgggtgccagcgggagcgccacccattaagggaggacagcaagggacgcgaacacaatagtgtgtagttgagctgacaagcaccgagcaggaagacaacacagcgaggggtggcgacgcccccacaataaaaaaacacaccggaggggaagaagcgagggtagttaagaaagaagaacaagcaagcgaggagtgtccaggccagagcaaggggtgtattataaaaggcaggcgcgcagcagccaaggacgggagaaaaaaaacacacgcccgctagtgggn

SEQ ID NO: 679175 - DNA, 929 bp, Homo sapiens
tttgctgtgccgcgccgacaattgcgttgtgacctgctgtgtgattggtcgaccttatcttgcggctcatatattgcggtttttgagagccccctattttaaagtccttgtggaaaggccccccggtattgcgtgtccggccgccggctttttttaaaaactcctgcttacttttcaagggagccaccctgtggatcccgctgtgataacatgcggcacactgttcaccaaacgatgttgtgcccaatcgacgtggcgaattctcgtgggaagctcgttaagagccacacaaatgttgtgaaataaaatcatgggggcctcactatataggtgaaaagcttattgaaaaaccccggtttgaggtggccctcccccggatactatgtggccattaaacggctttttaatttacagggaggaattgtccagtgtgaggagtacaaagaaagtccgcgtttaggggtgaggaacaacaagttactctgggggaggattttgactttacccaagtgcagttgtcactgtggagatgacacccttgtaaagtcctcacaagaccacgtttctttaagacccctctggccccgacaccaccatcttggggagtactctggccaccttagaaattcgagcgacagatcttccacgcaggtcgttcacttctttggacaaccaagcgtgattgttctcaacagggggggagaacaagtttcgcggccgccctctaaactgtggagtacaaagcgaccttactccaataagtttttaaccccgcctagtctgtgtcttggaagatatagtcgcgtctcctcaaacggtcttattgatagcaaggaggaaaccatcagttgatttccgtcgcgtaacaagaaaacaattcttccctgatggagaaaaaaaatttttccttgctaaacgcaccacatgac

SEQ ID NO: 679176 - DNA, 838 bp, Homo sapiens
cacgacgagggtgatggtagcacgaagacggaggagcgaactgcctggacccagcgacctaccgcctgccggggctcagcgagagagccagagtggcggaggaggcttgagacgactcggagagccgattgaagactttccacctggacacctgaccatgtgcctgccctgagcagcgagtgccacaggcatctctgtttgttgggcatgcatgggccatggtcctggtcttgtggaccctcagtgcaagttggcagggcgtcccctctgcaagtaggagggtctagggcccttcgggcccacacagtagtcagagcctctggctggtgtgctcccagggactagccggctgagcaagtaagacaatgcgaagctaagcagccaaatgagcagctgagtgagcaagttgagtaagcatgttgagtccaaatggcatggaagcagctatgaccaagatgtgcaagtggtggactgccgtacgtcaccagacctcagatgggcagatgacacacacagccccccgagcgtctggaacaagagcggtatcatcagtgagcccctcaagcaagatgccttgctgccgctcccgcccggtctcccagctactctatctttattggcagcagatgtgttgtgtaagttgtgcaggtggcaagcattgattgggcgtgagagttcttgcctgacaaggccactgcggcatgccaagcgctgccttccctgttgggccaatgggcatgacctggctggggccatggggggtggacaaaagcaaccctaactcaaagcaccaaagtggtgcttgtggccacgcctgctgagcaaagagaaacgggca

SEQ ID NO: 679177 - DNA, 457 bp, Homo sapiens
gattgtgagaggggcctgaattctgtaaaatgtaggtgtagttataaatgattaccagccattgttccggggctcataagatttgcaatttctccagttgctcctgtaagtaacatcactattgtataatttaagattggccttttgtgatatcttttcagactttgtatttctgaagaccaggtgctccacccagccagagactcaggactcagctggtcctgtggcccctacccagaagtggaatcagtagagaggaccagtttccatacccctatgattgcatccccaaccagtcagccacacccaccctctagccacctgcccaccaaactgtctttaaaaaccctagtctctgaattttccaggagggtaaattgagtaacagcaaaactgtggtctcctgtttaaccaactttgtgtgaattaaactctttcctttgcaatttccaaaaaa

SEQ ID NO: 679178 - DNA, 385 bp, Homo sapiens
  misc_feature (54)..(54): n is a, c, g, or t
ggcacgaggacgggagtaacaggacggccatccggggctgatatggggaccctnaagccacagcacaacgcagagggagctctaccaagactttgtatttctgaagaccaggtgctccacccagccagagactcaggactcagctggtcctgtggcccctacccagaagtggaatcagtagagaggaccagtttccatacccctatgattgcatccccaaccagtcagccacacccaccctctagccacctgcccaccaaactgtctttaaaaaccctagtctctgaattttccaggagggtaaattgagtaacagcaaaactgtggtctcctgtttaaccaactttgtgtgaattaaactctttcctttgcaatttccaaaaaa

SEQ ID NO: 679179 - DNA, 325 bp, Homo sapiens
aaaaggacaaagatctgaatagacatttctcaaaagacatacaaatggccaacaggtatataaaaaatactcaacatcattaatcatcagagcaatgcaaatcaaaaccgcaatgttatcatctcacccaagttaaaatggcttttaacaaaaaggggatgacagataagtggtgaggatgtggagaaaggggaaccctcataaacactattggtagaaatgtaaattagtatagctactatggaaaactgtatggaggttatgcaaaactaaaaaatgaactattgtataatccagcaataatccactactgggtagtcacaga

SEQ ID NO: 679180 - DNA, 480 bp, Homo sapiens
gcctccccccccaacccccaaacacaacaaaaaaagcctggtgttgaccacacagtgctcccggtgtaacaccaaccgaaaccaaaaattgaatcaccaaactggaaggaactccaaatggcccaaatattgataaaaaggaagaagatttagaagacaaaaacaattcttggcgctgaacctccacatcacactggtgaatgttaccctcatgagacaaactctgccactacggacttcgcactacaccccccttaaatggccctttttctccaataactaacatatcccccgccacccccccgcgcccctacatcccaccactgccgccatctaccatcttctttctacaccgactcccacgaccgtccctccgccaccccaccgacacccaacatagcgggcgacctatagccccccccctagccccccgaccctcccccctcctcctcctcctgaccgcctccccccctgcccccc

SEQ ID NO: 679181 - DNA, 151 bp, Homo sapiens
gttctcttacatatgttagggaataggcacactttcagagagagggataggagctgatactgccttcggaatcactttggatagagtagattgatggatgctggggaatgcagtgtaatatggaggatggcctcgtacgggtgtgatttgg

SEQ ID NO: 679182 - DNA, 652 bp, Homo sapiens
  misc_feature (26)..(26): n is a, c, g, or t
  misc_feature (28)..(28): n is a, c, g, or t
  misc_feature (51)..(51): n is a, c, g, or t
  misc_feature (56)..(56): n is a, c, g, or t
  misc_feature (60)..(60): n is a, c, g, or t
  misc_feature (68)..(68): n is a, c, g, or t
  misc_feature (91)..(91): n is a, c, g, or t
  misc_feature (94)..(94): n is a, c, g, or t
  misc_feature (121)..(121): n is a, c, g, or t
  misc_feature (151)..(151): n is a, c, g, or t
ggccccccccctgggggtttttttcncntttttttttaagaaagggtgggnttttntaanccaacctnccagggccttttgaccagggtgntcncttaaaatggccagggtttcctggaanacctttaaaaaaattgcggcccatttgggngggaaaccaattttcagaactctccatgggagaagtggaatgctccatggaatatcagaacaggagtttaactgcgtagactgaactaacagaagctatttacagtttttaacagttcagtaaagtacactcctgtgaataaaatttggagtgtatttgtttctctctacttgatttcttcagagtttggaaactatttgtgagtattcttaatttatggcaaatagttatttgtgtaagtgcaataagaatctgttttcttttgtaacaggatacaattggaaaaactggttattttaccaatgctttgactggaatggcatgctttcctttaaggaatcaaacctgacttgtaaagccaataaaagccacttggggaaatgccttataccttgcctatgcagtccctgtgcagggtttctgacctgtggtaagtaaagaatgtcactttctaacaggtccaggagccccaagttatcttggaacctcaagagctcgtgc

SEQ ID NO: 679183 - DNA, 525 bp, Homo sapiens
  misc_feature (21)..(21): n is a, c, g, or t
  misc_feature (44)..(44): n is a, c, g, or t
  misc_feature (126)..(126): n is a, c, g, or t
  misc_feature (308)..(308): n is a, c, g, or t
  misc_feature (310)..(310): n is a, c, g, or t
  misc_feature (327)..(327): n is a, c, g, or t
  misc_feature (334)..(335): n is a, c, g, or t
  misc_feature (344)..(344): n is a, c, g, or t
  misc_feature (354)..(354): n is a, c, g, or t
  misc_feature (356)..(358): n is a, c, g, or t
  misc_feature (360)..(361): n is a, c, g, or t
  misc_feature (364)..(364): n is a, c, g, or t
  misc_feature (366)..(375): n is a, c, g, or t
  misc_feature (381)..(381): n is a, c, g, or t
  misc_feature (383)..(383): n is a, c, g, or t
  misc_feature (394)..(394): n is a, c, g, or t
  misc_feature (405)..(405): n is a, c, g, or t
  misc_feature (411)..(411): n is a, c, g, or t
  misc_feature (417)..(417): n is a, c, g, or t
  misc_feature (426)..(426): n is a, c, g, or t
  misc_feature (430)..(430): n is a, c, g, or t
  misc_feature (436)..(437): n is a, c, g, or t
  misc_feature (513)..(513): n is a, c, g, or t
tctatttatttataaacatgntttataccgaggagatgggaaantggacggggcagggtggactgaccggggatggggaagctcctctcgctgccccctcggggcgggcccaggccctttggaggntggggacgccagtacactcctccctgaggttgtctggccgcctctgcccctggtgctcagaatcctgcgtgcccctcaattccggaatccctcccgggaccccaggcccactgggcatgctgcccctgctactcagaatcccgaagcgccattcagttccagaatcccctcctcagctgctngngtggcggggtaactacnttccccnntccaacccngaccccccantnnntnnttncnnnnnnnnnnatccantntacactctatnacagggggagntggggntggggntgggatacngaanggcgtnnaatgcgggggccattagggctcagccgatggtgaggccaaagccacactgaaacttgttcttgcggtgattcaggnaggccccaaggg

SEQ ID NO: 679184 - DNA, 134 bp, Homo sapiens
tcgaggattagccaacaacagtcgtagagggtagagtcggcggtactgtaagttttaccagaaagttgcacatgtcccattgtggcagctgctccgggatgttgagggccttccgcacgtcctggttgttgggc

SEQ ID NO: 679185 - DNA, 437 bp, Homo sapiens
ccacctcagcctcccaagtagtggtgaccacaggcataagccaccacacccagctaattttggtattttgggtagagaagggatttggccgtgtcgcccaggctgggtcttgaactcccagattcaagcaatccaccggcctcagcctcccaaggggcgggaatgataggcatgagccaccaaacccagccgatacctttgtttggtctaaaggcctgtatcctcccttagggtaaattacagtctagggtcgggggtctcttcaagaaggagttggattcatttaatcattacctatgagggacctaacatgtgcttcgggcaacacagtagtaaccaagcaaggtatgaggtctgccttcagggatcccattttagggcgggaaaacaatagacaagtaaacaattaatcacaaattgaagtggatgctatagag

SEQ ID NO: 679186 - DNA, 251 bp, Homo sapiens
caattccacctaaatgcaaacactcacttatgaagtggcaattcagtggatcatcgcattgaacatcgcagtgcttcagctctacggatattagcaacaatgataaaacttggccttgcagaaatttacacaactagttagaacttgtcactattgtaaaggaagagtcaactggaaaattcaaggagttaataaaatttgtttacttggtcccagcttttgagagataaatcccaggaatccccggtcga

SEQ ID NO: 679187 - DNA, 664 bp, Homo sapiens
gaatcattaagtcaagtcgcatatttgtcagatccttgtcaatgctacctgtataaaaataccagcgtattcactgctatcatcaatcaggagcgtgtggtgaataagacgtacaagagtaatctcatgtctctgaatagtttagcgatgatgaagttccagcaggactccatcgttgatcctgtggactatgagtggtttggctttgataaagctggtccagctgaagaactgcaaacactgcaagaaagccccatatacaaagaggatcgtctgggtttggcagcgatggattcagcagggaagcttgtgtttctggcctctgaaggagatcatctgcagttcacccgagagtggtttaatgagaatctgctgtcctacttgctatgaaaacaaaacttgcttattcacaataaaagtttacacgtgaatgcgcgcacagtgcttttattttcttatttcagcatgttcgtaactatcgtctcatacatatgcgatgtcttgtatagaaatgaagccagtcttgcttgttttattgcactgatcttttatttgatttaatggaacaaagaaatcaggtttaccttgatatttaggttttaattttactaattacgtactctttttaggtcatttttgttaagcaatacccacacagcgcaca

SEQ ID NO: 679188 - DNA, 414 bp, Homo sapiens
tgcgctcgtacccattctctgctgactctgtgttactccttagtgaacagacaaccagagagaagagaagcccaatgacaatgtgcctgaccttggtatccaggagaacagagccttggtctaaccatctagcagtggtggctgagggccctgcaatgaaagaggcacaccagtgatgaagcaagaggaggtgtatacatgagttctggttcaacacagaggccgccaacggggatctagctatgagtctgtcctggtgaccgtgcccaaccagggcaccttgtgaggacagttggcaccatccctcactcaggcttgtcttggccctcaaggaccccatgtcagggcctttttccaaccatgtactccacttgtgctgccatcctcttgggaacagggggtcaatcccaatcc

SEQ ID NO: 679189 - DNA, 535 bp, Homo sapiens
aatataatattaatgaggataccatgggatgcatcatttgcgttacacgatatgcaacgggtcagtatacagaggtttccggccagggtgattggatgacgttctcttaaacctaaccactggctctgtgctagtctaaatcccatcagccgtacatgattccttagcttccctctatgtcccagctgtggtggtcagagggtagatgaaaagttggggcgaagggatttaacaaaagttactgtatgcgtaaagattggtgggaagattcaggtctgaaaacatagcattagaaggtgtctagagatgatctagatgaggaaatacaggagcatgtggtcattctttcattcaccagacagctatgtagcacattctgctagtggcaccgcaggatatatctgatttacaaaataggaaccacagtaataatagctgcttatgcgtatggagcatggtcatgtgctagataggcaccatcctcagccctgggcagggctgagctcctttattgcttccaatcaacagtatgagg

SEQ ID NO: 679190 - DNA, 1537 bp, Homo sapiens
  misc_feature (293)..(293): n is a, c, g, or t
  misc_feature (1365)..(1365): n is a, c, g, or t
cctctactcgtccttccttcatttccttgtcatgcatatcagtgggtgcagcgacttcatacgacagacgacgtaaggattctccggactcgtatatcatggaaccgtgggaggttgaggggctcgaagctccccagtagacatgagtcgtttgagttcctatcctaccttcctcgacactaatatcagcacccatcgattctctacaatcagagcgtagacacgctcgaaagataatttatactattcgaccagcgaaggcgaaaacccgcagtccagtagattgccgttcntaaaattcaccctaatgctcgtgctatacaaaaccgagatattcgcgtacgtacactgcgtactaagtgtatacgctcactcacatcaacaatgcactttcattcgaatcaaagtagacatctcatatcgatttccattgacaatcgaatggccatggggaatgactaggctgggattataagagcgataagcgggcacaattaaggccgccaccatatgccaatcgtcttcctgtagctcacacccagtggggagtctaacacacgcaaaagggtcagtcgcaccacattacagtgaactcagtcaccacgtgtctccttgtcgatttccttaattcctttgaatggatattgtaacaaacagatcaatcgtcaatttgctctctctaaatccgttgtagagattaccttgttccttaagccaccaaattgatttacttactttctcacctactaacaataatatgagtcggttaagaggtgtactcctcctaacctttctcaatgcacgctctttgcgttccttgccaaacgctacgttgtgacttttcgatattacttatttagagacgaagaggcctatgtgaacgcggacatgggcatagaaggtatatttaaaggaattggctatagacaacccacaaggttattgaactgtgggcttgagaaaagatctcttttgaggaggcaaatatatacgtgggtcataacgaaagtgtttaaactttcaattggagtttgaggacctttggtaagatcatatttagagggacattgttctaacttaatttcggatttgagccaatatggcctttaagaggaatttaagacgtctatttttaacctgtaaaaatatttttaaacaggcttgagttactttaaattatattgttattggcccgtttaaaagatatatactaaaggtcgtgatattttggcccttgaggtgtaagtcttacctaaaactgttttaacgacactggcacattggtcacgcaactttgacaggccgtatattttaagcttaatacgaacttgaaggcctgtggaccaatgagcatatgagctcaanaacaatttggaaatttagagcagaggccctggtagaaaattctcccgaggaccatagcctggtgccataatatccccgtaaaagagaagcgcgcatttgtgcacacctctggcgtgtgaaaaccggagggtgcagtagggccgcacacaatttttgtgtggccgccattttc

SEQ ID NO: 679191 - DNA, 513 bp, Homo sapiens
aacatgcactgctaacttaggcattttttggtagagtgggtgttggccagtgatgcccaggctagcacgtgtaatcttacacgccttatatatggcttatagatacaccttggtgtacatgtgtgtggtgttcgattaaaatttcctaattatgaggataagacctttaattcttatttctgttttttcattttttatttttagctccgactcagatttagaacggatgtttgcatgtataccacagtgctacattaaaaaccagtcatgtggatgtggagaagggtgctgatcaggactccctgttggctaacaaattctacagcagaaacaaagtattagggttggcagccaggaagcaagtgcatggggaataagcctgcagcttcttccaaatgagacagagccaaatcttttttctgagtctgtattcttcatttctattaaaccaaggtcctttttaagcagtcgaatttcatccaaagccagagtgagctacttggtaggggggaa

SEQ ID NO: 679192 - DNA, 911 bp, Homo sapiens
  misc_feature (363)..(363): n is a, c, g, or t
gaccgagccgaagaagacatggatgaggaggcccaggccgccacctgcaaccacactgtatggccctaatggcttccctggatgcagagaaggcccaaggacaaaagaaagtggaggagcttgagggagagatcactacattaaaccataagcttcaggacgctgtctgcagaggtggagtgactgagaagagaaaaccaggtcttaagcgtgagaatcgcggacaagaagtactaccccagctcccaggactccagctccgttgcggcgcccagctgctgatgtgtgctgctgggcctcagcgctctgttgcagtgagatcccaggaagctggcacatctgtggaaggtccgtcctgctcgngttttcgctgtgaacattcccttgatctcatcaagttctgagcgggtcaatggggcaacacggttagcgggagagcacggggtagccggagaagggcctctgagcaggtctggaggggccatggggcagtcctgggtgtgggacaccgtcggggtttgacccagggttgtctcccctccagagcctccctccggacaatgagtcccccctctggtctcccaccctgagatggggcatggggtgcggtgtgcgggggcatgtggctgcctgtgtatgggtcaagcgggggggtgcttcctggggtctgagtccaaaaaaattaacattccttgagggagagccccgttaaaaaaaaaaaaaaaaaaaagttgtgggcgcgggcccggaaggttcaaccatcggggggggcgaccgagaaaggaactggccacggtgcaagaaacgggcccaaggggcgtccccaaaagccgggccggtggacaccccggtcggcttcgctcagcccctccccccccgcggaaaaaccaaacacaaaaaaaacaaaagca

SEQ ID NO: 679193 - DNA, 430 bp, Homo sapiens
gacaaagacagccaagagggcggctcggtttcccagccagcagcaccccagcagacacataggtttggctgggaactggctgtgggcagacacaatcccactggagaaaaatgtgaatctggacatttgtttagctgagtggcggtgatggcaaaggaaggctccagtcctgcagccgtggcatggcgccagctctcaggaacttactgagccaccctggtctgctggatctagggagccctgagtcgagccccacctgtcaccatactctaggtttgaccaggactagaagatgacagacagcaggctactcggctgggctatatggcttgctcactggcttgctcacttcaggtagtgattttcaaattccgtcatttaatgtgtgtccaaataaactcctatgcaaacctcaatatataatacagat

SEQ ID NO: 679194 - DNA, 947 bp, Homo sapiens
gggtggatgaccttgaggccctcaggaacgagagtggcggtctctctgtgaggctgaagtgccgatcctgcggatgcccttaggaggcctgaggctctgtccgcttgcagaactccatgtggttcatgacctgtctcgatatctcagtcatttgcttcagtgacctgactctatgcccaagatgtggatgtggcagttgcacggacgagtacgacttgtctatctgagcacaccaattcatggactccacaggcaatgcatctactccacatgcgactcagcgatagggttgtccagtgtttagctcccgtgggtctgcgttcctggctgcttatcttgaatcctttgtctctgtcgatgcgactattccctggcgtgcagccctcactccttcatggtccacttggggccttgtgacagagttgttgctcgactatgttcatggggcatgccttgcagtaaacgctgccgaatgcagggcttttgtgcactgtcagctttaatcctttgctggtgttagctatgtcaactatcacgatgtgggcatctgcaaagctgttgccatgctgtggacgctctgacctttttgacttcatactttgaagaattgatgtatgcctctttgctctgtttgtcatgccattaagctcacaataaggcacagcaactaccagattagtccattggtggacagcctaattgtcttaatcccagatatcttcgaactttactctcgcggaacaggttgagaggaatatatctaaagtgggagactgagtctatatctggagagttaaggggagtggcatccaagttggtctaagactcagaggataagtaagatgaatataagcttggcttcaaggtatcatctctaaagagaatcagtggtacgataatataggtcaaagtcaattgcctggaaaaggaaaggacacgttagcaga

SEQ ID NO: 679195 - DNA, 857 bp, Homo sapiens
accatggctgattcagctgagcgagagaacagattgctgaattcaaagaagccttctccctatttgataaagatggcgatggcaccatctactaatctaaaggaacttggtaactggcagtgaggtcactgggtcagaacccatacagtaagctgaattgcgaggatatgatcaaactgaatgtggcatgcgtgatggtaatggcgaccattgacttccccggaattcttgtgacgtagtgactgtgctatacaagacatgcaacacgatacagactaggtgaagaacgaacaatcccgctggaggcaattcccgaggtctttgacaatggcatggcaaatctgggttataatcatggtgcgagcatgaacctacgtcacggtcaatgacgaagagcttagagaggaaaaacgtatgcagcactgaatgaaggtaagaatgacatgtgcactcagagacagcagatattgatggagacggacaagtcaagctatgaagaattcgtacacgatgatgactgcagaacatgaagacctagctgttcaagcgtcctattttcgccccctctagaaagaatcaaattgagttctttgacttacctcttgcgaaagacaaactggataaccacaaccaagaccagcagctccatagagggggcccgcgcagatgttcctgtgtgaggcgggcctctcttgtggtgcgcaccagtcttgttgccggcaggggccggcccccggcgcggccctattagcccaggcagcggcgctggcccacgcttccgccgtgacactgctgtggttccgactttttcctgagcacctgacttcggtggggggacacttccggcccgctgctga

SEQ ID NO: 679196 - DNA, 294 bp, Homo sapiens
gagtgtggaggactttgttcctgacgaccgtctggaccgcagcttcctggaagacacaacccccgccaggacgttgaagaaggttggggccaaggctgcccagcaggacaagtgacagtggatggggaggccctggggcggcaacccagatgggttgcaggatttccagggacgatgttggaccttcgaagacccagccactgtggtgagtcccacctcttgtctgcaggccgcacgtcccccagttcaaagacaatcacttactttcagagtcgagtgatggaagccagttag

SEQ ID NO: 679197 - DNA, 712 bp, Homo sapiens
gcggaggcaggttgctgtgtcgtgcttccttctacagaccaatatgaaaagggctaagtgaaagaaagcaagtaaacgcagtgacctgccatagagcggtataaaatccagaaaaaggttgcgagaaacatcatcgaaaattaagaaaggaggctaaagaagcagggtcacaagaagcctaggaaagacccaggagttccaaacagtgctccctttaaggaggctcttctatagggaaggctgagctaaggaaacagaggcttgaagaactaaaacagatagcagaacacttgagcaggtcagagaggaactagaaccagaaaagaaaacttgaaactaatcctgatattaagccatcaaatgtggaagctatggaaaaggagttggggcttgtggaagaattgagaacaaagccgaagtcaggagcatagacagaattcaaagaagctgtactgcaagaacttaataaaggtgattgaagcctccgatgtggtcctagaggtgttggatgccagagatcctcgttggttgcaggatgtcctcaggtagaagaggccattgtccagagtggagagaaaaaggtggtacttatattaaataaatcagatctggtaccaaaggagaatcggagaggtgggtaaattatgtgaagaaagaataggcaaagaggtgttcagaaagtcaaaaaaagcaaggataaggggaagataaa

SEQ ID NO: 679198 - DNA, 643 bp, Homo sapiens
  misc_feature (559)..(559): n is a, c, g, or t
  misc_feature (570)..(570): n is a, c, g, or t
gtcatcagatactgccagtgtgcctcttcagtgtgccagagaccctgatcgtgtcaagcagtcctagaaaaaatgctcacccgctttctcagatgaagtgcagtagggctccctggcctgcacaaagccagtgaccatttttttaaaagcccttggaaaagaaaggcatatattctgcaacacaatatttggtggacactatcatagcattttgtaagatcgtatgtaaccccaactgtggctctgaacaaaaaaatattattcagccccagaaaggcatataaatccctacaaagtacagggtgggttttgtgggttttattaagtggttaaattctcacaattttttgcctttgttcagtgcagggagacagtggtctgcaagggtggtaacaactgacttcctgagaatcttttttctttgagacagggtcttactctgtcacccaggctaaagtgcagtggtgcagtcatggctcattgtagcctccacctcctgggttcaagccagcctcccacttcagcctcccaggtagctggaactataagcacatgccancacacccagtntattttttatacgagatgagagggggtctcactgcattgccaggtggtctcaatctaggtcaaggatggcagc

SEQ ID NO: 679199 - DNA, 788 bp, Homo sapiens
  misc_feature (737)..(737): n is a, c, g, or t
  misc_feature (744)..(744): n is a, c, g, or t
aattcaagcttctaacgatgtacggggacatggggaagcagatttgggtaccacccaagtattgactcacccatcaacaaccgctatgtatttcgtacattactgccagccaccatgaatattgtacggtaccataaatacttgaccacctgtagtacataaaaacccaatccacatcaaaacccccctccccatgcttacaaggcaagtacaggcaatcaaccctcaacttatcacacatcaactggcaactccaaaggccacccctcacccactaggataccaacaaacctacccaccctttaacagtacataggtacattaaagccatttaccgtacatagcacattacagtcaaatcccttctcgtccccatggatgacccccctcagaataggggtcccttgaccaccatcctccgtgaaatcaatatcccgcacaagagtgctactctcctcgctccgggcccataacacttgggggtagctaaagtgaactgtatccgacatctggttcctacttcagggccataaagcctaaatagcccacacgttccccttaaataagacatcacgatggatcacaggtctatcaccctattaaccactcacgggagctctccatgcatttggtattttcgtctggggggtatgcacgcgatagcattgcgagacgctggagccggagcaccctatgtcgcagtatctgtcttggattcctgcctcatcctattattnatcgcanctacgttcaatattacaggtgaacctaccctgaaacgtgacttc

SEQ ID NO: 679200 - DNA, 83 bp, Homo sapiens
ggatttgctggtgcagtacaactaggcttaatagggactcgaattcgaggaggaacagctctttggacactaggaaaaaaaaa

SEQ ID NO: 679201 - DNA, 169 bp, Homo sapiens
aacgctgtaatttacactggcacatcccattactctacgctacagccactctctgcacggagtgaccacacgatatgtgtacaactatggtacgagcttgcagcatcagttataatcctcaaaccatgaaacccaccttatttcaaaaacatattggtacagaccgtcg

SEQ ID NO: 679202 - DNA, 774 bp, Homo sapiens
  misc_feature (66)..(66): n is a, c, g, or t
  misc_feature (723)..(723): n is a, c, g, or t
  misc_feature (730)..(730): n is a, c, g, or t
ggaggacgcaacctagtctcgataaccagcaaatcaccaggtcaaaagccattaaggccattccantggtaaaggatcattcagcaaaagagctaacaccatgaatattgtacggtaccataaatacttgaccacctgtagtacataaaaacccaatccacatcaaaacccccctccccatgcttacaaggcaagtacaggcaatcaaccctcaacttatcacacatcaactggcaactccaaaggccacccctcacccactaggataccaacaaacctacccaccctttaacagtacataggtacattaaagccatttaccgtacatagcacattacagtcaaatcccttctcgtccccatggatgacccccctcagaataggggtcccttgaccaccatcctccgtgaaatcaatatcccgcacaagagtgctactctcctcgctccgggcccataacacttgggggtagctaaagtgaactgtatccgacatctggttcctacttcagggccataaagcctaaatagcccacacgttccccttaaataagacatcacgatggatcacaggtctatcaccctattaaccactcacgggagctctccatgcatttggtattttcgtctggggggtatgcacgcgatagcattgcgagacgctggagccggagcaccctatgtcgcagtatctgtcttggattcctgcctcatcctattattnatcgcanctacgttcaatattacaggtgaacctaccctgaaacgtgacttc

SEQ ID NO: 679203 - DNA, 622 bp, Homo sapiens
ggctggtgtctgctgtcttccctgagccagtgtgctgagctctccgctgtcgccatctgtcagccctgctgcactggccatacctgctgtgcaactccctgtgctggcaactgctcttgctttggccttcgcccaatgccatggttggacctacagccaaggtggagtcccggtggccactttagatgcccgtggccaaagaggaacaagcgtgggcggaacccagggaacggcccaaaaggtgccacacggcaaaacggagcacaaaacacccaccatggcacagttgagccaatttggtttcccaaaccaataaaccggaccctgtagtgtgcctggtgccggacgcatggtgcgacacctcggcacaacggacccccctttgctgggtgggctcggagcccaaacaaaacaacacggctagcgtgggccccagttcgggtataacagccggggacccgcccaccagaaaggcagccaacccaaaaagagcgggccaattcactaacacgacggagggaaagaagaacgcctatacacagaggacaaaacgccacacaccccacggtgagacactgccacgaaaagcggccccagccgtctacgcctccggggctcgagg

SEQ ID NO: 679204 - DNA, 636 bp, Homo sapiens
  misc_feature (636)..(636): n is a, c, g, or t
tgaggcaaagttttgcccttgttgcccaggctggagtgcagtggcacaatcttggctcactgcaacctccgcctcttgggttcaagcgattctcctgcctcagcctccggagcagctgagattacaggcatgcaccaccatgcccggctaattttgtatttttagtggagacggggtttctccatgttggtgagactggtctcgaactcccaacgtcaggtgatccgcctgcctaggcctcccaaagtgctgggataacaggcgtgagccaccgcgtccggctggagcaagtatttgtattgtgtggtgagtgtgtcttttgtgacatgaatttgtgcactgtaggacaagtttgtgtgctgtggcacaattgtgtgcatcaaggagtgatatatgttgtaagatgtaccgttgcatgtctctgtggtggggtaaacttgtctgaaagctatagggagagtctctgtagtatgggtttagtctgtgctttgcggggtgactctacgtgctctgcaaagtgtctgtgtggtgcttggcgctgtgttctgaagtgatgggcttgggcctattgtgcttgtctggacaccaatgggggagtctgtctgttggggagaagctttttgttggcgggctttn

SEQ ID NO: 679205 - DNA, 492 bp, Homo sapiens
  misc_feature (459)..(459): n is a, c, g, or t
ggattgctgctttaaaaaactcgaagtcatctttgagagagttggctagaatttgaaggcacagaacgatgcagcatgtgctttctgtcaggattgcacaactgaacagcagaagtttgtggtagtgatgaagagcatgagtctcagagtctctcattaggaaaaactagagagccgaatgggagaaatgccaatgtttggagtgtttcagataaagctataaagtgcagacatttctctgaagtttatctgcgttcatctgaacaacccaagtctagagatcagcttgcagatctaccacagtaatttctctggcaagacttccagtgtctccctgttcctgactctttcattggatcttacaaccttggctttgttttgtcttatccctgtaataaaaggaacatgatggcacagttaaaagatatattcaatggaaacaaataccaagatttttcnccctgtagcaataaatgggaatatatctaaaaa

SEQ ID NO: 679206 - DNA, 163 bp, Homo sapiens
  misc_feature (111)..(112): n is a, c, g, or t
cggggacggggtcgggcgtgcggtgtgggcatgtccctgacctggctggggccaggatccaagagaaacaatgggggtgtggtgcatggatagaagtttgtgatggcaganngcgctggagctggttctgattctgatgaaatcgcttgtcaaggcactgcaa

SEQ ID NO: 679207 - DNA, 231 bp, Homo sapiens
  misc_feature (12)..(12): n is a, c, g, or t
  misc_feature (14)..(16): n is a, c, g, or t
  misc_feature (39)..(39): n is a, c, g, or t
  misc_feature (48)..(48): n is a, c, g, or t
  misc_feature (61)..(61): n is a, c, g, or t
  misc_feature (70)..(70): n is a, c, g, or t
  misc_feature (88)..(88): n is a, c, g, or t
  misc_feature (187)..(187): n is a, c, g, or t
  misc_feature (196)..(196): n is a, c, g, or t
attcgcgggcgngnnnacggggggctggtctcgaactcntgacctcanatgatccacccancttggcctnccaagaagcctggaaatnttagccccattccctttccttcgggaaagggggaggaactggagattgagttaataattgatcatgccaggtcaggcacagtggctcctgtctgtaatnccagcactntgggaggctgtctactctggcatgaataaagatat

SEQ ID NO: 679208 - DNA, 767 bp, Homo sapiens
ggccagcgtggaaggagctgcggggcgccgggaggaggaagtagagcccgggaccgcaggccaccaccggccgcctcagccatggacgcgtccctggagaagggagtctcgggtcttcattgcccaggcttgagtgcagtgaggcgatctcggatcccttgcaaccttccgccttcccgggattcaagtgattctccgtgcctcagcctcccgagcaagctgtgactacaggcgtggtgacaccaaacccgattaattttggtattcccaagtagagatgggggtttcaccacgttgggtcaggatgggtctcaaacgcctgaccttgtgatccttcagcctcagcctcccacggtgctgggataacaggcgtaagcacatgcaccgtggccggggacttagatttatattccctgaacgtaatacaggcccttagatggacataacacgattaatatggggggctaatggcggcagaaaacgacaaaagcatgcgtgtattatgacttgtggatgacttaatgtgctggaaaaatagtcgtgggtcccaacgtgcaaaccattaatttgtgtcattatccctgtctttggaggaatagactatcctgcgttaaattctacatggtaatataaactcaagagctatgtgaccagttgtaaatgatcccatttacactggctggtgcatacattatactggttacagaaaccacatgttttggtggtcacccctaaattaaaataaatcccattaaatgtttgtgacc

SEQ ID NO: 679209 - DNA, 403 bp, Homo sapiens
  misc_feature (403)..(403): n is a, c, g, or t
aggccgactcggtcacgaactccgatcagagatctccccgtcagctccaagtactaggactacaggcgacacatcatgctggcatacttcattacagtatcatatgaagatagtgtattacagatgtaagcttacaactgtcagatgtgcatgtgattgggggtagatgtgaagaatttgcatatttatctcctgacatataatggaaaaataggttaaataaccgtgtgatagaaaactgtatctcgtataggtctctagagtgtacagacattgcatatacttcttctcctaagatgtattggaagaatgaggttaataacactgtcatgataggtcctaagagtgcgccagtgttatagagtcagaatgagaccttaaagtaaatgaacggaaaggttcn

SEQ ID NO: 679210 - DNA, 358 bp, Homo sapiens
  misc_feature (221)..(221): n is a, c, g, or t
  misc_feature (247)..(247): n is a, c, g, or t
  misc_feature (293)..(294): n is a, c, g, or t
  misc_feature (320)..(320): n is a, c, g, or t
ggccgtgttgctaaggagtaaaaatgtcagaaactattactggtgaattgcccaacctgcgggaaaacggtggtgtggggtgaaatcagcccgtttcggccattttgctccaaacgttgtcagctgatcgacctcggagaatgggctgctgaagaaaaacgaatccccagcagtggcgatctttccgaaagcgatgactggagcgaagaaccaaagcagtnacatttgtctgatgccgcacgtaggnctgataagacgcggacagcgtcgcaatcaggcatcttgtgcaaatnncggatgcggcgtgaacgccttatccnacctacaaaaacaaaatttatcaatgatgttagaaatc

SEQ ID NO: 679211 - DNA, 878 bp, Homo sapiens
  misc_feature (62)..(62): n is a, c, g, or t
  misc_feature (109)..(109): n is a, c, g, or t
  misc_feature (122)..(122): n is a, c, g, or t
  misc_feature (277)..(278): n is a, c, g, or t
  misc_feature (280)..(281): n is a, c, g, or t
  misc_feature (855)..(855): n is a, c, g, or t
tagttagaatggttgtttatcaaattcacgggcgctcgcctggtggtaactgtctgaaagcntatgaggaacttttgtcagtaacctcaatggaaccaccgtgctggantcacccagggatngtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttatnnannctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatggacaggacaatggattttgagcaggtggtacgtcgattttggggctgcaatggtttgtctagagggcaggaggaaaaaatatatgggaggggccaaattgcattactttacaaactcaatgtactctggtttggccattagtcttcctagggattcggaccattagcccattataaaatcaataggctatcaggaacatttaacagagtatgggggtgactggaactcttctttaccataaaaggtggaaaattagaacaccactggtgttgattatttttcccctagaaaatgctggattattggcctcggcattactggttnataccagctagccttgagttact

SEQ ID NO: 679212 - DNA, 560 bp, Homo sapiens
gtttctgtttccaagtggtaattttgagcactgttgtcttgtttaaaaaaagtctatagttcccccgtcaacccatatagtcgagggaatcacaaattttaagtactagctaaccacaagactaacctcgcaaagttgtatttatgagcctgtgactttcatccaccaaagaaacctgtcttagccatcctttccctttcatagctctcactaaaaatcctctggctttattaccaggtatataatattaatgtttagtgtaggtcaaggggtgatggcctttttaaaaccaagaacccttttgaggcttagcgtcttaaagagagaaagaggcagactctttcttatttatattcctttaacctaaatgcaatcttttccttccctattatgagttgcttttctgacagagaaagggaaaggaaatcatgtctcccttgagtgccgtttttaaggcctctctttgtagtgatggattataggcagcagtgagaatgtacgggaaaaatgtgtcagcatggttctctggagatgcagtaacacgggtagaaaaaaaaagg

SEQ ID NO: 679213 - DNA, 301 bp, Homo sapiens
cgttgaatgtgtggtgttatgttcaactcaatcgattccaatgctcttttgtagtttaagccgctatcaatatctgttacaacttcatccacaatcattccttttgcgttagcgtattgccttaaaaactcgacttgattttctaaatcgtctttttggccttggtttgacactctggcgtatatgactgtcttacctacttgattttcctttggaatacccatatactctctgtactgttcttctgtataatatctccttccttttaggcataacaccacacaattccgggtaccgagct

SEQ ID NO: 679214 - DNA, 893 bp, Homo sapiens
acggccggggtccaatgcttcactcagccattttacctcacctccaaaaaaaaaaaaaaaaaaaaaaaaaaaaaacttttgggccgccgggccccaaaaattttaaaaacatcggttggggacgcggggccaacataggaacggcaccaccgtgggccacaggggttcccaaggaagcactcgggtgtacacagacaaacgggtcggggattcgccaccaaaataaacacgagacgggcggaacacagacggtcttgaacaaacactccagaagtggagtccaagagtaacatacggggactctaaaacacagagatccaacagagcagctcgcatcgatcaagtaacgccccgcgacacgagataaccagcgacagactgacgagagaggcgacaaagaagcgagcaaacagaaggaagacgaaggaggacaacgcagagatcgccgggagaggaagccaagcaggaaacaacgaaaaggaacagcgagacaaagagaggcagaccaaaggaagcagacacaggcgagcgaggaatcagaggaaagcaaagcgggagacggaaggagtgaagacgagcacaggaaagaaaagagaagacggaggaggaggacgagaagagcgagaaagctgaaaagagggcacgggacaaagccgggatgacgacacgcaagagaggaagcagaagaaagacggcaaggtagaagacaagcgagatgagcaacaggagaaagaacgaagagacggaggaaaagagagagaagggaaggcgagaacgacaaacgaagggacacagaagcagagacaagaacagaaaaaaggacagaagggacaagaaagaagagagcagagaactacgaagagaaagaaaggaagaaagaagaagagagaaga

SEQ ID NO: 679215 - DNA, 223 bp, Homo sapiens
aagctggtcattttctctatcaagacgcagtagtgttcttgcccgtgattgccttatctgtagctaggggcaaagacaataagagagctttctcggcggaggttgcagtgagctgagattgagccattgcactccagcctgggcgacaagaacaagacaccgtctcaaaaaaaaaacttttttttaatgggcagcgcatggtaccccacggcgtgtatatccc

SEQ ID NO: 679216 - DNA, 947 bp, Homo sapiens
  misc_feature (53)..(53): n is a, c, g, or t
  misc_feature (55)..(55): n is a, c, g, or t
  misc_feature (64)..(64): n is a, c, g, or t
  misc_feature (779)..(779): n is a, c, g, or t
tagggacagcagtttcctcagacgtgatgtggtgccccttgcatcctgctcananaattgtcangggggacagatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaagggtcagcagaggaagttttcaagaggggggggctcactagccagaggtcagaaaagatcgaagctagccttttcatctcagctgctccttaaatcagggcaacccctccaaattaatgggaattgaaacttgcgttgcttttcaacttaattgaatacttactatatgggaaccactggacaaaatgggggaagaacatgggggagacaaaaatgtggggcctgggttgagtgaatgacgggcaggggaccggagcttggcgttctcctggggtgaggagcgggatgcccaaggagggaatggctggggggggagggcacggaggacgggtttgggctcgtgcgcctgggggcgggccggcccgcgcggggccctggggcgggcggcggtgggggagcctgggcggtggggaggtaggcgagggcaaccgggcggggcacgggggggtccggggggaggggcggggacgggggtccggggggggggggggctcgggggcgcgggggggcgggccgggcggggagggcgtgggtggnatggcgcggggcgcggcggggggcccgggggcgccccgcggcgccgcgggcggctcgagcggggagacagtggaggcgcggggcacgcggcggcgggccgggggggcgcggccgtgcgtgccggcgcccggcggcgggcgcgccggcgtgccctgcgaggggcggggg

SEQ ID NO: 679217 - DNA, 107 bp, Homo sapiens
gggacatgatgcttctggtagctttgaatgtcataccacacctccccttggccaggcagatagaactggacaccatgggctccagagtctgatacagggtgaaccag

SEQ ID NO: 679218 - DNA, 307 bp, Homo sapiens
tatgagagctgctgaaccagtaccacaggttcggagaagttctcttctggaagaatgagagccgaagcggggaagatgtttcatcgtgcaaagcgtggggcagaaggttcttccttgaatgtggtcatcttcacttcagctcaggaatcctgcagagacgcaagaaagtgtcgttttcagacctggctctactaacagtttattttgccctctttcacggactcagatgagagcactgcacgaggaacaaaaacaagttctgaagtctccatgagtcaatactcctgcaaatcctgcaacatgttgg

SEQ ID NO: 679219 - DNA, 409 bp, Homo sapiens
  misc_feature (60)..(60): n is a, c, g, or t
tcgctggggtggttctcgccggtgcggtgcaggatttcatggtgctgtttgtttctacgngccgtgacggtcgctcgctgggtgagctggtcaaagaagagatggggccaaccgccggggtgattgcgctggtggcctgctttatgatcatggtcattatccttgcagtgctggcgatgatcgtggtgaaagcctgactcataggccgtggggaacatataccgttgcgttcaccattccgctggcgctgtttatggggatctacctgcgctatctgcgtccggggcgtattggcgaagtgtcggtcatcggtctggtattcctgattttcgccattatctctggcggctgggtggcagaaagtccgacctgggcaccgtactttgactttaccggcgtgcagttgacc

SEQ ID NO: 679220 - DNA, 572 bp, Homo sapiens
tggcaggtaaccggaacctaaaatttattatgtggaatgcttaatgcaaacttaataggggctaaagtggctaagaaaaggggcctactgaaataaataacaggaaacagaatgagtcacattgtggattgggggggctcgcaaaacacggaaaatcaggggcagatataagctacatactttattccaagttaccatctgggaagcgcaaatgggtgtcaacacggcaatgggccaaatgtaacagtgtcacggattctagtggtcttcagcctgccgacagcaacaccgggttgcttggcgccctgtgtacctccctgggagccaaggtgttaaggggcgcccatgaggccagctttgttccactctctctctgtggaaacgcctcaagggacagtgttgtgggcgctctagactttgaagcaagggggcggccccaaatagacaggccataaggtataccagggggcaacagagacggagagccttgcgcaaaagaggacgccctccaagtgggcacaggtaagggcaccctatgaggaaaaagtgatgcatccctcggtagaattcct

SEQ ID NO: 679221 - DNA, 1286 bp, Homo sapiens
aataaaaaaaaaaaaattaaatgggtagtgacgttcagagatatttatcagcttctagtaaaagtttttttattttaaaccgtgctagctacttttactttatgtaaaaattaaattgggaataactcactggagaattaaatgcatgttgagtatttataaccacgtaatattttatgggggctcttatacatggtttactaatattggtaaacccacttgtgtcctcctattccatataatggctaaaatggatcttggaccatatcttggtggggtataagagatctattaaaacaaaatggctaaagggccagggcaaccatgggtctccacgcctggtaatccccaggatctttacggaggccaagggctagggtggattgaccttgtagcctcaggagtttggaaaaccagctcgtgggccaacagtgagtgaaaccttccgatcctcttaccaagaaactcacaaacaaatttatcccaggtatgtgaatgattgtgtgacgcccgtgaatagtatcccgagacttactgtggtgaaggccataaagagatggcaaagagaagtggattgggggaccaccgcgaagggctaaaaaggattgccagtgtgaagcctgaagacatagttggccaccactgctcaataccccaaaacccgtgggcggacaacgaagaaggcacacagaaaccccgtgtcaactcaaaaaaaaaaacaacaaacacacatacacaaaaccaaaagggaggcccacgagtaaaaacagagaaggagataacaaactgcccatgggataaaccgacaggaacaaatagagggaagagtaataacaaggcagcggcgaaaaaaaacattctaagagagagatgcacagaagatatcgttaataacaaaaaacagcacgttggtagccacaaaacttgggtgtaaataaccccacgcatctcttttctacacaagagctattacccactataacaattttacaaaagacgcttataataagatggatgacccataatacccccaaagatatctaatgaagaacacaaatacgagcacgaagaaaaaattagagtgagacaccctgtgagaagatgtgaagaatgattcagcagagaccacaaaaaaaacacacccatcacgcatacacagggacggagacccacaagaagagaaagcagctgatgcaacaacacagaagcaaaacaaatgagacaaaaaacagaagagatgaagtagcgccatcagtgtgaatcaatcacaaagcgacaaactagaa

SEQ ID NO: 679222 - DNA, 427 bp, Homo sapiens
  misc_feature (46)..(46): n is a, c, g, or t
  misc_feature (61)..(61): n is a, c, g, or t
  misc_feature (128)..(128): n is a, c, g, or t
  misc_feature (181)..(181): n is a, c, g, or t
  misc_feature (241)..(241): n is a, c, g, or t
  misc_feature (301)..(301): n is a, c, g, or t
  misc_feature (336)..(336): n is a, c, g, or t
  misc_feature (416)..(416): n is a, c, g, or t
tgggcatgaccctgttcaagggttcccttctgggcctgacctctgncctgggccttgggcnccagatgcaaccttgcccttcccagctagtgtctggtggggccataagatgctgaaatgtccttctncccctgggacagtctgtacatctttgtcctcgatacaagggtgctacagactnagtcaagaaagggtagaagccctggatgatgccaagtggaaacctcaggcaagggccttnaggaagggattttaaactcctcctaccctccatcagctttctctccattcttgaaatggncaatgacttcctactgtcatgcaagcttccagggngtatgtagcttctagcatctttccatctaaccagagtgctttccctaaaacctttcaataaagaaatttcagaatagttnttgttagaaga

SEQ ID NO: 679223 - DNA, 129 bp, Homo sapiens
atggcagcaggccagtcagcacaatcagcatggcatggcatagcatggcagcaggtccagtggcacagatggcatggcatatcattggcagcaggtccagtggccccatcagcatggcatggcatagca

SEQ ID NO: 679224 - DNA, 952 bp, Homo sapiens
  misc_feature (608)..(608): n is a, c, g, or t
ccacgcgtccgaaattgttaatttccacttgccttagtttcctcatcgaaaagagaatggcatttgtgacactcctaggatcttaaatgccattctcttttcgatgaggaaactaaggcaagtggaaattaagatcctaggagtgtcacaaatattaataaaatgtgtttttttctagtgagtttgttagagaggttcacggtgtatatgtaatgttaactgtagggttcccaggttatttctagcatctgactcagttcagcaggactccatgtgatatggtgacaccttatactatacccaccgtgacactgttttcgttcattccttaaggtattcatgaatttttcaagtttatagaatgctaatatactttagaatgcaaaataatggttgagaaattttaacaggaggtggcaattattattttgtaaaaaactgagataactacatatattacacatattatatatacaaatatataataattctgtttcccagtgaaaatggaaaaatgtctatattacaactggaaaaacattgtgggtcaatctaatctaagcctgagttttcctaacagaatctaatgagtcttggttctgtattgntttcacaggttttctctatacaagagcacagatactagctgggtctgcccggtccctctcccggccctcttggttattcaggctgtggcgcaacccacgagtataatgggcccccgtgggagattggggcacccagcgggaaaaggctctcgacagcgaggaatgaggaaattgcgttcgacaacacaacgttatatgtaacatccgacaatggtgctgtgacaacaaatatgttgctcacagactttgatgtggaatagatcacgacacacaaactgcgtgactatctcacgagggtggtgtataagtgcgtccatatagcgaaggatagaaaacacaactca

SEQ ID NO: 679225 - DNA, 948 bp, Homo sapiens
  misc_feature (174)..(174): n is a, c, g, or t
  misc_feature (948)..(948): n is a, c, g, or t
tggaaggtccaaatcaataaggtctttaatggcatcatttaaattatcacaagtaggtctaaaggtggtcatctgggcatcttctttctggtacgccagggtaactctaaaatctaattcatcagcctggctagaacagtcccttttccaagaagacataagataccatccaanaaattccctggatactcctggttttaaactggtggtggcgctggctagaatcaaacgccggctagaatttggaaacaagcgctcaatggtcattcccttcaagggataaatctcatctttctgggcgcttggaagatactggaacaagcaacacccttgatcatggtcctggtacatagactacaaatatgtccagaagggtagccagtcccttctcggtgttaccccaccattggtcaaccgcggagcctctttttttccttcccaagaaaggcgtgagtctctacatggagtggtgatggagagtccctcgcgaagggtccctcgggggcccttacagagaaaaaactggtggcgtcccttacaaagtaaatggtcagaccatttcctggagaatggtccgacagtctggatggctggaagaatagtcctcacattccggttcacaaggggccgttggcagatggaccaaaataagggcagatcccgaggggcccgaaggctacaggcggaggcgtgtcccgggagagcgcacctaccaggagctgtgtgggtcaaccagaaacccaattgggacacccccgggattctcgccgccttcagcggaaagctctaacaagtgcttcaagaaaaggggtgaaagcaaaaagcagattcgggcgggggctgaaagagaggtccacaaaatcggtcaacaacggacacagagggaccacggttgggacggaacaacaccgtcccatgggaggtatacgggcatctccacactggcgn

SEQ ID NO: 679226 - DNA, 698 bp, Homo sapiens
caaaatcgtttaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaaaaattgggggccccctttgccccaagtttttttaatctcgggacttttttttttggggcccaaatttgggccctttttggcaaatccccctttaggggggggtttaaaaaaaaatggggcccgtttttaaaaacgggggcttgggaaaaacctggggtcccccaaattaaacgcttttgaaaaaaatcccttttttcacggtggggaaaaagaaaaaaggcccccccagggggcctttttcaaaagtgggcccccctttagggccaaaggaaatttggggccgttattttttttaaaaaacccgcgaaaaattttgttaaaaccccctctttttttaacccaaatggccaaaatcttgaaaacctcttttaaaacaataa

SEQ ID NO: 679227 - DNA, 317 bp, Homo sapiens
  misc_feature (55)..(55): n is a, c, g, or t
  misc_feature (71)..(71): n is a, c, g, or t
  misc_feature (82)..(82): n is a, c, g, or t
  misc_feature (131)..(131): n is a, c, g, or t
  misc_feature (155)..(155): n is a, c, g, or t
  misc_feature (169)..(169): n is a, c, g, or t
  misc_feature (181)..(181): n is a, c, g, or t
  misc_feature (188)..(188): n is a, c, g, or t
  misc_feature (191)..(191): n is a, c, g, or t
  misc_feature (194)..(194): n is a, c, g, or t
  misc_feature (206)..(206): n is a, c, g, or t
  misc_feature (212)..(212): n is a, c, g, or t
  misc_feature (220)..(220): n is a, c, g, or t
  misc_feature (230)..(232): n is a, c, g, or t
  misc_feature (239)..(240): n is a, c, g, or t
  misc_feature (245)..(247): n is a, c, g, or t
  misc_feature (272)..(272): n is a, c, g, or t
  misc_feature (279)..(279): n is a, c, g, or t
  misc_feature (287)..(287): n is a, c, g, or t
  misc_feature (294)..(294): n is a, c, g, or t
  misc_feature (303)..(303): n is a, c, g, or t
  misc_feature (311)..(311): n is a, c, g, or t
aatgtatttcaaaattaagaaattacacatagttcaattaaaattaaatttgaanataattttatttgtgntgttttttagngcaccaacaattcatacacatgatcttcattctcatagccacttaaggnaagtgttacctccattttgggggngaggggtttggggntcaaattggctnttttggnggnggncacatagttttngggggngttgggtntggcccaggnnnggttggnnttttnnnttcacttaccaccattccagcagantagcagngcaatttnttttttnctgttattnagggttantcatcc

SEQ ID NO: 679228 - DNA, 1447 bp, Homo sapiens
  misc_feature (571)..(571): n is a, c, g, or t
cggcttattattatgttataagcgcgaagcggtgctctcttgtttttttttgttttttcctctcccttgttgatggttgtcctccctttctggtgtggatgcacttcttccttatacctacacttccttttttttgtgtctcctctctcgctgactcatagatgaagataatctaccctccgcggcgggcgtggagagatgattctatcaggcattcttcctcgctggggatgatttttttttagctgactcctatgaatggaccgcgcgggcgtgggtgcgcggttgtatgtacctattttttttgtatcctacactagggtggaatactcatttgttttgtacccttctttatctgtgctcgctctcttttgtttgtggggggtgcgacactcttgtttgtgggggcggccagctctttgtggtggtggtcccctactaatatgcgtgatcgcgccgcgtcgtggttgttgcttccgcgctgctctgcgtccgcgattatttttttctctgcgtcggtggtgtttgtcgtttcgtctctcgtctgcttctttggtgggtgggtcgtgcnccgcgcacacggctctctcgtttgtttgtggagtggttgttcctctctcctctgcgtagtcagtgtgtgtttccgcgcgcgtcagctattatttgtttttagggaagtggtagtagtatctgctacgatacgcgactctacgatcgatacgtacagcgactacgttggagaggccacgcggcgtcggctgtcatatattaataatagcattcttcttctggtgtctcatcttctactgctacgtcgccccccgccctctataggaagagtggtgttaggtggtcgcgcgcgcgatcatatataatattagatctgttactactatttggtgggtgtggttttgtgaggataatagctcgataccacttctgtgttcgctctttctctccacacagattaggcgcgcgggatgaatatctctctctcgttgtggagggagatagaagagatggggtaaacgctgtgtgttgtatcgcaccctctctatatacgcggcgatatatatccccagcgccgctcttctcacataatatatctccgcgacagagtgtgtttttttgtgacagcaagcaaccgcaagagagagagatatttaagagaggaggtgagataatacacgccggcgttgttcttaccacaggttgtgtgtggcagcagagagttctcttgtggatagacctctgggggcgatattatataataatatttgcgcgccctcaaaaggaggtgtcgtatctattttggggccttttttgattgggagggccgcttcatcctccacatgcccctcttgcccccggggcccccccgcggggggttccaaaaaaaaaaaatttttggggcctttgtttttataaaaaaaggtgtataaaccca

SEQ ID NO: 679229 - DNA, 454 bp, Homo sapiens
agaatgtaaaatgttgcagcctctgtggaagactgtttggcagttcctcaaaaattaaacatagagttaccatgtgacccagcaattgcatgcctagatatatagcctctgggaattgaaaacatgtccttacacaaaaactgtacaagaaatgttcacaacaacattattcctaatagccaaatgtgaaaacaatctaagtgcccaatttattattggataaacaaaatattgtatctctatccaatggaataatattcagccataaaaaggaataaagcactgctgcatgctgtggtatggatgagccttgaaaacattacactaagtgaaacaagccaaagaagccagtcacaaaagtccatgtattatatgattccatttatatgaaatgtccagaacaggcaaatccagaagcagaaagcaaatgaaccaaattcatttttaaaacggg

SEQ ID NO: 679230 - DNA, 777 bp, Homo sapiens
ccccttgagtggacaggtctgggatggaagctaagacgcttggagtatctgggtaacaaagggccatgccccataagatatgagcagaaagttctggtcctcttccctgaaaaagttttccccaccccagccagacatcttctgcttccccttgggttagtgaccaggggtagtggggagagaggctgaggctctagctcccctgagagaccttctctgtagagagttggggtgcttcatggaaaatgccaagcctgaggttaccctgtctggtctctggccaattagatgtgttactcggtagtcctccatgtccttgtttgactttttccctgtgtcctatggttatggcgtgttggcgaagatgttccctgctcattgatccctcacctcccatgcccgcaccagccttcatgttacagcggctggtacatctgcatgtgaggtgttcctgtctctctctcctctcttggttggtgttggttttgggctaccgtgtacctcaggtgggatctcacctcatttcttggttctgtcttactgtgactcagtattcgcgagcctgtaatggtgtccactgcgttgggatgacctataaaggcatgtttcgcattggctgggacgtcatacgataaccatccgaaccgaagatactccttgtactcatgtcggacttcctctaggattgggggggaacttactcaacctttcggcccttgttgtatgcacctctgatgctggagggagaagctatggatgtaaagggggaaactccgg

SEQ ID NO: 679231 - DNA, 109 bp, Homo sapiens
tactttgataagcattccccttttgttatttattagggctatctttttttttacgtgttaaatcttgtgattattaaaataaaggacccttgtaatttaaagtgaaaaa

SEQ ID NO: 679232 - DNA, 557 bp, Homo sapiens
ctgactctaaggatcccccgctggcgtcttttaggatactagagcgaggtgaatgtcccgcttaactctgacttcatcacgagagccgtgtactctccccttcactgcacttgagctctcacactgattacacccagcacatttttattctatctttctctcaaatgttccatgtctgtctggggatgagtcagtgcaactactcccgtctgatagtggttttaaaaactagggaattgtcctcaaaagaccaaaaaaaacaagagaaaaagatcacacacaaaaaaaaacatgaatccaacctaaacacaagttctgtgaacacaatatatgcactaaggtgaacatgtggtttcctctatacacctgagtggatcctttattgctgtgatcctgagaggtgagtatccttgcccttgtacagaaggctacagagcagcacagatctgtgggaagtccaaaatactcaaggggctagagctttgttatatttcaacagataccaccatattttttccccatttttgccatgattctgaagccaagacggcaagcgg

SEQ ID NO: 679233 - DNA, 204 bp, Homo sapiens
tgctgggattgtaggcgtgactatgcccagcctaactcatttatttttaatgctgaatatgttccattgtttagatgtgccacagtttacccattcaccaagaaggacatcttgcttgcttctaagttttcacagttatgaataaagctgctacagacatccatatgcagatttttgcatggatttaagcgttcaacttattgg

SEQ ID NO: 679234 - DNA, 951 bp, Homo sapiens
gcccaccccacgcccctcgtttgtttctcgtcgtggagggggagtgtaccccccccccccggcggagtgtgggtcctcgttcttttctgagctcgatgcaccacagatcgaggtcctcctctcttgttgtgttgttgggtgagcatccttcttcttcctctccctccttcggcggaggacacccatacttaggggggttcggccccccccctgtttttgttccaacaaccatggtcggtcctcctgtacgtgcacgttcacacacctccatgctttgtgttgtgcacacacgccgcggtgtcgtacgacgaccacgtgttcctcgctctcgttttattgaagatcatttgcttggtttgttttttctctggcgcgcccccctactatctaggtgctcgtcctagaaggggcggctctcctctctctgttcgccgcgctcctccctcccttcctttcttgtgggtcgctccccaccaccacgacgaacacattctagagtatgttatctctctctcacatccctcctcctgtggatggatgtcgtgcgtttcaatatatttgtctcgtgcgagtgaaccacccctcttggtttttccgcctccctccccagcccccgagcggtgccccccccccctcgcccccctcctgctgtgtgtgtttgttttcgtgcggagcacacaacacacctcctttgctgccccctgcttccctcttcttctcgctgcagacacaccctccctcttttccttcgcttcggcggtccaccccaggaggagggaggcgctcccccacccccacgccctctcttctgtccacctgtgacccgcagggctacacccttctgctgcccccccccccctcgggtttttttcccccccccccccccccccccttttccccccccccccccccccttttttcttaaaaaagtgggggggggggggcccccca

SEQ ID NO: 679235 - DNA, 160 bp, Homo sapiens
  misc_feature (135)..(135): n is a, c, g, or t
tggactagaggaccccaagcagttaatacagactcacatatcagttctgaatgtacttcatgtagatatttgaatatagtgtgaggtaagggtctaatttcatttttctagtatgtaggatatccatatttaccncaatgcctatttatatgaatgggac

SEQ ID NO: 679236 - DNA, 383 bp, Homo sapiens
cagctagagatctgctgctcacatggtgatctctcggtcacgcgtccatgtctggatcagctcctccttggacagccgtgctggcacagctccagctcagtgtcagtgtgcggtgggctggggggagacaccggttccagcttgcccgtcaggctacggtccttggtgaggtcttcagatcccgcaggcttacccgtggccagcaggtgtgacggtcgcaagcagggggtcaggcagcagctctagccgagggggaaagtctcgggtgtagcgagctttccctcgtatctccacctgtaaggtaacggtcacaggagactgtgcaactcctgatctccctgtccccagaccttcgcctggccctggaaaaagcccattgcatc

SEQ ID NO: 679237 - DNA, 626 bp, Homo sapiens
  misc_feature (72)..(72): n is a, c, g, or t
aagtcaagagtaatgtgtagttcggaaagttttcctgagcaagggtgtgtttaatcttctgcttttagccancagacttccagctcatctctctccaccctcatctcctgcacggtgttatggatggggtaataggcagctgccagcctgtctaaatccagggacaagagccatctatgacaacacgatgggccctgaggcaagggaggaatgtcatttgttaactacctttctagctatgtctgcctgattcattacactcactctttcgcaaagaaatatggacaaatagattacaataagcaaaacagcccattaaaaaatatgtatgtgcttggaaaaaaaattgatttcttttgaatgttagttcttgagggcaaaaccatctatgatgctgtacagcactcaaatgacataaagtaatttgaagctttgaaggcctcatttaaaaagcaatacaaaaatagccaggagaatgtaaaatagtgctacttctatggacagcaagttggcaatacccatcaaaacctaaaatccagtaaaatgtaagccaaaagttaaacttatagggctttatcatactggaaacttggctctgtaaaaggttagccaataaagtattgttt

SEQ ID NO: 679238 - DNA, 187 bp, Homo sapiens
ctgtgggttcttattctttcagctattcataatttctctcaggagaagcagactcggcctgtgagctgtgctatcacacagggacccccattcagaagggtccacatttggggattggaaaccctgacagtcaccagtcttgaaattcttaacgagttttatcatggcaatttgtgcgttattatac

SEQ ID NO: 679239 - DNA, 256 bp, Homo sapiens
ggtctgagcacgctggcagtgcatgtgtgttctggagagccccgtggccatcacgccacagtttcccggagggtccactccatagtcttctgggtggctgtgatggcatgtactgtggtcatgagtccttccacgataccaaagttgtcattggatgaccttggtcctagggtggtgcttaagcagcttggtggtgctagggaatgtcattgcttgatgatcttcgaggctgttgtttagtactttctcatgtgtt

SEQ ID NO: 679240 - DNA, 248 bp, Homo sapiens
ggccagccctattcctcatgagttggcggggggaaagccattgtttttaatttccccttaatatgaaaatggttggttttaaaatggtttttcctgctggaccaatggattttttaaaggaaaaaaaattttcttttgggtctaagaagtcagctgtatgagcaggggtggccatatcataacatgctgatatgataggaatcaataaatttttccctctcagggaaaaaaaaaacccccaaaaaaaa

SEQ ID NO: 679241 - DNA, 778 bp, Homo sapiens
  misc_feature (11)..(11): n is a, c, g, or t
  misc_feature (95)..(95): n is a, c, g, or t
  misc_feature (113)..(114): n is a, c, g, or t
  misc_feature (129)..(129): n is a, c, g, or t
  misc_feature (173)..(173): n is a, c, g, or t
  misc_feature (186)..(186): n is a, c, g, or t
  misc_feature (233)..(233): n is a, c, g, or t
  misc_feature (235)..(235): n is a, c, g, or t
  misc_feature (263)..(265): n is a, c, g, or t
  misc_feature (267)..(267): n is a, c, g, or t
  misc_feature (301)..(301): n is a, c, g, or t
  misc_feature (309)..(309): n is a, c, g, or t
  misc_feature (319)..(320): n is a, c, g, or t
  misc_feature (388)..(388): n is a, c, g, or t
  misc_feature (476)..(476): n is a, c, g, or t
  misc_feature (597)..(598): n is a, c, g, or t
  misc_feature (602)..(604): n is a, c, g, or t
  misc_feature (606)..(606): n is a, c, g, or t
  misc_feature (609)..(609): n is a, c, g, or t
  misc_feature (612)..(612): n is a, c, g, or t
  misc_feature (640)..(640): n is a, c, g, or t
  misc_feature (645)..(645): n is a, c, g, or t
  misc_feature (649)..(649): n is a, c, g, or t
  misc_feature (666)..(666): n is a, c, g, or t
  misc_feature (675)..(675): n is a, c, g, or t
  misc_feature (678)..(678): n is a, c, g, or t
  misc_feature (683)..(683): n is a, c, g, or t
  misc_feature (685)..(685): n is a, c, g, or t
  misc_feature (725)..(725): n is a, c, g, or t
aaaggggagantccagcacctgcaacccctcacggggtacagagggcaggggcagggccggcggggacatgaaggcaccgtcagcactgagaggnggggactcgtggggctannggagggaggccagangctgggggcccagggtctgggggcaccaaaatggggcctctgangtcagtgtctgtnaagggggtgcactagtgtctttggttggggctgaaggcaccgcaggngnggtcgggtggagcagggaccttataaannnanaggaagggaaaggggtgatggagggccgattttngggcctangaacccaggnnccgagtgtaggtgacataaagcagcagcatgaggaccacgtagaagacgacgaagccgcccaaaccanatgggggccagatgggcggtagggccttgccccccacccgcttcacggcctccagcgcggtccgcagcccccgggcagtgccctggangagatccgagggcgagcacaggtcagcctcaggcacccccatttttcgacaggcttctagaaaactctccacattcttccgagccttgagggcactgagttttggcacagcaggggagggnncatnnntnaanggntcggagcgcggccgtagctggttggcanctggnacangatgacccactggccanagcctcggncangtctnangcaggggccgctgcagccgggactcaaggacctggcgcantgacgtcattaagtccttctcatctggaacctgggggtaccgccgaggtctca

SEQ ID NO: 679242 - DNA, 621 bp, Homo sapiens
  misc_feature (207)..(207): n is a, c, g, or t
  misc_feature (212)..(212): n is a, c, g, or t
  misc_feature (214)..(214): n is a, c, g, or t
  misc_feature (225)..(226): n is a, c, g, or t
  misc_feature (230)..(230): n is a, c, g, or t
  misc_feature (235)..(235): n is a, c, g, or t
  misc_feature (245)..(245): n is a, c, g, or t
  misc_feature (247)..(247): n is a, c, g, or t
  misc_feature (250)..(250): n is a, c, g, or t
  misc_feature (252)..(253): n is a, c, g, or t
  misc_feature (256)..(256): n is a, c, g, or t
  misc_feature (258)..(258): n is a, c, g, or t
  misc_feature (262)..(262): n is a, c, g, or t
  misc_feature (276)..(276): n is a, c, g, or t
  misc_feature (288)..(289): n is a, c, g, or t
  misc_feature (291)..(291): n is a, c, g, or t
  misc_feature (303)..(303): n is a, c, g, or t
  misc_feature (307)..(307): n is a, c, g, or t
  misc_feature (316)..(317): n is a, c, g, or t
  misc_feature (322)..(323): n is a, c, g, or t
  misc_feature (329)..(329): n is a, c, g, or t
  misc_feature (339)..(339): n is a, c, g, or t
  misc_feature (341)..(341): n is a, c, g, or t
  misc_feature (369)..(369): n is a, c, g, or t
  misc_feature (438)..(439): n is a, c, g, or t
  misc_feature (451)..(451): n is a, c, g, or t
  misc_feature (463)..(463): n is a, c, g, or t
  misc_feature (472)..(472): n is a, c, g, or t
  misc_feature (511)..(511): n is a, c, g, or t
tcttacttttgcccccagagccttttggggtttttaaaaattgttgtttttgtaaaccagataaaagccggcccccaatcggtctacaagcccttcaggccccttccgtccaggccttcacttcccgggtggtggccgggcacctcggttcctaaagtgggtcgcgggggcgggcttgtcccaggtttgttgagacagtcttttttnatttngnattgttatttnnattnttttnaatttaaacntnatnanntgnanagcntctttcccaccggnaagatcggcctnntnccttccctctgngggntgggggtgnnacagnnccagtnggggccaggncnacactcagcgcagtgtgggctggacccncctctgtgctccaggggctggccggtcttcgggggcgccggcttccaccactcgccgccccacccctgnnctccgtgacctntgagaacccagntggcccctngttagccccagggtctgccgtctagagggagcccaccgnctccggacactgtcttcccgctagaccccgtcctcctctgcgggctctccgaccccccttccccctcacctccaggcagggacagaataaatgtttgtatggattttaaa

SEQ ID NO: 679243 - DNA, 282 bp, Homo sapiens
catcgagctcggtaccggtatttatcgatgccaccacctaccagcttgtaagagtgtgtacgtggatggattttgaaactctttctagatttctcttctcttgtagcaaatctggcgttcatctatgatatgtcctgcaattagagtaattagacatgttttcacttgcagtcgtgaaatacaggcgagatgtatactgacatcatatttcattaatatatctcagcattctgagaaagattgtgcacggttgacatgaggtcttctccttgaagcttctat

SEQ ID NO: 679244 - DNA, 745 bp, Homo sapiens
agtctcgagtattatttttttttttatttggaaaactgaaatgttccccatcataggggattcttaagcacgtcccccacgtatgcggggtgcaagcggaatgtctatgagggcataatggttacacgttgggcaggtgatagcacacaggttgggtgtcttcaaaaaggccaaccagataggcctcactggcctccgtgcaaagcaccgatagctgcgctctgtggaagcgcagatctgtttataaagctcctgagcaattttctcgcaccagacgcgtgaaagggaagttggcaggaatcagaagttcagtggacttctgataacgtctaattccacggagcgccacagtacctaggcctgtaacgatgagtgtttcttcaccccttccagtaaagggcgcactcttgacagagcgggctttggtacgccagtaggctcccggggtggctataaccaccggatcgatatgagcgggcagtcgtgatataggtacagagccagggtacatgagacctcctaacttaccccccttcatcctatcggctgggaagcctcggagagccgaaagggcggagcaggacgatggaggacagagggagacatagtctcgagataacaagctaacaacacacccacatacaccaaagaatacaagacctcacagaagggtggggacaccccatcgaacggggcaaagtccctaatagggccctgctgggttcaccatcactgaaggacacga

SEQ ID NO: 679245 - DNA, 136 bp, Homo sapiens
gagcagacaatttatttgatgcagcaagcagagagcttgtgcaggcaactccctgcactgatggtttttaaaaccatcagatctcgtaagactcattcactatcataagaacagctccggaagtgaggagagtggg

SEQ ID NO: 679246 - DNA, 369 bp, Homo sapiens
  misc_feature (48)..(48): n is a, c, g, or t
ttccaggaactagtgcatagcataaacagtttattaagaaagtaagtngtgaaaggacagctactccatagaagtagatggagtaacctctaacctgaggtcagtcaagtgtccttgccttttattaagaggggcctctaactcactctgtcttaggagaaactccaactcccctaagttgggcctctaacccaatcccatttgttactcgggtaccccatcacttacccaaagtcgtccaatcagtgctgcagtctatttctttggggttggggggatttcttcagtatcatcctttctgtggtttgccagaaatatgttacaggaccccaacacttacgcaaaggtagccgttgggttcacgtttct

SEQ ID NO: 679247 - DNA, 91 bp, Homo sapiens
  misc_feature (80)..(80): n is a, c, g, or t
aaatgttcagttccttgcaaaagtcaacatttatttatttgaacttgcttccagctaaggttactggttgcatttcaaancaccggtagca

SEQ ID NO: 679248 - DNA, 468 bp, Homo sapiens
atacattcatctagattaactagtaatataagcatagaggtgtagtattataccctgatggtaatatgtattcatgtgggatcggtggtgatatccccttatatcataaaaataagcgtctatatgaatctcccctcattaatactttattagtactatgctagtcagatctatcaatatagttgatcctttcaaaacaacagcacctggattcatacattcattgaaggtgttttttgtagtctctataaccttcagaatctgcactgatattagttatatactatgccttctgctagcttacgaatgtagatattgctcttgcttatctcgatacttaaactagtgaagtcagggtgtacaaatatagaatctttacctgcttactcttgtgggcctatcagtgctataaataaccactctacacaatgcttagaatgcgtgcgtcgatcctaaacttacctggtg

SEQ ID NO: 679249 - DNA, 711 bp, Homo sapiens
ggagatttcttggcttatttccttctgggcaggggagatttgaggaggcttatcattaataggaaggggatctatagggagcctaagatacgggtgtaagctgagaggtcctcctgtgggatgtaaattgcaagctttgcatagttgtgtattttccttcaatgaaaagaaagcctggacataaggtatttcactccatttgccttccctcttacagaaaaggtcaaactgcaggatagtattgtaatttgtacttccctcaggtggccatttttccccatcagagagagaatattggggcccggctgtagggcagaaaaaaatgagccacctctttttcagggtttgtgggtcaaattggtcccaatggcttaggacgcatttcaagggtgagcctgttgatgcctgagtgtttcccatctgaaagccaaaactgcccatggttttgggtttgttttgtttctccccctgcccgagaacctgcaacagtccctggaccctcctgatgggcttagttgaactcacgacgcaacagcagaaacactagttttctcccagacacaaggtggactgacgaaggttgatttagtggcccttaccaacaattcttgaaaaccttgacccttgttgtccttctagacacgtaggcttggcttgggggggggcccgtacccaatttgccctatagggaggcgattacttcctggccgc

SEQ ID NO: 679250 - DNA, 1113 bp, Homo sapiens
  misc_feature (344)..(344): n is a, c, g, or t
  misc_feature (357)..(357): n is a, c, g, or t
  misc_feature (727)..(727): n is a, c, g, or t
  misc_feature (744)..(744): n is a, c, g, or t
  misc_feature (758)..(759): n is a, c, g, or t
  misc_feature (769)..(769): n is a, c, g, or t
  misc_feature (791)..(791): n is a, c, g, or t
ggagcaggatcggggaggacacacaggtgggcgtctcaagaactgtggtgtacacagctgagcccctgcagctctgctttgccgggcctcaccctcggtgctgggtgcaagacgtgacaagatggcatgggaagcttcccggggaacgctggaactgggtgtttgaaggaggacctcatggcggcagctccagcccaagtactgcaactgtggggccgtgccaggagcaggtgctgcggagcctgtgtgggtccaggacaagaggagcaccagaagctcctggaggcggtgcagacgacactgtcggccggcccagcccaggccccagcagttgactcctctgngatcagaggatgnggctgaggatgtgcatttccgtcaagttcccaggagaacctggtgctgctgcttcggggaccccactttgaggaccactgatctaacactgcccctcgtggcaaacgcggaatgactcaagattcagctggatggatcattcagggagcaaatccacccttgccgcctggcacaccctggccattcggtaacgatgccatcagggttactggcttcttcattctccactgtgcattccagggtgggcatttccacagttgtgagcccatcatcaactcagcgagttcccattttccagttagaaaataagctttctgatcgttagccattcacttcaattggctctagaaaagatttctgggatgtatantttatttttaacataangaaaagctaagtgnnaactagatangctacaattgtcccagacgttntagacactcacagcaccgttttcctcttctagcaaaacaaaacaaaaaattctgcaatcatacaggcagtaggaaaaaaaaattagctggacaccatggctcacacctgtaaccccagcactttgggaggccgaggtgggaggatcacttgaggccaggagttagggactggcctgggcaacatagtgagatcccatctttataaaaataaaaaaaatctgggcgtggtggagcacacttgtggtcctagctactcaggaggctgagagtggggaatcgtttgattcccaggaggttaacgctggagtgaaccatgttgcag

SEQ ID NO: 679251 - DNA, 260 bp, Homo sapiens
ggatgctgaggaggacaggatgctggccatgaattttactgaatttttgacggggcacgctacgttacattatggcagaaaaaaagtgcaactgacatactacaacagcagattttttaagtttaaaaaaagtttggatctttaggattactttatttttttggctctttctgtgcttcactaccgctgaattataatcagccacacaactaatgagcgttttattttttttcctcctggctcaccccaaatcagcctgt

SEQ ID NO: 679252 - DNA, 142 bp, Homo sapiens
tgactccccacctggttcatatctagcccatgtagccttccaaaatgatgagtgaatgagcaaggcagtgagctgggacaagatggagagccactttatactgcccagctctgagttgagctataacatattcatacaataa

SEQ ID NO: 679253 - DNA, 101 bp, Homo sapiens
ctattatactaccgtggcggattacaaggtagctaaaaataatttaatattcctacccgctgaacagtggacccacataccccacccagtggatctaggct

SEQ ID NO: 679254 - DNA, 126 bp, Homo sapiens
aagtgaaacgcagtctgcatgagaggtggatgggggcctgtcattatgtttcccccccagcccccaacgtaaaggaaaactaagactcccaacataaacagtgtctttgaggtgaaaagaccctgt

SEQ ID NO: 679255 - DNA, 449 bp, Homo sapiens
  misc_feature (187)..(187): n is a, c, g, or t
gtgtgcagaggggcaggaagactctctaccgggagaagtgtgtgccgtcctgagccaggtgctggggcgaatcacctctctatcaccttgagccacccatgtccttctgcaggagccgggcttgcagcggctggaggagctccgggaccagcagcgctcccagtgcctggtcgacctgcaccgcagnttccacacctgcatctcccgccagcgcgtcctgccccggatgcaggctcacatgcgtgggttccaggccagcctatcttcacacattccttccacagctgttggcttgaccgtctgcctcatctacccttgggccagattcttggcgacagaagctggggatgccagagacggggcctcccaggctggttgggaagtcagattcagatggtagagcagccagtgatcttcccagagagtaaactcgaggggctgagaaatga

SEQ ID NO: 679256 - DNA, 320 bp, Homo sapiens
atacaaccgagctcgtacccccttctacgtctcatcactgcagggaagtaggatgaagcaagggactgatggaatgtgctttttgtctttttctttgtgacttctcagtgaaccctttcttgatggaatagtgctaaagctgagaatgaaagggtgctaggcagctgatggaggagcaagggcattttaggcagtggggtagagtgtggtgcgagacgaggttagaaatggaggtggaggttggagcctgcagcaccctataagccatgataagaaactttatctttatcctagaaatatcagtgatgagacgtagaagg

SEQ ID NO: 679257 - DNA, 437 bp, Homo sapiens
gaatacgtatgtgtacatattaggggagacacatattcactctatatatatattatatattatatttttaatttgggaaatactattcaggtttgtaggtgtgcttgtgtgagttgtgtgagtattaaaggattagtaataattgcgcacggaaactatcattagggagggtttaggtggttgctggttggactgggagggatgatttaaatttagtgcgtatgaaaccaattttagtgactggacaggttatcatttgtgagacagaaggtagctattaagctaccctgtgaggcatatcaaaaaagtgtcagaggaagattagtaaatatttatcaattaaaatcattttggttttctaatatcttaacatatcctcccctttaggaggaagaacgtgccgtgaggagctatagcgaatactggaagagatccgc

SEQ ID NO: 679258 - DNA, 1377 bp, Homo sapiens
agatcgcgagcggctgccatttttttttttgtccaattgttttaatttttgggatggcccatttttttaattttgcaattaaaagttttaaaagtttaaaaaaaaaaaaaaaaaaaaaaaaaaaaaaaaaaaaaaaaaaaacagacaacacaaaaaaaaaaaacaaaaagagaacacacacaaaaaaaaaaaaaaacagaaaaaaaaaaaaacacaacaaggacccacttagcgacccaaaaactaaaaaaaaagaaaaaaaacacaagaagaaaacaaaaccccgcgaaggacggaaaaaacacgacacaccacggaggagcacatcagggaagaacaacaaccacaataagcggggcgcgagcgagaacacccagcggccccaaacagataactacaacagagagatacatttaaaaacagccgatatagggagagaccatatataataacattatagaaagagggatataaaataggggttacaacagcaagatgggaataaatatgccagtgaaggaagctcatgaaatacatatttgagaccacaatcatggagatgctaacttatagtaacagaaacatatttttttgactacacaaacgagtgagatacccattatataataacaaaataaacatcttgatctttataatatatcaattatgaataccatcttacagtaactcaactaccatatcatcacatactatatacaactatgacaaaaacatttgatcgaaaaaaaaacatacgtcctccgtataccagaagaagaagataagagagaatagtagaacggaaataagaagaagagatgaagtaaagaaaaaaaaagcaaaggacggaggagagagagggggagaggaaacacagaagagagaagggaagaaaaaaaaaacaaaaggcaaaggaactagggcaggagagaaggagagggaaagagaaaggaaaagaacaaacacaaggaagtggaacagaaaggagaggaagagtacgacaaacaagtagaaagaaagacagaaacaagacaagtgaaggggaagagagagcgataggaccaaggggcgagagaaagagcggagaattagggaggaggaagggagagaagcaagagagataggtatagacgcgtaaagagaaagaggaaacaacacaaatacaaaaacataacatacagaatacaaaataaataaataaacataataagcaatcacaaaagacaaaaaaaacaaaaaaaaaaatataaaacaataaacacagaaaaaattaaaaatacaaaaagcagacaaaccaaaactaagaacagagaaagaaaaagtaacaaaactacacacacaaacaaaatcatcgtgtatttcattatctctaaaaag

SEQ ID NO: 679259 - DNA, 257 bp, Homo sapiens
actagtagtgtgtctagtgtgtatttgatattgcctgccattatttgatagattcattcattcattcaacagaggcttattgcaagtcttattgaggttgggcccagtgactcatggctataatcccagcacttagggaggcccgggcagtaggatcacttgaggcggggagctcaagactggcctgggtaacatagcaaaaccccatctctattgttttttaacaaaataatttttaaaaagtctcttgcatagag

SEQ ID NO: 679260 - DNA, 202 bp, Homo sapiens
cggaaccccgggaaagcacacccctttctggcagatttgggtctactgtcttaatcaggcaggctaagtcgcccagggagacttctccattctttctgtctgccttatctcagcattaccatcttcctaggctacaggatagcgaactcgatcatctctgacttcttttcttcaaagccaggaagttatccagtcctcctga

SEQ ID NO: 679261 - DNA, 251 bp, Homo sapiens
cgtgcgaatgacagctggctgttgtggtgttttccagcgccggtgtactcggtctcttggacgacaacgatctggtcgcgatccatctgacgagccatggcaaccgcggccgtcaagctggtgttgccggccggtccgcgctctaggccttcgatcttggtgagaagctcggtcatgtagaagacctcgccctgggacactagctggtagccgtccatgtaacgtagcggacgtgcagcattgcgcgggac

SEQ ID NO: 679262 - DNA, 494 bp, Homo sapiens
  misc_feature (73)..(73): n is a, c, g, or t
  misc_feature (202)..(202): n is a, c, g, or t
  misc_feature (332)..(332): n is a, c, g, or t
  misc_feature (440)..(440): n is a, c, g, or t
catgatcatatcccttgccctgcctgggactcaatattttactcctgggccctgttaacctgcaggacagganaaggatggaagcacaggctaccatggtttggttctactacattagctatagaggtcttccaacctggatttctctttgatttctttccaataattatttgcctttacatgtacatttacctactggaanaaatgggttggttaataagcatcaatatttgaaacacttgttagctatatcctcattgtaaatcaataaattatctttgatttctttccaataattatttgcctttacatgtccatttacctactggaanacatgggttggttaataagcatcaatatttgaaacacttgttagctatatcctcattgtaaatcaataaattatctttccagtgttccccctgcctctgcagcttcangtgaatgtgcatcctaaagctgttatcaccaccaatgtgtctatagttcagttt

SEQ ID NO: 679263 - DNA, 232 bp, Homo sapiens
  misc_feature (165)..(165): n is a, c, g, or t
  misc_feature (196)..(196): n is a, c, g, or t
  misc_feature (204)..(204): n is a, c, g, or t
  misc_feature (208)..(208): n is a, c, g, or t
attatctctcaggaactctgcagcgcttcataacatcagagcgtctagtgagggctgtactcaggttctctggccaccggttcacaccactgtcctgtgtaatcatttgatgtgcccactatgggtaattggtgctacggttccctgcaccccctcccgcttctntctgcagacactgagccacctgtgtgcacgncccctcgntttnggcggtgtgggttctcagcctccc

SEQ ID NO: 679264 - DNA, 885 bp, Homo sapiens
  misc_feature (767)..(767): n is a, c, g, or t
ttcttgctgaagggcgggcaccttgctcatagcagctgataccgtattccaatcccttcacgcaaggactaaacgtcgaccgacattaccttcgacttgaagccgagtttctcgcgctaagccacggtatcgaggtccgaccttcaaagcttgatgcgcttatgtggtaccaaatgatgtcggcgccaataatcgtgcatggcctgctgacccacgcaggactgaaagccgcctgagtatcaagattcagggcgccctacgacggccacgcccactcctgcaaaaactccatccgggccaagccggctaacccagggatctccggttatccctagcggggaataatgcaggctcagagcctcggctactacggccatgatgccgagcagtgctccagcgtcgcgccagaccaggctggatgcgtcattgtatttggcttgggtctttccaggttctgcgactagcaatagcttcgtagcactcgatgatggcaacgaagtttcgatttcagcagacagctcttcgaataatccccctgaaccaggaaaatcgataagagcatgacttcgagagtcgtatcggcaccattcaacttcgtctggaagctttagcaggacgtgaatggggtgaattgcgcctgcagacggtgcaggtctctgctcaagttcgaaacccaaagctgaaggcgctgtagcgagcgtgcgagcggaacgccgaagtagctcggaaagatcattccctgtcagcggggcaaaggtttttcggcntctacggcgctctatcacctgaaaaacctcctgcgcaactgagatcgccgatggctcaaaagacggctctgggttgtcattaaaaacccgcacacgattccatttgggggaccgctac

SEQ ID NO: 679265 - DNA, 86 bp, Homo sapiens
cggcacgaggctcatttttgttgtagccaaccagtaagatttgctaatgttctacattaagtgccttctccaaagacatccctctt

SEQ ID NO: 679266 - DNA, 447 bp, Homo sapiens
ttcttgctgaagggcgggcaccttgctcatagcagctgataccgtattccaatcccttcacgcaaggactaaacgtcgaccgacattaccttcgacttgaagccgagtttctcgcgctaagccacggtatcgaggtccgaccttcaaagcttgaaccgctgatggtgtacgtcacgccagacacatcggctgccaagctgagaggcgatgttgaaaatcttctgcgcagggcgcccatggtgcttcgtttccggttggacacagggatcgcttttgagcaagcccgctttgctcgatccgttgcaaccgaagttgagcatgcgggtgtcaaggtcgagttcgattctcccctgtaacgtctccctttaaatttccgtgaacactaggtagggcctgctgatacccttgtcaggaagcccccggccggattctctccagatcgactcg

SEQ ID NO: 679267 - DNA, 732 bp, Homo sapiens
  misc_feature (4)..(4): n is a, c, g, or t
  misc_feature (69)..(69): n is a, c, g, or t
  misc_feature (91)..(91): n is a, c, g, or t
  misc_feature (94)..(96): n is a, c, g, or t
  misc_feature (105)..(105): n is a, c, g, or t
  misc_feature (110)..(110): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (141)..(141): n is a, c, g, or t
  misc_feature (151)..(151): n is a, c, g, or t
  misc_feature (158)..(158): n is a, c, g, or t
  misc_feature (171)..(171): n is a, c, g, or t
  misc_feature (195)..(195): n is a, c, g, or t
  misc_feature (202)..(203): n is a, c, g, or t
  misc_feature (212)..(212): n is a, c, g, or t
  misc_feature (217)..(217): n is a, c, g, or t
  misc_feature (258)..(258): n is a, c, g, or t
  misc_feature (269)..(269): n is a, c, g, or t
  misc_feature (275)..(275): n is a, c, g, or t
  misc_feature (280)..(280): n is a, c, g, or t
  misc_feature (293)..(293): n is a, c, g, or t
  misc_feature (345)..(345): n is a, c, g, or t
  misc_feature (357)..(358): n is a, c, g, or t
  misc_feature (365)..(365): n is a, c, g, or t
  misc_feature (486)..(486): n is a, c, g, or t
  misc_feature (635)..(635): n is a, c, g, or t
gggntgatcctcccatgttgggagataaaatgtggcaagtgacaaagctctgagcccgcccctcttggngccaaagtggtagggatggggnttnnngatggaccnatggntggggtagtaccatgattggngntnggggangcaaccagangcctgtngctttggggaggngcattcccccaaccatgtcccganacctctnnagtacaggnaaggnccttccagtcctacttgtcctgcatcttctcaaggataggnacaatcatgtnaaattngggtngctttgaagggtnttcattcatgcagatcttcatgagcttacacacatgaggggaaatacctggngggatggtaggnngaagttnccaatgccaccttcattccaatctccatattggagaggtcagcaaagggtacctcccgtgtcaccagttcccacagaagcactgcaaaactccacatgtctgctgagcgtctgtttgtgtnttcaggcttcttctgcagagcttcgggggctacccaggcaggtgcatacatgcgaccaggacattggaaagagaacttgacatcagccatgctaattcgggcagtcatgtcctcatcaatcattacactacggctattgagtgcatgtngtgggatgaggggctctagtgtgtgtaggaaggccatgccccttgccatgtccaaagcaaacttcacagcctggctctggtccacgacgaaattggt

SEQ ID NO: 679268 - DNA, 523 bp, Homo sapiens
agggagggacgagacgcgtgcgagcggtattagagaacacatcatgactagcgatggatacgctcgatagtcgcaagccaagcgcctgcgcactcaccgtttcggcaaacaacatccccctgagttcatagccgtatcctgggagctgtagcggtgatgcacggtcatcgggattggaatacggtatcagctgctatgagcaaggtgcccgcccttcagcaagaacgtgaaccgctgatggtgtacgtcacgccagacacatcggctgccaagctgagaggcgatgttgaaaatcttctgcgcagggcgcccatggtgcttcgtttccggttggacacagggatcgcttttgagcaagcccgctttgctcgatccgttgcaaccgaagttgagcatgcgggtgtcaaggtcgagttcgattctcccctgtaacgtctccctttaaatttccgtgaacactaggtagggcctgctgatacccttgtcaggaagcccccggccggattctctccagatcgactcg

SEQ ID NO: 679269 - DNA, 222 bp, Homo sapiens
  misc_feature (28)..(28): n is a, c, g, or t
cccccttcccctttcccggttttttttngggggggcccccttgggggtttggcccccttttgggggggaaaaaattttttttttttcccccaaaaactttttcccccctttaaaaaaattttttttttttaaggggggggggggggtttttccctttttttttaaacccgggggggggggggaatttccggggtttttaaaaaaatcccccctttttttcca

SEQ ID NO: 679270 - DNA, 438 bp, Homo sapiens
ggcggcggccacgcgttcgatgatctcgttggcaatttcgccgccaccttcgctgttggtcatcacacgacgccatagcccttggcgacatgggcaacggcgcggctgcggaagccccagttggcgccgctgtgacggaaataccagccttgccccttctgctcgatggcaaagccgacggcgtaaggcccgacgcccaccggcgccaccatgttctgcatcgttgccctatcgagcacgacttgcgactggccggcgagcgttttctgcacatcgatcatgaacagcgcataatccgcggccgtggtccacaggccggccgccgcctgttcgggatagacatgccagcgggccgtccccagcgccttgccatcttcatggccgcgtgcggtccttgtctgccagtccggcggcagcggctgttcgaaactggaatgg

SEQ ID NO: 679271 - DNA, 117 bp, Homo sapiens
ccgatcacatcgaaaggtggctggcagctgtcggaggcttaaggctcttgaggcgctgcagaccaccaggctgactgagcagaacgccagctgtttggatgattttgcatagcaatc

SEQ ID NO: 679272 - DNA, 184 bp, Homo sapiens
tgcgccgcactcgtgctcggccgcacagcttctccaggccctgccgatgcactcagtcccccaggactcaggatcatagggctagcggctcccagggcacgggccccaaggcagtagcagttcctgacctgacccacccctacttgtcactgaggcccagtggtaccattgctatggggtgaca

SEQ ID NO: 679273 - DNA, 743 bp, Homo sapiens
cctctgggtatgctcattgggcgtgacgagacttggtacgactggcgcgcctaggttcgtttacctccggctactgtctgcaaaccctgtctgggtggaatccatgaattccatgagcggatctgatcaaacagagccacgagagaaatatgtactgcgtaccatagtaacgattgtacaggaacagcacgctggcaaatcttaatgaggcgtgcgccgtcgatatgactgtccatttcacatgcgttgacttcttatagaaaatgtctgacctgactaactgtgtaagatgcaaagaacgctgatcaaggttaaaagaatctgctgtcattttcacgttgaccaactactggcctcaaatgccgtgcctgactttcacatatgtaccactatatgggacgcagtgaaggatagaactggcatccacgcacgaatgatgatatgttggaggcagaactgtgttgggaccacagttaaagctaaagtaaagccatactgggccatgggtcctagaggctgtatagcactaaatcagattgccatgtctttagctcaaacgatcttaattatgccaatacacaatatgtgaatatgctaatgacaagttaaatactctcatgccaacaaggccaaagtaaactcccttttcgcccgtttggtgcggccaagtctacactttacaattttattcatgcgccctgattcaaagtcactgggcaattccccctaaagagagtctgctt

SEQ ID NO: 679274 - DNA, 349 bp, Homo sapiens
  misc_feature (166)..(166): n is a, c, g, or t
  misc_feature (308)..(308): n is a, c, g, or t
caatacatgtatacagtgtacactgatcaaataagagtaattagcatatttatcacctcatttcttttgtggtgagaacatttaaaatcctttctttttgctattttgaaatatacagtacattgctattaagtatagtcatctggctgtgcaataaaacaccagnacttacccctcctgtctgtgactttgtaccctgttcaccacccctccaatcctctagtaactaccattctactctctacttctatgagcctgactttttaaaattccacatgtaagtgagattacatggtattattctctcngtggctggcttatttcactttaacataatgtcctctaaatt

SEQ ID NO: 679275 - DNA, 314 bp, Homo sapiens
tcgtatctagaggatctcggcgagtgcaatggctgctattagaagtcaacaaacaagaggctgggtgtggcggctcatagctgtaatcctagcacttcgggagtgccgaggcacgggatcacctgaggccaggagattgagaccagcccggccaacatgacaaaaccccatctccactaaaaatacaaaaaaattagctgggcctggtggcaggcgcccgtaatcccagccacacgggaggctgaggcaggagaatcgcccgaacccgggaggctgagtctgcagtgagccgagattgagccattgcactccgg

SEQ ID NO: 679276 - DNA, 857 bp, Homo sapiens
gccgccgaagaagcatcgttaaagtctctcttcaccctgccgtcatgtctaagtcagagtcgtcctagagagcccgaacagctgaggaagctcttcatggagggtggagctttgaaacaggactgatgagagcctgaggagccattggagcaatggggaacgctcacggactgtgtggtaatgagagatccagagacaccaagcgctccagggcttgggttgtcacatatgccactgtggaggaggtgggtgctgctatgaatgctaaggccactcaaggtggatgggagagtgtgtggaaccagagagagctgtctccagagaagattctcaaaagaccaggtgcccacttaactgtgaaaaagatatttggtggtggcattaaaatgaaagacagctgaagaacatcacctaagagattattgttgaacagtatggaaaagttgaagtgattgaaatcatgactgaccgaggcagtggcattgaaaaggggggtttgctttgtgaacctttgacgaccatgactccgtggataagatttgtcattctgaaataccttactgtgaattgggcccaatgtgaagttagaaagcctgtcaagcagagatggtaggttcatccagcaaagagtcgaggttctcaaactgtggtgggcgtgaggtgcttcggggaatgacaacttcgcccggaggaactcaggtcgggctgggcccccgtgggggttgggcgggtgcactggtggcacggcacttcgggggggccccgttggagtcacactcaaggcccaggagatgggaacccctggggaattaccacaggggtgtcaagtgaataaaagaacaagccggaactcttta

SEQ ID NO: 679277 - DNA, 484 bp, Homo sapiens
  misc_feature (22)..(22): n is a, c, g, or t
actgagcaccgattacgccganagctccgtactttctatggggtttatataagagcaattcgagtctccccactcctcacttagtttaagctcattttgccctgagtttatctggtagcactttattttagcggacaaggagggaagtggggaaaggaaaggaattataaaaatacaaggtagacgtgcacaagaaccttcgttctattattatttagtaaagtgagaactggaaacagcttaacgtccagggtaagttagtttcactcactcgacggaatgtatgcagccgttaatgtatttctgcattttcccatatttccagtgaacatacagtactttcgcaattcggagtacaaacgaaaaagggcgagagaaggtcgcattttgcctgccggagctaggggcgcgcttgccggttccaacgagttttcggtgtcggaaaacttgtctttgctcacattctcggattcccgcggccgca

SEQ ID NO: 679278 - DNA, 469 bp, Homo sapiens
  misc_feature (33)..(33): n is a, c, g, or t
  misc_feature (36)..(36): n is a, c, g, or t
  misc_feature (171)..(171): n is a, c, g, or t
  misc_feature (180)..(180): n is a, c, g, or t
  misc_feature (231)..(231): n is a, c, g, or t
  misc_feature (241)..(241): n is a, c, g, or t
  misc_feature (260)..(262): n is a, c, g, or t
  misc_feature (267)..(267): n is a, c, g, or t
  misc_feature (271)..(271): n is a, c, g, or t
  misc_feature (275)..(275): n is a, c, g, or t
tgcacaactccgctgagttggtggaggtggttnccngtttgtcagggttggggctaacatgttttttattaacacaagctaagcggcattgtttctggaggatgatagcaccccaggtaagcagagtaactgcctctccagagcgtctcagaagcagaggctctgcagtcnatccggtcntgtaaggatgactgacatccattccctttcttcctgcagactgcatcaacnagtatggtcnccgtacaccaaaaactcannntcgcnaccngcgngcaaagtaagtcggcctcctttgcgccttcctgggagcactgtgggtttgggcggctttaggcttggctgtggtttgtggagggccctgaatagttctgttttttaaggagctgtggtcccttgccgaggcctgctcccttttcgccaaactttcttttttaaacaagtaaattttgacgtttttagcaatagg

SEQ ID NO: 679279 - DNA, 356 bp, Homo sapiens
  misc_feature (56)..(56): n is a, c, g, or t
tactgttgtgtacgtgcatggttgcatgtgtctgtggcggctcggtgagcgctggnagaaagcggtgctcctggtgcgttgggctgtacgcgctggcagtgcgggatccgtccggctacaggctcgaatcgttcctcgggctgcggctggttcaaggtctcggcgcgggcggtgtgtcggtgatggcgcgggtgttggttcgcgacagtttcagcggtgccctgtttggctaaaggcttgaccgtggctggggattacattcgtgatcgccctgggcatcgggcagtttgtgggctcgcttgttgcaagtggcattttggctgggaggcgatcttttaatgggctggcgatagcgg

SEQ ID NO: 679280 - DNA, 317 bp, Homo sapiens
  misc_feature (41)..(41): n is a, c, g, or t
  misc_feature (103)..(103): n is a, c, g, or t
ttttagcaataaacgaaaagtttaactaaggctatactaanccccagggtggtcaaatctcgtgcagccccgcggtcacacgattaacccagagtcaatttangaagcggcgtaaagagtgttttagatctaccgcctcccttaaagctaaaaatcacctgagttgtaaaaaacggcagttcgacctacaatagtcttcgtaattggctttaagatatatgtgagcaccagatctaattccccacatggttttagatagccccctatgcttaggtctttaccaggccagttctatcaataaatgtgctagagctctc

SEQ ID NO: 679281 - DNA, 341 bp, Homo sapiens
cctgtaggctggagcttgctgtgcgcgcagtcgcgccactgcactccatactgggtgacagagtgagactccgtctcagacaagaacacgccacctgtgctttcacgttgggtgtgtggctcaggcctcaggcctgttcatcccagcacttctggaaggtcacggtggggggatcacgaggccaggagttcgagaccagactacacaaaatagcaagacctcatctctaaaaaaataactaaataaacaaccaaaaacttgtgtgcattttgcattctatataataatatcaccaaatgatctcggacttcacaccatcttcttggaaccctctgcaccat

SEQ ID NO: 679282 - DNA, 349 bp, Homo sapiens
  misc_feature (1)..(1): n is a, c, g, or t
nggctttccggcggtgacgacctacgaacacagaaccaggcttttggaaagggaggtccttaatccttttccagaggaggagaggaggaaccccaggaggaaacgcctggtgcaaagccccaatctacactaaggtatgaaaagtgcccagtgggttataaattcaccagggtttttacccgtgcacaagcggaatttgtgtgtgtggtgtgctacagtggcctgtgaaactctagggggggaaaagcagggtttacagagggatgcctttgaggaggagccccttaaaagctttctgggacaagaggagtgggacaccatctattaaacacattgggataaaaaattc

SEQ ID NO: 679283 - DNA, 514 bp, Homo sapiens
gggaattacttcgtatccaggtctcactgtggagtaggaagggcatgtgttccttcccaccatggagatccgtagaaatcacaagctccagccgccatcaatagatgacagggttaccagtcacataagcagattcatcagaagccaaatacgcgctgcggatgggtatttcttctgcagtagcgaatcttcccgtgttgagtctcttcacataatcattccgtgcctctacaggatatcctctggcttgtattcttgcttgtagagatggcgtatcaacgtgttcctgggcacacacagttgcacctgatgccctgctggatgagatctgcagcgacagattagagtgaggccaatcacagctgccttggttgtgctgtacacacgtctgttcagactcctttgacgctggaggcctcagaagacatgtcgataatattgccagatttcggagcaggcattttaggaaggaatgccttgatcatcaggtacatgctgcggcagtggagttcat

SEQ ID NO: 679284 - DNA, 172 bp, Homo sapiens
taccgtgagcgaagcattcattgcattgctctgtagtgtgagttgatgcaccactgcggtgcatgccggcctgtacaagatccggcgacacttgagcaccgggctgacctccaaatatcgttaagctggagcctggtcgactctatatcatcctacagaaccctagcatgca

SEQ ID NO: 679285 - DNA, 216 bp, Homo sapiens
tggaaacttcttaaaatagggcttagtttaaaaaggttccataagcctcagccaatttttcttaattataagggtatctttcctcccagaatccttcaatatttatgtggtccacttgattccggatgctatcgggtcggtaattattaaagtcttaattgggaggtattttcctccattaaaataaccgggaacggggatcccggaggcccgaat

SEQ ID NO: 679286 - DNA, 497 bp, Homo sapiens
  misc_feature (3)..(3): n is a, c, g, or t
  misc_feature (9)..(10): n is a, c, g, or t
ganagaganncagcaatttggtcacactggaagggattttcagagccaaagagatcacacaggctaagtcaaacaccgagccggagttacaggagagagacatcgcgcacagacaaattatctattctctccgcatggaacggccgatgatagcatggaaaggaaatggcgagaaaagactcgacataaactgcgagagactacgtggtgcatgacagctgactgtaggaaaattgatacaacattggaacgaacaacgatcctctgtacacggtaactgacaggggaacatctattgaaactggctgatgtaagagacactgtgcaaaagagaagaaagacttgaatacacgcatttagataagttacaaacaacttgagttattattacgcggaccagtgccaccatttacagggcaatcaacgtgaagtaccgggaagaaagcggaacagactctgcttcgacagactgaagacctgaggaatgagcagctatt

SEQ ID NO: 679287 - DNA, 343 bp, Homo sapiens
gtactgagggactgcagcagacagcgggatagcaggcagtagcggtccgcctacgctcagactacgaggctcgcttatccgagagcaccacgacgctcatatagccggcatccgcaacggccggcaccgggtgcaccatcgtgccgaagtcttcgccgaccgtaaaacaaacgcgcgcatctcgctccagcatctccatttttcgcccttcttccgcaccgcgaacataaatggcaccgttccaccaaacgaaattcaacggaacgacatatggttcatggccgtcggcaagtcctaaaaaccctgtcggcgccaacgataaaaatgcagaaattttttcttc

SEQ ID NO: 679288 - DNA, 307 bp, Homo sapiens
atgacttcaagattttagcttatggcactcaagaaagtaagctcctcatattgcctattgctggaccccaagctttattaattataatgaggacctatacttacgaaaaactactgtggaccacaagtcgagattgctgaaggtgcatatctgtctgctcgtagtaactgagccggctatagtagaagctggtggaatgcatagctttaggactacacctgacagatccaagtcaccgtcttgtacagaactgtctttgtgactctcaggaatctttcagatgctgcaactacacgcctctgcaggc

SEQ ID NO: 679289 - DNA, 1543 bp, Homo sapiens
taaccaaaccatttacccaaataaagtatagtgcgatagaaagttgaaacctggcgcaatcagcatatcagtaccagcacagggaaagcatgcaaacacattataaccacagccatcaatcatcagccaaggcactaacccctcataccattcatgcatcaatgcacattcaactcagcacaatcaacgtttgccaaggcagcagcccaacagctacagcacccccagcaaaccagcacgcagctcaccataagcaaccagctcacaacagcagccacaccacgtcatatgtcagccaacaatcagatcgggcaagcatattcatcagcgtcagcagtgcagcacaacaaccatcacccgcagcctcgcgtgcatcacgctggcgttgagtcaccacacgcattcagcaatccttcagtataccacacttctcacacattgtgcccgacaagcaacaccatctaaacatccccccttcgtcaacatcttacacttgtctcagtccccacacgcaggcaaccagactcgttatgtgcaccacgtcagtgcaacacacaaccatgtggatcgcagcaagagtcacacaagacatgttcaacgacccacatcaagtcagtgcacatcaaacacagcccagcacaagcacacagttcagagcacacagctgtctcccaagcttcctaagcaccacacgtagcttaagacaacatccgcaaagaaccattcatcaaactgacaacagtcctcgacacagcacaacatttgtgacaccaaatcgtcatacaggccctcattagcaaagcaaactacatcgtacacgatcactcaacggtcacacacatgtcaaaacaacttcatcacatcccgacattacagccatgcgatccaggcaatcacacacacacgtggaacacgtggacaccacagagccaagccatgacccagcaatcacactaaccgaaagtcacaagccaaaacaaaaggtcccattacatacaaaccacctcaactgggtcaagcacccgaacaacaggagcacggcaccacctgaagcgcacacgcgctacacacgacacagtcacacaggaacgctcgcgacgacatctgttaccccgcgcggttccaccacaaaacacatctactgatctaaagaatcagcccaagggatcagaacgggcacccggctcgtgcacaagcagacacaccacgtagtaacacagcaccagcggaagaccccaacccgggtccacggcatacactaacccggggtacgtaaaatcgatgacggaacacagcgagccaaacggggacaccgtgaccacccagaacaacgacgacacaacacagaacaaaggagacggacagaacaaaagcaactcgagacacaaacagacaaagaacaaaacagatgagacaggaacagagagcgagacacacgacagcaacaaacagaacgggccaagcctgacggacgcaacagcaacagccagcagccccctagagcagcaagcacgcaagacgcaagcgagaacaaagaaagagt

SEQ ID NO: 679290 - DNA, 258 bp, Homo sapiens
  misc_feature (26)..(26): n is a, c, g, or t
  misc_feature (91)..(91): n is a, c, g, or t
  misc_feature (128)..(128): n is a, c, g, or t
  misc_feature (142)..(142): n is a, c, g, or t
  misc_feature (147)..(147): n is a, c, g, or t
  misc_feature (170)..(170): n is a, c, g, or t
  misc_feature (214)..(214): n is a, c, g, or t
  misc_feature (234)..(234): n is a, c, g, or t
  misc_feature (247)..(247): n is a, c, g, or t
acccaatgggcagcagtgtcaacagnacgggagtccagtccagggtgggtgcccttgttcattgaggttagggtacagtctatccccaggnttatgtcctgggccccacccagtcagggagttggggntccccccatcaggnctgtnagctctgtgggccctgggatgtnatctagctcagatgccctctcatccttgatgtcatagttgagtncacccaagtggcacccactngcggccaggggancagcctggttg

SEQ ID NO: 679291 - DNA, 490 bp, Homo sapiens
  misc_feature (10)..(10): n is a, c, g, or t
  misc_feature (12)..(12): n is a, c, g, or t
  misc_feature (43)..(43): n is a, c, g, or t
  misc_feature (90)..(90): n is a, c, g, or t
  misc_feature (204)..(204): n is a, c, g, or t
  misc_feature (206)..(207): n is a, c, g, or t
  misc_feature (216)..(216): n is a, c, g, or t
  misc_feature (219)..(219): n is a, c, g, or t
  misc_feature (225)..(225): n is a, c, g, or t
  misc_feature (235)..(235): n is a, c, g, or t
cttgaagcgncngctgctctgtggggctctggcgcgcatggcntggccgggaccatgtgcgcgtccgggacgactggcgctgtgcatccnatgcacgagttttccgccaaggacatcgacgggcacatggttaacctggacaagtaccggggcttcgtgtgcatcgtcaccaacgtggcctcccagtgagcaagaccgaagtanannacactcagntcntcgacngtgcacgccngatacgctgagtgtggctttgcgagaatcgatggccagtgcccgcgtaacctaggatcaggaagcaggacccagggagcaacgaagagaccaaagacaacggcccgggttacaacgtcaaattcgagaagatcagcaaaattggcgtgatcggggacgacgtccaccccctgtggtagtggatgaagatgctacagccaggtaatggaatcttgtgatatgccactgcaagtagattctcattcaagctatcatc

SEQ ID NO: 679292 - DNA, 649 bp, Homo sapiens
cagcctactttggtctccaacacaatgaccgctcgcacggcagaccacatcggtggcaagtacaccttggggttcatgtcagatccgagagaagcttgatcagcatgaggaaaaccgtcgcagaaaacgccaggacgaagagaaatgcaggatcgctttgaggaggagaccgacggatgacggcgaactgggaggagacgttcatgagcgaggagagtgcagggatacaagaaaccacagaagtactccgccaggacgcggtcaccagtctacaccagggagtacggcgatacggaggcggtacaagaattaaatacctccacgaagagtcgacggacaacttgtcccggtacccgcctcccgagatagacatcggcgccaccgcagccgttcccggagccacagccggggacatcgatcgggcttccacggcgaccgaagctgcgaaaagcaagattctaccagagagcgggcatccagagaggagtcctgggagagcggccggagcgagcgagggcccccggactggaggcttgagagctccaacgggaagaaggcttcacggaggtcagaacgagaaggatggccggcgagatctgaacccggtcttcccgggtgctgtaaatatacgctaaaggtccacacagtc

SEQ ID NO: 679293 - DNA, 364 bp, Homo sapiens
gcacgaggtcagtcacatagccccagatgggctgcttaggattgggaaaagaaagctgggttagaaagtctcatgctgctggccgggtgcaatggctcacgcctgtaatcccaaactttgggaggccgaggcgggtggatcacctgaggtcaggagatagagaccatcctggccaacatggtaaaaccccgtctctactaaaaatacaaaaattagctgggtgtggtggtgggtgcctgtaatcccagctactcgggaggctgaggcaggagaatcgcttgaacccaggaggtggaggaggttgcagtgagccgagattgtgccactgtactccagcttggtgacagagcgagactccgtctca

SEQ ID NO: 679294 - DNA, 148 bp, Homo sapiens
cagtatccgccatgaagcctgtccagtttggaaccgttcctctcctgtgcacagaaacagagaagtctggcctaggaggtggaggatgcagcgcaccaagatcgcaccactgtactccaggatgggcaccagagtgagaccttgtctc

SEQ ID NO: 679295 - DNA, 530 bp, Homo sapiens
  misc_feature (382)..(382): n is a, c, g, or t
  misc_feature (497)..(497): n is a, c, g, or t
agctctctctgtgggggccaatattcacatcttaaagaaaagaattttcaacccagaatttcatatccagctaaactaagcttcataagtgacggagaaataaaatactttacagacaagcaaatgctgagagatttggtcaccaccaggcctgccctaatagagctcctgaaggaagcactaaacatggaaaggaacaaccggtaccagccgctgcaaaatcatgccaaaaggtaaagaccatggagactaggaagaaacggcatcaactaacgagcaaaataaccagctaacatcataatgacaggatcaaattcacacataacaatattaactttaaatgtaaatggactaaatgctccaattaaaagacacagacggncaaattggataaagagtcaacacccatcagtgtgttgtattcaggaaacccaccccacagagagagcggacgctctctctgtggggaaaagaagcacccagaccccgcgcccggntgatcttgcttcagtccttgaatcacctgtggg

SEQ ID NO: 679296 - DNA, 369 bp, Homo sapiens
gtcgacggtacatccaacgtcgcattgctcggatgcttggtgtacctcgaatcactgtacggatgctatcagaccctttcgggagacgggttcctatacgcggagaccgagacaaggccgtcatcggtgcacatcggttcaggaggatcgtttcattatgaacaatgtattgagaaatccctttaccacagctcccgaggttagaactcgcctatttgaagtgagaaatctcagtgtaagtgaacgaacagcgagaagaaggttgccagagaggaacctaactgcgtttcgtccagcacgtgccccagaattgctcacacagcaccgcagaggtcgacgcggccgcgaatttagtagtagtagtcgacc

SEQ ID NO: 679297 - DNA, 1181 bp, Homo sapiens
ggggggtggtgaagggtcactgctgaccggaggcagctctgccagtgcagttgtcatcagtgggcttcacgtttgactgacagcccaccagcgtcacctcctcagccccgagctggaccgtgacttgccttgtggatcacggttttccatcttcctagaggcacgcagccccagactggagtgcacgcaggtccgacggacggtgggcgttggactctttgctgaggaccccggctggctggcccggggtgatggcggcctgaggctggcggttgcggcgggccggaggtcgacatggcgcgaggagcaggatcctactcggaggtggacgctgagccccgttgggctcggcaggagccccgtctgtcctgttcccctggggatgcgtcgccctcgctagggcccgacggcgggccgagcggctggcatcggagcctgcgaggccagtgcccggaggctcaggcgtagccatgtggcacaggcctcccaagtaaatgggagccaggcaagaggaacgtgcgtaggtcggtgtaccgcagtaatcataggttcccccgctggttgcaatccggcgaagaggctcgattccatgtgcccagggatgacttccagccgtgcttaaccgaacttggcatagcgttgagttgtccccaatggcccgcgttggccgcctggtttaacctagtgacacagtctaaaatagcaaagcccgcccacggttccacacgcgtgtcctcaatggaaacggccttttacatttgggtttgtttggcggcttccaagaggtcaagaccggccagccagtgaaaagcttacggcaggggaacaccaaggctaacccctggcaaacccttggaaccaaacacggccttggacgcctcccacggccaaaggaaccggcttggggtggcaaaggacttccttagggaggggcttctgcttttgaacatccggcaacgatcgtttgaacccaaaggccgtctcccccctttttccaattcggaaagtgaagtggcgttgatggccggggcttcccgattaatggccacaggccacacacagaaaaaaaggagcacaaccccggggagcttaacaaaggataacccaagaccccagggccggacgggaaagaaaccggggaaaccggggccggtcccagtgggcggaaggggcgaaattgc

SEQ ID NO: 679298 - DNA, 161 bp, Homo sapiens
gggaagccacacgctgcagtaagcagtgatagagaccactgcactctacaaaaaataaaatcaaattgaaaattagccagccatggtggtggtgctgtcatccccagagctgcttgaggaggctaaggtgggaggattacctgagtcccggaatttgaggc

SEQ ID NO: 679299 - DNA, 134 bp, Homo sapiens
gggtcacatatcatctttgcaaggagtacacagagaggattattctccatcttactaatagaactgcggcccagaaggaaatcccttagtgtctttagtggataggaacacagttctagtgatagggaatgcta

SEQ ID NO: 679300 - DNA, 449 bp, Homo sapiens
aaggaggcatggactgaaaaactacttattggctaatattctcattacctgggtcacgcgatcatttgtactccaaacctcagcatcgtgcagtaatatgcatggaacaaacctgtgcatgcaccctctggatctaaaataaaaggcaaacatgttttttaaatgaatgtttgctctcaaaacagtttccaggcagctgtgaacttttcattaagtgtttaatcttgaaaataatttatttccattttatcctctatataaatgaccatttcttaggtcctagctgttaagcctaaattggggtagactgaataatggcaccccagatatgcccacaacctatgaatgctaccttttatgacaaaagggactttgtagctgtgcatgatattgtgaaatatatatttggtcttcctcccagtttcctggcatacaacaactaaaatcct

SEQ ID NO: 679301 - DNA, 688 bp, Homo sapiens
  misc_feature (120)..(120): n is a, c, g, or t
tgaggcaatctcagtaacccttaaggccattagtctcctggtcgtatataaggggaataaagaacaagacccaacccgattattctggtttgggaaccgggtcctaaggtgaatgaaganacgtcacgaacttgacgacgcacggccttgcataggtttaagtgtgcactataggatcatgtgcaaacagtgccaaagctacacacttccatctagatcttgcagaataataacctgaatttgctcagaggcctgtctgtgctctttgcccatagcctcaggatcagtccagtctgggtcggtgtggtcttattaccatgaagcagggtcattcagagttcatgaacatcgtcgacaataacattgggtcaaagaacccttgtttggaatgccaactgtgggagaccctcctgctctgacctgtggcccctgagaaaggtggtggactcttctaacggcaggggcccctgcgtctgtgtagaccatggggctcagggtgattgaggtcgtgcaaggccaaggaccaggtaagaaaggcggttttcagggcagggccaccaagatgagccggcggatgtaggctcaggcgcttctccaggactacatcagcgcgcagagtgctacgcagtcagggcttagggcactcccctcctgtttccacaggaatctgttggtcaatgttatagat

SEQ ID NO: 679302 - DNA, 322 bp, Homo sapiens
ggtcgacagaggttaccaggaactgtggggggacaatgggaagttattgtttaattagtacaaagtttcagtttgggatgataaaaaaaagttctgaagataataggggtgatgggtgcacaacactgtgaatgtacttaatgttgttgaactgtatacttaaaaattgttaaaatgaacaatttgtgttatgtctattttaccataatataaaaaatgtaaatgaaatcgctctgctttgcaatttataaaatgcttttccaaaaatatgttaaaacttttctaaatacagtaatttctgaaaacttaatttattcattat

SEQ ID NO: 679303 - DNA, 1660 bp, Homo sapiens
  misc_feature (757)..(757): n is a, c, g, or t
  misc_feature (1092)..(1092): n is a, c, g, or t
cgttctgttgtgggtcgcgtatttgttgcgtgtgtccacccttgttttgtggggtagtttgccttcttgctcctcctgctgggttggtctgttgtccctctccgcgggcgtccctcctaggtgtggctgtctgcccgggggtagttttcgttgtctctctctctcgggcggccgctctttgctctctcgggcgttgttttgttgccccgtgttgcttcctgtctgcccgcgtcgcccactgttgttccacgggtgggtcagcgactgttcttggggcgctcctttctggtgcaggttgtgcgattcgcgccagcacgtgcgcgggggaaccccgcgggggggcgccccccacgtgtgttgcatcgtgttggcgccccgtcgtttttgttgctgccgtgtgtgtctccccctatgctcgccctgttgtgatcaccgttttggtgggcccgggaatgtcccccggtttttctgaggcgccccacccggggtttgctccccggtttctaatgaagcgctcttcttggggagaaacaggctttccccccccgttgttgtgccccccaccacggggcggttttgctaaacatggtttatggctgcaccctattggcgggtttttttttcgtccggagggtgtgtcctcttgttggtgtgttcacctttgagcggggcctcttttttggggggggaaaagggacacctcccaacttggcgtttatacgccccctgtgtggtgccccccacgtgtttgaagggngagcgtaaacgcctctcctctcctgggatgcccacgttgttctgttgggtctcccccccaatgtgggacgccgccgcgagagtgtcttcttggttcgcgctctgctggcggcttctgtttctgttcgcacacagttcctcagggggtgcacacatgggcccttgttctcgtggccctctcgagaggggcgttctttatgtgcccatatgccccacacgtgtggggagcaggtacccggcagcattagtgtgtagcacacctccgcgcgtgtgggtgtgattatgttggcgcccacacatctcgtgtttgccccttgtcccccttgggagcacccncccccgggggagtatctctggcgtctctctaaggtgtttgggagctcccacatacgctcggagaatatttgctgtgtttatatgtgtgtgtgaattatattacattgtgttatatgtcaaagaaagagttatatacgtgatatataataagatacaccccaacactcacatgtagacccctcttcttggggtttctttttgcgccggttgtgaaataagatccccacacatagtggtgccatccagagaaaatataagcccattctcctctcatcaccccatatatatagagatccagcctcccttgcacctcttgagagggcccgagagatgcttctctggtggtgtgtatttgaaatcccttctctgcccttgtttccatggccacatgtgaataccctctttggtccctgtccccagatgtcatcttttccacatgatttcttgaatccatagttcttagattgccttgaccctgccccctgggtccccgtgttcatctgagcataacctgtacttaatcccttttcccatatccagtataataaaggagtgatgtcgccaatta

SEQ ID NO: 679304 - DNA, 159 bp, Homo sapiens
  misc_feature (6)..(6): n is a, c, g, or t
  misc_feature (8)..(8): n is a, c, g, or t
  misc_feature (33)..(33): n is a, c, g, or t
  misc_feature (69)..(69): n is a, c, g, or t
  misc_feature (104)..(104): n is a, c, g, or t
  misc_feature (113)..(113): n is a, c, g, or t
tcgcgnangtgttatcctcgcgaacgtgttatncctcgcgaatgtgttatctctcggctataccttgtntacattggataagacgttcgcgagaataacacgtncgcgggatnacacgttcgcgagtggtaccgaagctcgaagttcgtacatcagtgg

SEQ ID NO: 679305 - DNA, 223 bp, Homo sapiens
aatgccatattcaagctgtaactgttctctttgcatacagactccgtgtaacttgtgtgaacacttgggatttttctcctctgtcccgaggtcgtcgtctgctattcttttatgggtttccttctagaagattgcgacgtgcatatgacagggctgagagcacctcctcaaaacaaggctgaagacgaggggtaccggagctcgacatttcgtacaatcaatg

SEQ ID NO: 679306 - DNA, 412 bp, Homo sapiens
aagagaagtattcagtctagatgcagacttcccgtatggagctcttaggggcataatatccatccagttagtcatttccacaggcgtgataaactaagcgcacagtcaacgggccattaatagcatagtgagctagatttgtggcatcctcagtattaagtaaacagtgatggtgaacgtcactgttcagaagaagtgggcatctttgcctaatgtgcgtgcctatcgcaacagtcttagatctgcaagggcccttagagatcatctattcatctggtctactcatgttgcaatggtgaatctcatagtagacctgcgggtaagagagtaggtgaagaaggagcatggcattagagcggagtctatcaatataatacctggcaggaactcatgtggatgaagagtatactcg

SEQ ID NO: 679307 - DNA, 262 bp, Homo sapiens
caaacaaacatttcaccaaagtctattaccaaccattaaaaaatacagttcttactacaaataccacgattctatatatgagatatgaagaaacatgatgtttggttttcatatcttttgatacagctgcatggtaaaaggatttaaatgcagaatatcagactctaagttagtcccacctatggagccagacaaccatgagtgaatctctggccaaggaggccaagtacaggaattctgcaggtgtatccatcagtcttcc

SEQ ID NO: 679308 - DNA, 761 bp, Homo sapiens
atgccggtgcagcggggtggtgccggggtgccctgagtggccctgggatggggaaccgcggtggcttcctgcggagtgtttcggcagtggcatcctggggccggggtcgctggcctgtggacaggggccggggccgatggccgctggagctcgcggagtgcaatggcctggaggataagtgagtggatgccctgtcaccaagttgtgtgccgcttggtcaatggacatgaagatcaagtccctgtgtatggagatctatctcttctcccatgcctattaaggaatcagagatcatttgattttcttcctgtgggtgcctctctcaaggatgaggttattgaagattagtagccatgttgcagaaagcatgacccctggtgcctgtgccaggctgcaaccaatgtgttcaaagggcatttttggttgctattctgggggactaccagcaatgtgccacagtcgggacattgggttgttaaagttggctccagatggatgtgttggccacctgccaataccaggtggggtgcccatcaatccttggccaaggctctccaatcggtccccgtgcgcatgagtgctaattggggggaacagagatcggaaagccccacacgtgtcccttgcaaggtgacaggccagtgcgggatctagtgcttggtacagacctcatcccatggaccacaggtgcagttggcatcagcatccgaactgtgacaaagaagatggaaagaaagatgtacagataatggaaaatcaaa

SEQ ID NO: 679309 - DNA, 872 bp, Homo sapiens
  misc_feature (697)..(697): n is a, c, g, or t
gaaaaaaatcaaacttcaaaataatctacaaaaaaacaagtatcaagggcatgaaagacaaaaagaaaagctgaattttacttttttaactttttttattttgggaaagggagtttggcattgtcgccaaggttggagtgcaaaggcgtgatctcggctcactgaaagctccgccgctgtgggttcacgcaattatgacttgcgctcagcctcccgcaattagctgggactaatgggtgcccgcaaccacgccagctaaatattttaggttaattgttgtagctagaaaacggggtttcacacggtttaagctagagatggtctccatctcctgtactcatgatccgcaccgacctcggacctctccacaagagtgcggggattacagagccatgagtcgctcgcgaaacccgagataagaagaagatctacaaagaagatgtctgcatgataatgtgcaatatgtgaccctgatttggatcctgagttaagaaaacactttaggtggaaccatgagacaaaattttgtcacatgaaggtctgctaggtaagtaactaattcgtgtatcaatcttcctaagtgtgagtaacggttacgtcttgagaatagtggggtgttgagcgaggtaaagaaaatgcgtgggtgtgagagaagtatgtctgggaaatctctgaatgttttgaaaatatattttgngttagaggcttaaaaggtagtttcaacattggaacaaatttttacacactacatgggaattgacgaggagaaaaaaggcatagggaatggaaatgttcagaaaagtatgtgggcgctagattttgaaattccgtgggctccaatccgcgaaaggccttttaaaattgacaggggt

SEQ ID NO: 679310 - DNA, 302 bp, Homo sapiens
agtagccgtggctctatatggcatcagctctgctctctctgtggaccggctcttgtcccttgtactgcactggccataccgtgcctgccctgccctgccctgactcagtcctggctcagcccctggcccaaccttggccttggcattgcccctggtcatgccatatttcttgcggtgtccataccctggccttggctcttgacccttacctttgatgtggccctgcctttgccctaaacgcatgcccttggccctgtcactggccttgcccttgaccttgtacatggcccttggcatttcgc

SEQ ID NO: 679311 - DNA, 357 bp, Homo sapiens
  misc_feature (136)..(136): n is a, c, g, or t
attcgcggccgcgtcgacgaaccccgaagcggaaggcgaagaaacggaggcacaggatccgaccccgaacgcctgattgcaccgggctctgctcctacagattcagggcgtaccaaaacccgcgctcgacgccaanctgtaggagccgggcttgccgcgaaaaggccctcaaaaccgccaaaagcttcgcgagcaagctctgctcccacaggttccgtagcgttttcgaagtcatatccggcttagctgaccgaccgccccacatcccccatcggcatcaccgtcacctggacttccgggtcatggttgccgccccccagaatcaccccgggcgacgcggccgcgaatttagtagta

SEQ ID NO: 679312 - DNA, 216 bp, Homo sapiens
aatgtgttctaggacacttatggataccaacatctctggatgctcaagtccctgatataaaatgtgtgtgactatttgcatacaacctgtgtacatcccgtattattcaaatcatccctagatcacttatactacgtaatacaatgtcaatgccatgtaattgactgtactagggtgattagggaataccgaagagatgaaaaatgtacatgtgca

SEQ ID NO: 679313 - DNA, 790 bp, Homo sapiens
ggaatctccaactcccaggttcaagcgattctcttgcctcagtctcctgagtagctgggactacaggcgcgtgccatcacgcccggcctagtaaatttgtatttttacgtaagaagacggggtttcaccatgttagccatggatggtctccatctcccagacctcgtgatccacccgtcttggcctcccaaatgtgctgggattacagtgcatgagccactcgtgcccggcagattctttaccatatatgtatagatgttcagatggtgttcttttaacagcaggagggccatgccagtttaggaagcatatttcactgggaaggttagctgggatcttattaggtatttagttggtttacatctacggaataattttgtatttatagtagaaccattttctttaggtaatagaagtcaagtcagtgctaaaaaagttaacatgatttaagagctttctgtgtgaacctttaggcaatactatgaaaccttgtgtcagcgttacttaaacacttgtaaaacttgagcactttcattttcccctaccatatgataagccttccccatctctatagaatgggcactcttatgaagtgccagttgtcaaaccaaacactgtggggcgggtacttcattcttactccctcaattatcaatcttgccacatccaaagttaatcgggtagcttcccctataatctccaaaacaatggggcaaattctcccattaactaatagccctaagtgccggagtcacttggcaccctataacgcattctattcccaggagga

SEQ ID NO: 679314 - DNA, 411 bp, Homo sapiens
  misc_feature (411)..(411): n is a, c, g, or t
gtaattaagggaaggggatgcggtggagagcgcatacagaaaggagaagacgggatgagtgagggcaccttacgcttatagaagagcaggaggagtatatacgggaggatatagaatgggctcacattgactacttcaataatgcgatcatttgggacctaatagaaaataacacaaagggaatcctggcgatgctggatgaagagtgcctgagacctgggacagtcactgatgagaccgtgtgaggcggaaccaagtatgtgccacccaccagcatgatgaaagcaggatgagcaagtgctctcggatactcaatgacacgtacttggcacagaggtggttgaggagccagcattatgctggaaaggtgctgtaccagggggaaggattcgatgacgcgccttggtcgcn

SEQ ID NO: 679315 - DNA, 272 bp, Homo sapiens
atatagtccgctagggatagtgaaaaatttggggcttggtttagattggagaggtatatggtggggtgtcttataaggcttaactttgggagggcccagggccttgatttctgtcccccttgccttgcgtggcctttgaattgaaagctttgaattaggccttcatagattttagtgtgcatacaaataacacgatctttttataaggcagattatgattctgaaggtttagtgtgggacccaagctttcgcatttctgatctataaggtga

SEQ ID NO: 679316 - DNA, 244 bp, Homo sapiens
aggcattgtatcatatcttatgcctttgtgtcctcatagtttagctcccacatatccgtgagaacattgatgtttggttttccattgctgaattacttcacttagaataatagtctccaatctcatccaggtcactgcagttgctgtatcccagaggttttgataggtgtcattaattttgttaatttttctcttcaatttccattttgattttcaagaacaagttaggaagtcggagagggag

SEQ ID NO: 679317 - DNA, 740 bp, Homo sapiens
  misc_feature (555)..(555): n is a, c, g, or t
  misc_feature (557)..(557): n is a, c, g, or t
  misc_feature (559)..(559): n is a, c, g, or t
taatgccaaaggaaaaaaaagaacccaaacctcccttaaggaggaaaaggagaagtgggcccccaaaacaaagcggagaagcaagaggtcaaaacgaaaccaggcctaaaaggctgtgtttagcaccaacccacaacaaaaggtgggcagggaccgcaggtatcggaaaggaaggccgcaggaagaaaaagtaaggaccatggaggcttcttcaagaacccctgaaagaatcaaatcctccatgggagcaaataaccaaggcgaggggactagagggacgatactgctttgcaaacaaaagctctatgaaggggcacaggaagatcacaatcctaaaattcaacaagctccaccttaatcccccaggcatcagaggcatcatccagagtagactgcaagatgagagcaaaatcttcacagcaagagaggatctgagaaagattcttggtgcacagaacattcatcagagaagtatgtgccaaaagacgggttgatgagacagagttggagatatatgcagcagccagggtagcattctcaacgcggaaatagagnanantagtacccccccccgtcaaaaaaacctgtgtgaggatctcctgaggaggaacatcaaatgaaatagttaccatgaccacattgatgaaactgtcagtgtatggctctctctctctctctctctctctctctctctctctctctctctctctctctctctctctctctctctctctctctct

SEQ ID NO: 679318 - DNA, 265 bp, Homo sapiens
  misc_feature (110)..(110): n is a, c, g, or t
gggggtggggaagggttttttccccccacctggggcagggggggcctggccccccctttttgttccccccttgttgggggggcgggggccccaatttttggcggtccccnccaggggggctggggtccgtcctgtttttgggggggtttgggggggggggcccttcccccctccccccctttgggggtccccccacctttggccggctttccggggggtgggattttatggccccggcccattaacctttttttggggggggcca

SEQ ID NO: 679319 - DNA, 923 bp, Homo sapiens
  misc_feature (1)..(1): n is a, c, g, or t
nttgaccgacataacggacggaggacttttaaaatcctgacatgtccaccggtacaaacatgtttgccaaaacctgggttccccccattgcgtgggcacaaaatgggcagtgcccgccatttcccgggccgccgttatatccccccgcgtagttgttccaagcagttcaacggccaaaaccaaatgtgttccctttaaaaaaagagaaattgtttctccaaaggaggaaagatgttgaaggtgtccccccgctcctagcaggatccgcgtatctttgtgtgtgttcaaaaggaggaacatcattggccatcaccgcgcctgttttggaaaccccgagttgtccctcttcttttacaaaaagaattttgggtactctaattctttcgtttgtttacaaaccaacgctttcctggggttccacataagcacaaactggtgtatgctcccccaagaactgtctataccattttgtgtttcccccccttgataatagaatttctttttccttgaacccctctttaacaaaaacacaatgttccctccttctctccactacgagaaaatatatcataataccgctgttgttctactttttctcgcccggaaatttataggaagatttaaggggccaatcagggtctgcgctacccacgtctgccaccacccctataatttggtacagaatgcctaaattgcggtaaaagaaccccccgcatccttgggagctcatgtaagaatgagtttaacacacaaggaaccacacttcttcggactcatgtagtgccttaaagcccctatattaaaataaactatggcggagtaaagacgtaatgcgataggcagaaaaattatttttctgttagtaaacccgagaagggttatttaatcttaaaaaaactttggggcccccaccaaaaaaaaca

SEQ ID NO: 679320 - DNA, 935 bp, Homo sapiens
  misc_feature (1)..(2): n is a, c, g, or t
nngggtctctttctggtttgttttctgttttagtgttttcttgtgtggcttctgtgttgtgtgtagtgtagtttctctggggaggagaatagcggtacagagcggggatggtgtgtatggcaagagcagaggtaatgaacttgaccgagtagagatgggtagttgggggcgcttacgaactgacgaacggggtctctctgcgcgttttgtgtacgcgcatcctatggggccgcttcccggtgttcgtcccgcggcccactctaccaattgctggcgtatgaggatagtgttccgccgtgcgtggaaaaccggtggtgtcgtccctcaattttaagccgtgcggggagcccccccctttgtggtataggtgtcgctcgggacgacacagttgtggtgagacgcttctaagagagaacacacccttgggggcgccttccgttctcggaattgagaccacagcaactaatcgctggggggtgaacaaacaacacagtggggcaacaaaggggcttgtgagttgcggcaaaggagcgcccactttttggccccggaagcttctagtaaggctttaagtatgagttttctccccttatacgtttcgcgctccccgctgtgtaaccacggtgggggaaaacagcggtttcaaagacgtgttggtcgtatgggcgcgcctgatgagttgtagttggagaaaacggggcgttatgatacacccaaggtgctggttaactcttcttcgagggaaaaggaggaagatcttttgtcgggaccacccaatgggggtttctttttttcgcggtgtgcacaccttttaaatatattatttttttaaaaaccacaacctttttaatgggaacacacacctctgccccacaaattttgctccacacaaaatttgtgaggccccccttcaaaaagtttaaattagagagaga

SEQ ID NO: 679321 - DNA, 136 bp, Homo sapiens
gcagcgtgtggcttactgtgtatgctcatgcctgtatgtgcccacatctgccagtgcctgtgtctgtgtgcacgtgcatctctgtgtccctgcatcacgtgtgtgcctggtactctccgcgctgtgggtctgtggt

SEQ ID NO: 679322 - DNA, 133 bp, Homo sapiens
cagctactctgcaggctgagacagaaggatagcttgaacgccaggagttcaaggctgcactgagcaattcaaggctgtagtgagctgattgcaccattgtactccagcctgggtgacagagccagactgactc

SEQ ID NO: 679323 - DNA, 114 bp, Homo sapiens
cccgctggttctactcttctgaaaatatctccaacttcaaccatgccctggagtcaaagactgctgccagctggggctggaggtgatcagcagcaccttagaccatgctacagc

SEQ ID NO: 679324 - DNA, 364 bp, Homo sapiens
ctgctccgcccctctctggctggtgttctggagcgtgagcgaccaatgcgtctagctggggttctagagcgagagcgtccacgtctggctggagttctggagcgagagcggacacgtctagctggggttctagagcgagacctgccacttctcctgcctggcgatctactacgagacctgcgctgaactgacgatcgctgcctagatctgcgcctagcaggtgttctagaccgagacctgcccctccggactgatgttctagaccgaacctacgcctggtgggagttctggatcgtgatctccgcctggcaggtgttctagagcgggacctgccccggcgggctggtgttctagaacgagatct

SEQ ID NO: 679325 - DNA, 856 bp, Homo sapiens
aaaatcactatctttatctcgctgtcctttctagagacactggctaccagataggtgtattataaggcttgggacacattggtggatgtcccgtgtcatgaacatcctagctgcgccatgctctgcaatccgccacctccgcgtagtactgctgtggagtctcgagcacatctaccagcatagagctgttacatgacagatgattcctggtgattctgtacagcatggaggtctcttaccatgggtacccatatactatttatcagatgtgaatgattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtcagatattggacaaagaaccttctctatggggcatcctctttttccaacttggctgcaggaatctttaccaagatgcttttaaccagagtctgaacctatttcttaaacaccttgcaacctacctgttgagcatcacagaatgtgctacaggaaatcaacttgcttatcaacttcctaaatattatgagatgctggcttgggcagcatccccttgaactcttcactcttcaaatgcctgactagggagccatgtctcacaaggtctttacagtgactaattggccttgcagacattacacacacattctcagcatcacggtcccactgccctgatgcctctgtccttctggcatgggttttccacattagaaccaccaactgacaacagttcacataacttcactctgactgttcttatgcagacaagcctctctcga

SEQ ID NO: 679326 - DNA, 817 bp, Homo sapiens
  misc_feature (3)..(3): n is a, c, g, or t
  misc_feature (65)..(65): n is a, c, g, or t
  misc_feature (71)..(72): n is a, c, g, or t
  misc_feature (84)..(86): n is a, c, g, or t
  misc_feature (107)..(108): n is a, c, g, or t
  misc_feature (111)..(111): n is a, c, g, or t
  misc_feature (113)..(113): n is a, c, g, or t
  misc_feature (120)..(120): n is a, c, g, or t
  misc_feature (149)..(150): n is a, c, g, or t
  misc_feature (189)..(189): n is a, c, g, or t
  misc_feature (193)..(193): n is a, c, g, or t
  misc_feature (200)..(200): n is a, c, g, or t
  misc_feature (203)..(203): n is a, c, g, or t
  misc_feature (230)..(230): n is a, c, g, or t
  misc_feature (244)..(244): n is a, c, g, or t
  misc_feature (260)..(260): n is a, c, g, or t
  misc_feature (267)..(267): n is a, c, g, or t
  misc_feature (314)..(314): n is a, c, g, or t
  misc_feature (336)..(336): n is a, c, g, or t
  misc_feature (352)..(352): n is a, c, g, or t
  misc_feature (368)..(368): n is a, c, g, or t
  misc_feature (545)..(545): n is a, c, g, or t
  misc_feature (547)..(547): n is a, c, g, or t
  misc_feature (669)..(669): n is a, c, g, or t
  misc_feature (809)..(809): n is a, c, g, or t
atnttctccccacttcctaaacaaaataaaatagcctccccttgaacacgaagacctcaaaattntaaaannaaaaaaaaagannnccaaaaaagaaaaacaaaacnnccncngaaagcnaaccaaaaagaaataaaaaaccaacaacnnacaaaacaaaaagagagagaaagaaatttttgggggggnagangagaccnggnggcagaggggggggcgggggggggggngagtggcgaattcnagtgccgagagggggnagggggnggggggcacagcagcggccaaccccaaccaagaagcaacggagaccnccgggcccccagaatgccccancctagtcttacccccnaccatgtcagtccttnaaggagaaagaagaaaacccaaaaagaggaaggaaaggggattgaaggctgacaatcccaggctggctctgggcagggaagaaataacctggggttttgtttaattttccctgtccttaaaaaacatatttaaaggaaaaaatgctttttggcagagagaggccaggcatctccgtntnagcttcctccagcccccggggccgaggcccgccctggggtgccgatgctcccacacgctctgcgacaccccagccccgggacctcgggttgagtggcttcgttcaaaggtcgatttacagtnttgaaaaagaggtcataaaagagacccaaatgacatcgtaattttgtaaaaatttctcactcattcgcccatgtctctccctgtggctgccccggctccctccagcccccagaagggagaggagggctgggggggtagtnagggaagc

SEQ ID NO: 679327 - DNA, 168 bp, Homo sapiens
cagctcggactgtcaagtgcatctagtacaacctacgcgaaaatccatttcactatcatattcatcggacgtaaatctaagctttcttcccacaacactattctcgagcctatccggcaatgccccgaacgtcacttagacagggcgatcctgctaggacgtcgacct

SEQ ID NO: 679328 - DNA, 122 bp, Homo sapiens
ttggctgggtgctggtggtgcccttttcttcctgcaccgtggaggtggggatctagccaacagccagggagcactgcagaaagtcttctgattgtcaccctggtaccctgtgtacctgcttc

SEQ ID NO: 679329 - DNA, 315 bp, Homo sapiens
agaggccatctctcccaaaagtacaaagtcagccaggtgtagtggtgcacgcctctggtcctggctactcttgggaggctagaggctaggaggatcgcttgagcctgggaggctgagactgcagtgagccatgatcacaccactgcactccaaccttggtcacagaaaccccgtcctccctacaaaaaggagggggatagacggtaagcgatctaaactgaaggcgagcggggtacggtggaacaggtgtgagacagggcgagagagacaacacgcgagagagagtacacacaacaaaaccaaaaaaaaaacgac

SEQ ID NO: 679330 - DNA, 404 bp, Homo sapiens
ttgttttatactcagtacctcttttaagaaaaagtgacaaggaagtaaaaccaaagtcaggcagcctggtgccaggcctgtatccaggcctgggcctgtctggcctaaacccagtagttaaaaatcgactcataacttagaaactgatgttattcatagattccagacattgtatagaagaacattgtgttactccctgccctgttctgtttctctctgacctctggtgcatgcagcccctgtcatgtaccgcctgcttgctcaaatcaatcacgaccctttcatgtgaatctttagtgttgtgagcccttaaaagggaaaaaattgagtatttgggaagcttgaattttaagacagtagaaaaataaagatacaaaataaataaaaacattcattcaacaaaa

SEQ ID NO: 679331 - DNA, 374 bp, Homo sapiens
ccgggtccaccagctctggtctttactcttcttgaaaagcaagaaccagaaggcgagtaatcagaaagcactagcaggcatcagttaatccaagatactagctcttagtcccaaaagcactggcaaagaaaacctttgggggggaggggggggagagggatggaagcactccataagtaaggggcaatcccaggcagggtgtatgccaagtctcatgaggctatttttggaattaatccttgactgggtcagggtttttgccctcaaatcacaatttttctttggcacttttttccctcaaagtataaaaggtatgaaatataaccaagctctggcacggcacacttgaggggggcatcgataaacacggggtc

SEQ ID NO: 679332 - DNA, 176 bp, Homo sapiens
ttacaacccacgatcaccaatctcagtggttgaactacccttgatatggttcagctctgtatccccaaccaaatctcatgtcaaattgcaattcccagtgttgagggagggacctggtgggagatgattggctcatggcggctgacgccccccttgctggtctcgtgatcgtgggg

SEQ ID NO: 679333 - DNA, 147 bp, Homo sapiens
aacagacgaggtcaacgattccttcctttaccatcaaattcaatttggccaccattggtactgaacctacgagtacaccgactacggcggattaatcttcaactgctacatacttccccattattcctagaaccaggcgactgcgat

SEQ ID NO: 679334 - DNA, 181 bp, Homo sapiens
taggaatacacagcgataaacgtatgtttatactatattgtagtctaaaatgtgcgtacgctttatgtgtaaaaaaacagtgtagttaccccaattaaaaaaatattggtaaaaaatgctaatgattatcttgagccctcaggttgagtcttaattctctccggctggtgcggctggttat

SEQ ID NO: 679335 - DNA, 1299 bp, Homo sapiens
ctcaacagccccctgtcaggcgcaaccaggtggagcaccggctggaagtcgcggtgctccacctggttgcgctcaactagccccctgtcaggcggaatgctggctggtcatccgtcggtggccgcaccttccagtgccgttccagcagtgcgcgcggcccgttgcgcggcctggcgcgagccgctatccgacgcactacctgttcctcgacgcctgtccagtgacactgtacacgcatcgctgctgccggcagacacgacacgtctctacaggacactgatgccccatacgtcaacacatcaacggcactgacgtctggctgcataaccactatgaattggccacggcatcatgatacatacagagcactctgagctggctccagcctagtacacacctcgaacgagcaaacagccaagttcattacctccaacattatgaccgcgataagacgtgcaaccacttcacaattgaacgagacatcgcaccaacaacctgtagcacccccaatcaataagaaagcacgtaagatgagacaacttgagacatacagctcacacaacgcaatacagcgagccgcccaaatcggtatatataacaccgcaaaaccatgcaactacacagttgactaaagcaacagagatagtagcacgggaaaacgaggcagtagcataaccacacaataccgacgaaaaacaaagtagggcacgcgaaggagcacaatacgagataatgacctagacactagacgttgctagtctagacgacatgtcccgtagagagaccccaaaagaatgacggaccaacaccagaagatgttccaactcaagtaaaaccccataagaaagtagtcaggagctactccttgacgcaatataggaagaaaacgcaatgaccttcatcaacatgaatattttggagacacccctaaacctaaaatcacaactagggagaacacgtaaggaatataggctaagacaaaacggagaccaggaatagcaacaatacaccatttgataagattcacatgactatatagtgaaatatgcgatagagtcttaacaaattgatgtgtgctgatgaggaatattatcaagggtgggctgacaaagacaccaccatgaaagagcagcggaaggatatgctagggataatgtgatcacgcatacgacgaacaccaagtaaaaaggagtaacaaatagcgaattccagaaggacaagattcttgaaagagatcgaaaaacacagaaaagacacaaaagaagaggcactaagaagtggtacgctagtcgacgccgc

SEQ ID NO: 679336 - DNA, 268 bp, Homo sapiens
  misc_feature (158)..(158): n is a, c, g, or t
  misc_feature (160)..(161): n is a, c, g, or t
  misc_feature (199)..(199): n is a, c, g, or t
  misc_feature (208)..(208): n is a, c, g, or t
  misc_feature (225)..(225): n is a, c, g, or t
  misc_feature (264)..(264): n is a, c, g, or t
ggcggacccaaccgtagcacttaaaactttaaaaagatttagttcgcaacatagagcttacaacaactttattgagtattccgaagcatatttaaattacgagttatgcacggattaaaaattacatcagtgcaaaaacggcatgtattcaatatctntnnggcaacaacacacacacagagagaaatagcacgatcanaagaatcanagaataatgcgggtganttttagatgtgtcgcgcttccacgtaatggtggggatcnctct

SEQ ID NO: 679337 - DNA, 928 bp, Homo sapiens
ccaatatcatcaatccacaactcatcactcttctatgtcgatccaacacacacaccacttcgaggaaaacaggaatgtcaagtttttcattgataaactcctacctccaattgattgacgtcactaagaggccttgtgtagaagtacaccatcatcattgtagtagagtgtgaaccttttcccatgcccagtcttgaaatttctaatgttttgcagtgataaaatgttttgcaaatacatgccattaacacatatcaaataatatcctcctcctgacaaatttatgatcttttaagttcctatacatgcattcttataatatgacccaggatctactatattaaaatacatgaaccaggtacattcttttcttctaaaatgcaattcactccactaatacagtcctgacaccagattgtctattacatcattccaacattatcaactctgctacactgaaagccccgtttacgtttaatataatcagtccacatgtactcacctcactacttggctgtgacttcagcatatgcgctatacttccaccattagttgaaagtcccatcgctgccatctagcatctcctatacatggtcgatcacctcctacaagcactcctactaatcacctgaacgctgaattaacgctcgacacatcattaactccctaccactcaacgcttcatcacatcacttttccaactcctcaactcaccaccccaccaccgaatccatattcatgctcgccctccaagtaaaacataccaaaacttttccgtgtgggctgtgcaatctctacagtagtcgcatagcccgctctatcctccacacacgaccatacatctgcctcttccaacacttctatcctgaccactctcatcacacaagtctcttcctcaccctctctatctgactagatcctactctcc

SEQ ID NO: 679338 - DNA, 277 bp, Homo sapiens
ggctcgcgagcagatactcagatggtttgggctcaaagcatctcagtgccttgccccaggccttcaggcctgggtgtttggatgccagagcttgagtccgtccacgtgtgacttcagacactgccctgtccacaccgcctccccatccagcctctgcagtggattcaagggcagcccaggaggctgggagcccagtcagacacagcggagccaggctgtatctgttgtctggccatgggcatccactgaggaggcagaacggagcagggggctgctg

SEQ ID NO: 679339 - DNA, 1741 bp, Homo sapiens
  misc_feature (1741)..(1741): n is a, c, g, or t
cacaacagcagttcccactacggaccatgcgcatctgacagcaatctagacatgcatgtgtctaagatcctatgcataaaatgaaagggatgcttcatctctcagcctaagcacatcgatgctcttagttgtgtgcttagtcgactcccacgtcgataggcttgacatccgttcgtgtcatacaaatagagactaggaagtgattatcagttgcctaacgcggataagagataatacatcagatgacattcttcgttctggtcgctattagatgaattcctattatatgtaccaatacacattcgctatgaataaatgtgtataaaatttgcaataacgttatatatgaatatacctgacacgcaacacattatataacattaattcatgacaatcatcttatgtacatatataagatttgtaagtaatcttctaacacgtatgttccgagactttcgtcatcctctctcctcgtactctgaataaggggtaaggcatttaaaataggaagatatgaagaatagagtgtttagcatctaggagggatagatgccatagggtagtaagcgctaaagatgaattggtatagaacaggcattataccagattgtctactagcaagtatttctgcttcgcgattacctcataaaggcgttggagaaaagtagattattatatcttagggtgactccctcttcctgtctactctcaacggataataagatgagagacgtaatacgtcatttatcatcttaagattgacaaagaatcattgcacttgctgttcattgaatcttaagttcctacatcaatgggggagccatccccaacaattacaaagcggttgcgcccccattatccctcgtaatactttctttcattccatttataacgtccattttttacatatccgcccaacatagactaagagaaggaaccacattacacgacacaaagggcgaaggagcccacccgaggccccaggattgatggggcacttcctttacatgcgaagggtggcctaaacattaagttaaatatagcgaggcacccattaaccaacaagtttacagaccacagcacacttcagaggggcgaaccgagattaaataagaaggagaaacgccccatgtgttaaaaggggttccccacactttgagcccaagcaagctgtggcccgttgttcttaactttggggactttaagactccggttataaacagcccttgtaaagaagatagagcgatattcccttgggtgacgccaagggagcaccacaacatagggtccgccggcagtagttagtgtaacacttaaatgaaggaacgaacaggttcgcaccaattgaaagaactatcatatgtctacaagagacgcacggataatgcaggaacgcggaccactacaaggagaaggaaacaacttccagacatgtggggggatgattggggaaattaaatcagcaagggaacaatcatggatgcaaagttctgacgcatatacaaggaagtgagcagaactattcataagtagaaaagaagaaggaaaggacgaaaatagacgaatgcgaagacataacgaaggaaggagcaagaaaaaaaaagaagaagagagaagagaaaaaagagaaagaagaatcaaaaataacaatatgaaatcgagtcaggtaagatgagcaacataggaataaaagaaataacaaggagcacgacctcccatccactccgcccgacgacaggan

SEQ ID NO: 679340 - DNA, 100 bp, Homo sapiens
caagatccaactacgagctttttaactgctgcaggtctccaaggtgaacagcctctggcatgttggaactcggtcagaggtgggaactcggtcagaggtg

SEQ ID NO: 679341 - DNA, 650 bp, Homo sapiens
tggtgctcaaccccaacgccggatcaagcgtgggcggtccgcaaccctcttggagcctggcacttggcttggaggctgcccctgccctccccccccccgttgtgccttggtgccttgtccgcctcagctgtggccttaaggacttattctggcacccccttccacgggggttccctgaaagcccttttctctgagtgcctttttctccttaaggaggcctgccgagaaaggggctttgggctctgcccccctctgcttgggaccctgggtattctcatgagctcatcccagcccaggttggacccctcccccagaggcccaccccgtgccccctccccttttccgctactgagcccgtgtcatcccgctttccaccacccggtgttgctgcctattgtggtgccgcctcacggttaggggctctcacgccactctctaacctctgccctcgctgctcttggagattgcgccccccagatgctctctcccttttcccatgagggaggccccacgaatcctgagaaggtgaatgtgccctaacctgctcctctgtgcctaggccttacgcctttgctgactgactcagcccccctgctttctggggacctttcctacccccctcagcatccattaaacctcctgtctcccgt

SEQ ID NO: 679342 - DNA, 962 bp, Homo sapiens
  misc_feature (15)..(15): n is a, c, g, or t
  misc_feature (129)..(129): n is a, c, g, or t
  misc_feature (189)..(189): n is a, c, g, or t
  misc_feature (225)..(225): n is a, c, g, or t
  misc_feature (349)..(349): n is a, c, g, or t
  misc_feature (358)..(358): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (378)..(378): n is a, c, g, or t
  misc_feature (382)..(382): n is a, c, g, or t
  misc_feature (384)..(384): n is a, c, g, or t
  misc_feature (391)..(391): n is a, c, g, or t
  misc_feature (393)..(393): n is a, c, g, or t
  misc_feature (396)..(396): n is a, c, g, or t
  misc_feature (403)..(404): n is a, c, g, or t
  misc_feature (408)..(408): n is a, c, g, or t
  misc_feature (412)..(412): n is a, c, g, or t
  misc_feature (414)..(414): n is a, c, g, or t
  misc_feature (418)..(419): n is a, c, g, or t
  misc_feature (422)..(422): n is a, c, g, or t
  misc_feature (433)..(433): n is a, c, g, or t
  misc_feature (436)..(436): n is a, c, g, or t
  misc_feature (441)..(441): n is a, c, g, or t
  misc_feature (445)..(445): n is a, c, g, or t
  misc_feature (496)..(496): n is a, c, g, or t
  misc_feature (503)..(503): n is a, c, g, or t
  misc_feature (522)..(522): n is a, c, g, or t
  misc_feature (531)..(531): n is a, c, g, or t
  misc_feature (563)..(563): n is a, c, g, or t
  misc_feature (568)..(568): n is a, c, g, or t
  misc_feature (581)..(581): n is a, c, g, or t
  misc_feature (630)..(630): n is a, c, g, or t
  misc_feature (669)..(669): n is a, c, g, or t
  misc_feature (828)..(828): n is a, c, g, or t
  misc_feature (898)..(898): n is a, c, g, or t
  misc_feature (953)..(953): n is a, c, g, or t
tccggaattcccggngatgaggtagcccagccccgcgttcggctgctctcgaggaggccggagcccccggagacgatgcgccccgcgcagccgcctgcgcctgcgggagccggctgcccttgagatggngttgctgcctctttggctctgcctgggttttcacttcctgaccgtgggctggaggaacanaagcggaacagccacagcagcctcccaaggagtctncaagttggtgggtggagccgctgactgccgagggcagagcctcgcttcggtgcccagcagcctcccgccccacgcccggatgctcaccctggatgccaaccctctcaagaccctgtggaatcantccctccanccttaccntntnctggagancctnancctgcananctnccacctnnagcncatnanccgnngcnccttccagganaangtcanctgntcacttggtcctgggggacaactgcctctcagagaactacgaagagacggnagccgcnctccacgccctgccgggcntgcggaggntggacttgtcaggaaacgccctgacggagganatggnagcgctcatgctncagaacctctcctcgctgcggtccgtgtccctggcggggaacaccatcntgcggctggacgactccgtcttcgagggcctggagcgtntccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacnacgtcctggagtggttcctcgcgaccgggggagaggctgccttcgagctggagacgctggactgtctcanaacagctgctgttcttccgctgctgcccagtacagaagtgcggaccttctgctgngcgacaaaa

SEQ ID NO: 679343 - DNA, 425 bp, Homo sapiens
catctatggtataataaatgaaatattcattttacgctggaatagagattataatagcctcacattagttcaggccatgtggcaccatttctattaaaaaacattccattttcagagtgctctggtgttcagcactgttggctgaggaactgtgggcctgctccatcgcactcactttatgtgctacggtcctgtttcacaaaggccaaatatccttggctcaagttcatgcagctggtgaaagaagatagcgcaaggtatgaaccccgactctctcacccaaagcctgcacggtgcttcttctacacttaatatgaacgcaatgatcacctttacagcctctctgatagctgactgtgagtcggcaggtctgaggcagggcctgggaaactgcattcctaaagcactggggctcctggaaggac

SEQ ID NO: 679344 - DNA, 415 bp, Homo sapiens
ctctcacagccccgtggatgcagggtgctactactcttatcccgggtaggagacagagcgccgagagaggttacgtgtcgtgcccaagtcacacatgctcggctgtggccgggcttgagcatcagctacgtctgtttgcagaccccatcactgtcaccccctcgagcccgtgcgccttgggccctgccggtcaggatgtctcaaagcgtgcaggcactcaccgagcttcgtggcagtctctggaaggtcactgagctctgtgcccagaatcgagtcgggggagtctgtgcagaggtggccctatgtgtggggacagtgtgtgacacaaacactgctttggatagacacctctcccgtgacctcctagcatccaatcccaaaggaacaactgttgcagtgcatgagacgtagaaag

SEQ ID NO: 679345 - DNA, 379 bp, Homo sapiens
tgaaataggacttgctatttataaatgttgagagagaatctcactttctatctgcattgcccctcccaggaatctgcccaggaccacactttcccaccaactgatggttactacaacacgggaaaaagtaagatcaaggtggacaaccagcttccctaccacctggggttcgctggcaggagatctatccctgcctcaactgacaggaagcatcaggaacacccaaagggagaaatatccctgaggacagccagaaacaaaggaagcagagaaggactaccatccccagtcctggaaactctgctccataaattagacaaaggagatgccatatcagagtggcagttcagcagcaccatgctgtggagattagttccac

SEQ ID NO: 679346 - DNA, 383 bp, Homo sapiens
agatccccggcgcttgttaggtacaggcatacgcgtccttgcgcctggctgtcccctgtgtagcttacagctcctgttcgtggagcatggctcagcgctggaccccccaacgcacgtagttcagcctttgtccaccgaggtggctatggcgaggccaggatgtccatggtgcgcattgctggctggatgtagaaccagagcttctgctgcgaaaggagggcctgcctgtgcagttgatccagctctgactcccgaatcaggtgctccgtcaccatggggtgcgcagttgaggccgccacgggcgtgattcacctgacccgtactcgaaaggaagacttctcttcgaatcgaacctggtcacagaggataagctgtggcggccg

SEQ ID NO: 679347 - DNA, 2117 bp, Homo sapiens
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcttacctgttcacttcagagttgtaccctacggtgctcagacagacagggatggggctgactgcactggtgggccggctggggggctctttggccccactggcggccttgctagatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggcccttcaactcaggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaacttcaccatt

SEQ ID NO: 679348 - DNA, 378 bp, Homo sapiens
ccctcagattacctcaacaacatcagttattttttgtctttttgataaaaagcaattgtaacttgggtgagataatattttattgtggttatcatgcacatttccctgatgattagtgatgtcatgggttttttttatatacccattagacacttccgtgtcttcttttgagaaatgtctattgagagcttttgcccattttaattctttttttttttggctatggagttgtttaaattttctatttttccgggttattatctctctttgcagatggattgttggtgaaagagtcctctcattctgtaggttattcagaggttattcattctcttcattttgtggattgtttccttggtggtgcagaggctttttagc

SEQ ID NO: 679349 - DNA, 219 bp, Homo sapiens
tgagtcggccccttgtagactaaccaggaagcgagaatgcagttttcctctgtgatatcaagcacttgcagtgcttgtagatgctgccattgtcgaacacctgctggatgaccagcactaaaggagaagggggagatgatgagcatgttcacgcagcgtggcttcgctggctcccactttgtctccagctcttgatcgagctgcagcatcgttagggtc

SEQ ID NO: 679350 - DNA, 708 bp, Homo sapiens
taggtttgagggggaatgctggaaattgtaatggggtatggagactatgtcatataagtaatgctagggtgagtggtaggaatgtttttccataggaggtgtcatgacgtgggccgtaccggaatcgggggtatgctgtccgaattcataaaaacagggaggttaacaagtagggtctgtggtcgacaacaatattgttcgtggtagatgtccacggggagagtgcgtcactatgttggtccctaggaacgattcgtagtgggtgacggcgtgttctattattaactaactgtctcggggttctctccgggctttgacaagaactcaggcgccgcaagggcgccctgcggcgatatcccgactgttgacacgccctgagcactagctctcggacctcccctttcgggcaaggctccgaagggggtcccggttggccctcgtgctaggctgtggacgcactacacactccatatttatggccccaggggccctggatgcgccaggacgtaactccagagggtgtctcctgtggtgtcgggtcgcacaccggggtgggaacagcgtttaaaggggccccccttacttagctcactgtccgactcgttcaccacttgcttggcctagggtggactctccttttgccgcattgcttgggggctacttgctcccaggtgccccgatcagggccgtaccttcgacaattctgac

SEQ ID NO: 679351 - DNA, 503 bp, Homo sapiens
acccaatatgtattttatttttactattgtttagtatttagtatactttagtatcagaattaaatttgtcagtgaagtgtattgggaagtttttcatagtttgtactggccgcatgtttaaataatccaggaattatctgttctttatgatgtattagaacttactgataaaacaaactggaactggtgctttttttgaagttagagcttttgctgcattttcaagtttttctttgattattgggataatttcctctcttcatgagctaatattagtaatctgcattttgctaaaaatttgtctatttcatgtagattttctaatttactggtgggtatttggaattttagaattttaaaaatctcttaatgctgaattatttttctttccttgttgtagatatttgcattttctttctctttttttcttgttcacacttattaatggtttgtatgttgtattctaaaaacaaaaacaaaataaaacaattgctttatttaaa

SEQ ID NO: 679352 - DNA, 773 bp, Homo sapiens
  misc_feature (307)..(307): n is a, c, g, or t
taaagaaccctccatcaataaatggaaacttacaaaaatagtcaaaccacttctacaaaaggtcagtatcaggcgggggtcttcaaacccaaagggatgttgggtatgtaaaggtgaaaatatttagttgtggcggattgaagcagaatagtgtgaggaaagttgtgacccaattaatgtgacggtgaagctccggtggaacccgtggtggctacaaacaaatgtgttgacccgataaagtcccgctcggaaagtgggtgagagggagacctcgaagttacctcgtgaggcttgtgtatagagcagnggataaaaatataaaacacccagtataaaaattgtgggttaatgtgagccagtgtgctgtgtgaattataatgtgtgggttccggggtgtgggtttctctatattatagaaacttatgtgtgtttgacgcctcagggggtgattgtgcaatcaccctccctgtgatgtgccgagtataatatacgggatgtgtgtgtttacagagagtgtggagcacttctctataggagcgatttattacggcgggggggagacgtcgcctgtgtttggggggcgccatgtggccctctccctaaatgggggggagtacggggcgcaccaggctggagaagtggggtcaaaaagggctccaaaaaaattctcggcggaaagaaaaaaaatcttcctggaaggtatatcaaataacggaataaccccgtaatcgaaggcccttttgggacaggtggtttgtgtgggtggccttgaa

SEQ ID NO: 679353 - DNA, 387 bp, Homo sapiens
  misc_feature (137)..(137): n is a, c, g, or t
  misc_feature (155)..(155): n is a, c, g, or t
  misc_feature (258)..(258): n is a, c, g, or t
  misc_feature (344)..(344): n is a, c, g, or t
gctcggacagacagggtttcaaccatgttgcccaggttggtctcaaactcctgagctcaggcaatccacccgccttggcctcccaaagtgctaggattacaggtaacagccaccacacccagctattttttctttcnttttttaattttaaagtnggggggggtctcaatttgttaccctggctggtctcgaactcccggacttaagcgatcctctgctccaagcccactaccagtctcaggtttctttactaaaagntcactacctttttttctcttatctgctgccatgtgagatgtggctttcaccttccgccatgattgtgaggccttcccagccacgtngaactgtaagtccaataaacctcttttgtaaattaaaaaaaaa

SEQ ID NO: 679354 - DNA, 498 bp, Homo sapiens
  misc_feature (495)..(495): n is a, c, g, or t
  misc_feature (498)..(498): n is a, c, g, or t
ggcgtggtggcaggcgcctgcaatcccagctactcgggaggctgaggcagaactgtttgaacctgggaggcggagcttgcagtgagccaagatcgcaccactgcactccagcctgggcgacagagcaagactccgtcccaaaaaaaaaaaaaaaaaaaaaaaaaaaaattgtgtgtggggggcccgggccccggaaaaagtttttaaaacccttgcgttgggggcgcgcgcggggccccagaaaggttaggttaacaacgcgtccagaagtggtttcccaaggaagaactcgcgggtcaggaacatagggctggtggcttccttccccactaaaaaaaagcgcgcgcgggggcaaccacagcgtgtgttctggaaaccaaaatcccgagttggggagttccggaagggccacaataagcggcttcctaatcaacaaggaggagttccacaggggagccgcgaatttaaaagttacgccccgcgcgcagcgggganagn

SEQ ID NO: 679355 - DNA, 126 bp, Homo sapiens
ccccttttttttaaagggggggggggggggggccctttttttccccctaaaattttgggggccccctgttttttgttttttggttggcccaggccttttttttttaaggggggggccccgggttta

SEQ ID NO: 679356 - DNA, 1736 bp, Homo sapiens
  misc_feature (1211)..(1211): n is a, c, g, or t
  misc_feature (1411)..(1411): n is a, c, g, or t
cgctgtgtgtcgacaacagcgtgttgagcgttcactttatgtgttctgtggtttctcctgtgtgtttgactaataccgtcggtggtttttatctctgcgctcgtctagtttcatgtttctcccgttctttatgggttggcgtggcgcctcgtggtggagtaccagtatttccgcgcctcgaccgagggggggttgtgctcttggtggtgactgacatccttggggactgatcattagggtcgggccatgatgtagctcaggtggtgctgtcccaccgccacacgtcgcccgtggtgtgtacccttggtgtgtgtgtttttctggtgggcgaactgctgtggctttcctcttagtgatttgtgtgcgcgctcacctcattatttaatttgtgagattagtctccgttggtgggtgttttccacgcccgccgtgtcgccccgtgcgctctactgctcttaatggaaagccccacgaaatgggggcgttcttttagaaaattctgtgcggcccacctgtgtgtcactgccatatgttgtcccggttggtggagataaaagattgtggtgtaactttatatgtccaaggaaacctgttggttcctaggggacaactccttgttctcggatgttggacgcctcacttttagagaggggacctgtgtccacagacttcgtttgcttataaggagtgttttttcgctcgcccccaaaccacacaatgatatttgggggggggcacacacaccacacatggggcgacatgtggtgtgctcccccacataagatgcccatccaaaggggtttctctcaacaccccagatgttataataatatggggggggagtatatctcttttagaagcgcgttttaaaagagcgttttttttggagctttttggtgacacagccctcttcggctcgttgttggtcgacacacaggagatagtaaaatgatttctccttcctcaagggttacaccccagcagggtccccccaagaatcttgggtctcgataatagggggggacacacaagattttgtggggccgcccgcgcgccgcgcgcacgaccagaggacgacctggtgggtacaagagagggcccctcctctccccacacgagttgttatagtcgcacagaggcgcaccagagggtgggccctcggggcccaccccacggccgcggagatagtgtggctttgagatagtgtttgngtgtcacaccacgcgccgctgcactatcctgcgggctcttgttcgctcaatggtgggttctctggtgtacacacagaggctctctcagccacattctcacccgaaatctctttctgcttctctgtccgtgtgccaccctcgtgtcacggctgtgtcttcgtgcgttgtctgagagactataagagaccacacatgtgtgnggggaaccacaccacaccacacttataacttcacgagaaagaacacatgcacattaatgtggggtggataatcaaaacccgagtgctttcacgatgagcctactgtacagtcttcacaatgtggaataaagaatataagagacccacaacaccacatgcactttataactgcgtgggcacaatccacggtgaacttttataaatgtaagaaatggaaattcccaaccacttaaccaccttcagctatatgacagaaagtttaatctatggatatggtattttgtgaatgatcttttataatataaaggaaacccttacgtaatta

SEQ ID NO: 679357 - DNA, 186 bp, Homo sapiens
  misc_feature (98)..(98): n is a, c, g, or t
ggtggtatatgtggtatggtttgggtctgatagatttggagagactcaatactgtttttcaggaatgtctgatcatagatacgggatggtgggtccanttccagagcaccacagggcactgtgtacacatgagggggtaccttacagagccactgagatgatatttatatttcttctcacctctta

SEQ ID NO: 679358 - DNA, 421 bp, Homo sapiens
agatagaaagaaaaggcattgggggaaacaatagaaggagaagggaaatgtgggaagtgaaaaagaaaagggccagaagaggggaaggggagaaaaagaaaagagacgacaggaaaaggagagaagagactaagagaaaagtcagagaaggaaagacagacaaaatgagggatggaaagaaagaaaagcgagaagtagaaagaaaggagtacagagagtaaaggaaaggaggagaggagaaatatgaaaagagaaagagaaagagaaggaacagaagtgaaagagagatataaaaggagaacctctctctctctctctctctctctctctctctctctctctctctctctctctctctctctctctctctctctctctctctctctctctctctctctctctccgcgtggagaattcgcac

SEQ ID NO: 679359 - DNA, 1645 bp, Homo sapiens
agtgaccagagccctggcggcaggagaggccctttgccaggagcacagcagtcagctcgcctacctctgagcccaggcccacataaatacaacaatcacaccccaactcacatcaccatcacaatcctacaccaatacacaaaaacaacaatctcacaaagaccttctattcaacacaaaacacacaacacacacacatcacacacaacaatcaacaccaccaccacacacaaccagacacacccacaagccaacaacacaccacaaacaccacctcacaaatctcataccaaaccaacacacccacacaccacacacaaaacaaccaacaaccctcatcacacaacacacaaacaaacccaccaacccacaaccaacacagaaaacacaacacaccaacaaacatacacaacatcccacctacacaccccacccacccaaaaaaaaacaaacaacacaacatagcaaaaccatacaacaacaccacaaaacacccaaacaaacacccaccaacaacgactaacccaccaaaccaaataaacaacacacaaaaccaccatagaaaacaacaaactacacacaaccccacctccaccgtcaaaccacccacaaccacccacccccatccacccaccaacacctcaacaaacaaaaaaacaaaacccaacaaacaaccccaacagaaaccaaccgaccaccccaccccacacccacacaacacaacaaacaccaacacccacacataccacaaccacaaacaacacacaaaccacgaaccaacgacaacggaaaccagaagacacacacacccagaacaaacaccaaccacgaaacacacaacacaacacacaaccgcagcacaccccaacccccccacaacccccccccaatacccccccgcacaacacaagccaacccacaacaccacccgcacaaacacaacaccccacaccccgccacacgcagctgaccacacgaccagccaagccgcgaacaccaccccaccagcccaccgaaccaccacgaggcaccacaacaccaacactcaccacgaccacgccagcgcacgacacagaccacaacacaccagcacgcagcccccaccacccacacaagcaacacaccccaccaccacacacacacgacagccaccagaccacaccccaccaacccgaaacacaagcaccaacagcaacacaacaccgccgcagccgaaccgaaccaagccaccgacagaccccgcggctccccccccccccccacctccgccaaccccaccgcacacacacaccccaccgcagccgcgccccaccagacccacagccgacacacccagcaacagcaccaacgcgcgaacacaacacactacgacagagcacacaacgagagacagaacacagccaaagacaacgacaagacacacacaacccagacaccgcaacgacccgaccacaaccaacaaaaacacaaccacagaccacaccagcaaccagcagcgcccgcgcgggccggcaccgcagagacaaccgagcccagcacaggcactccgccgcgccccagagaaacccgaacccgcacagcagaccaccgagcagagacgaagaaccgaccaacagcacaagcacacacgcaccaccaccacacc

SEQ ID NO: 679360 - DNA, 1227 bp, Homo sapiens
gattcgcttatatctactatcagtttctagaatgtcttggtcttgctactgccttgaaagaatgacaatgtgaacatgatagttaaactcaccacgcatattataaccattattatgcaaaattgagaagaacagttcttggcatggtcgtggcatatagtgtaaactcgagagtacacttcactctgctgccatctgcttataattacctggtgagtcccttagaagaagtggtgtaacacttgttgcagtaggcattgttgtagaactatgccttaatgtaagaaactagtagacagacatgatccggtctaatatctatgtctagggtcgtgtatctctaactagacaccaggggtccgcttgccccatgtgtcctggtgagaaaataatatagcctcggcatcgagcattgtgcgtatgggagaatgctatgagaagtaactgtccgctgagaaggtctggtccggatgtctagaaagtgtgtgccgaatagttcgtaggaattctctgtactaatagaggattccaggagctctttgtgactcgcgtatattacgtaacacctgaaagatgacatccttgacagtgaaagggccagcactatataacgtagcaagaagtccctgtcttgcaagtctgccgacgggtatttcaggcgactcaagttatactgttatgagatttggcaaccactccttgtgtactcgtgacggatttctggatcccgtggcaagatcccttttacttgccatagattgggatgaggcattggtacacggtgctttaaaggtagtgggaactcctgggggaagccagaggggccatacgagacacgacacaatagtcaagtacgattgctaaatggcacttctacgtcccacttacgcacacggcatatgcgagcgaaacacatgattccattgccttgaccatacctggtaacccaacaggccgtaaacagctcagaagctaattacagtacacaaggtgaacacccagcgcggcggcaaacccacgcgggaaattcacacctgcagggacagggctaaacaagacaacacaacggacaacccatggagcacatataacgggaaagaaaacacacctggacagagcacaccagctagccccaacgaacaagcgatacacactccgaagacgccatgcaaaacacaggaggccatcatgcgtggcacgaaacaaaccggctgggaaacaacaccc

SEQ ID NO: 679361 - DNA, 160 bp, Homo sapiens
aacgggggcccctaaattttttttggggagggggggattttttttccgggcccggggtttttcccttttttttggtgttttgggggccccgggccccttgcccccaagccgcctttcccccagggttttttttccaaaaacccggggtttttttgccaga

SEQ ID NO: 679362 - DNA, 271 bp, Homo sapiens
  misc_feature (22)..(22): n is a, c, g, or t
gagagaccttgtctcaattttnaaaaaaatataaaaaaagaaaaccgtcactaaaaacacaaaattaatcaaggaagaggggagggggaaatggaataaccgagcttgcagcacacgcagcaccagtcatgcggtgagcccctctgagctggcgcctcgtgcctcagaatcaggtagactcttgttataagattacagttacccttaactgctccagagataacaacttgaacattatgaaaccttaacttttccctttgagatttttttt

SEQ ID NO: 679363 - DNA, 1245 bp, Homo sapiens
  misc_feature (7)..(7): n is a, c, g, or t
  misc_feature (10)..(10): n is a, c, g, or t
  misc_feature (16)..(16): n is a, c, g, or t
  misc_feature (18)..(18): n is a, c, g, or t
  misc_feature (268)..(268): n is a, c, g, or t
agcgggnatnacaggnangagccaccgcgcccagctatattatacttatacttttatgtgcaaaaggaaaaattgaccattattaacagtgaagtatattcttatattacacattatactggttgagtatcccttatccgaaatgcttgggaccagaggtgtttggattttttgcattttggaatatttgcattatacttactggtttaacatccctaatctgaaaatacaaaatgctccaaagagcatttcctttgatcatcatgtnggtgctcaaaaaatttcagattttgaagcattttgggtttcagattagggatactcaacctgtaacattttattgttttaaaatactcttgtatgtcagttaataaaggtacgtacaaacatttgctcaaatatttaagttgtcaataactaataagcaggttttctgcttgcttagtgttgctacatatagtgatcagaaatgtgtttcttgagtcactacgcaggccctggaatatattcttattttaaaaaaactagttaacttaaaaccgactgaggcatgtccttcaggtggcattccaggaaaaaaagcttcgttatcctgggaggtgatggctccatgcatgttactgcccctgtaagaccttccagtgaagatgtggaggcggaatatagtgttactgatgatcctgactctgtaggcctaggctaatgtgtgtgtatatggcttagtttttaacaaaagtttaaaaagtgaaaaatatttttaaaaataggaaaaggcttaataggataaggatataaagaaaatattgttcagctgtatgatatgcttttgttttaagctaatcgttactagaaaattcaaaatgtttaaaaatttttttaagtttccaaagtaaaaaatgttaagtaagcaaaggttaatttattcttgaacgaaagacaaatatttttatctttattactgtatatacattgtgccttttctgtgtttagatatgtttagatatacaagcacattgtgttacagtagcctgcagtattcagtacagtaacatactgtgcatcatgctttgtagcctaagagcaatagactataaccatctaggttgtgtaagtccactctgtgatgttgcacaacacaaaatcagctcagtgtgcatctctcaggaagtttcctttggtcaatgatgcataactggactgtctgacaccatttagcttccccgctagtcctactctcattctcaa

SEQ ID NO: 679364 - DNA, 338 bp, Homo sapiens
ctaatatgcgttcaacaaactgtgtgttaggtttctcctatatattaaaagtattattcattcatttaacaaacatcaacaagggcctattaatggtccccgcaatataggaggcattgagggcaaaaagataaaatattaactctgttaatattacttagtcttgggaggtggtatatcattttcagaatgaagttattctgcaaatgagtgaaactccaggataataacgatgaatgttttcataattatttcaaaggtcaaaaattcaaataatagcccacatactcaaagtgaactttacatgaaaactgcttgagccatgtaacagcatatca

SEQ ID NO: 679365 - DNA, 593 bp, Homo sapiens
  misc_feature (7)..(7): n is a, c, g, or t
  misc_feature (10)..(10): n is a, c, g, or t
  misc_feature (16)..(16): n is a, c, g, or t
  misc_feature (18)..(18): n is a, c, g, or t
  misc_feature (268)..(268): n is a, c, g, or t
agcgggnatnacaggnangagccaccgcgcccagctatattatacttatacttttatgtgcaaaaggaaaaattgaccattattaacagtgaagtatattcttatattacacattatactggttgagtatcccttatccgaaatgcttgggaccagaggtgtttggattttttgcattttggaatatttgcattatacttactggtttaacatccctaatctgaaaatacaaaatgctccaaagagcatttcctttgatcatcatgtnggtgctcaaaaaatttcagattttgaagcattttgggtttcagattagggatactcaacctgtaacattttattgttttaaaatactcttgtatgtcagttaataaaggtacgtacaaacatttgctcaaatatttaagttgtcaataactaataagcaggttttctgcttgcttagtgttgctacatatagtgatcagaaatgtgtttcttcgtgaatgactgtactttttcagagctcagcatgcactaggacttgtgatccttaagaatgcctcacaaggaacggacataccataagaacttctacattaacatcagactca

SEQ ID NO: 679366 - DNA, 105 bp, Homo sapiens
taaatcggctcgcacctgttaatcgtgtcatagcctgtcaggacagttgatgagtcattcaaaactttgtcagagaaaagtgagaggacctgctttataattgta

SEQ ID NO: 679367 - DNA, 853 bp, Homo sapiens
  misc_feature (301)..(301): n is a, c, g, or t
gcggagacggaggccggagcgggtagtgccagctacggtccgcggctggggttccctcctcgcgttatttgtatccccacgagatcctatagcaatggaactcagtcgatgcaaatctgcaaatcactaacagaatattctaaagagaaacacttgatcctgatcctgcgcatccgacgtgccaggctgagaaactttcttgaattctgttgaacggaacatcatgaacttactccaactgttgtctttatgacattatactgtgacgaacgtccgcatggatacattgtcatcaacaggntaatgttgcattctagctaacccattgcaacaataactattatttcaaaagggaaactggtgacgaacgtagttcgaacggactgaacaccaacgacaaaactatcgttgaaaggccgattcgacgctggtccactaaataaggccaaagcaataagtgaacctatgatgcctataagcagcctcgtagagcccaaattctagacacgccagggttacagctgaatgccaattcagccatctccattcggccagcagcaagcatttgtcctacatgcaacatggcctagaactatgcgtgaaccagaacagtggctgaaatcgcgtttcaagcagctggaagcatttccagttgttatcaaatggcagtcctccgttactagccacatttcagttacttctcaaaagaatacccggtcaatggaaattgtcaacgtcaaaatcgcagcttactggactgacaaattaagtctatgatcctgggaatggcctttaggcctttgggcctttttgaactaaactcgtattgcatagagggccaacttacttgcac

SEQ ID NO: 679368 - DNA, 782 bp, Homo sapiens
agcatcatccctctactattttattaaccaaatcagcaactccctatcagctgttccccaatcttttcctccgaccccctaacaaccccctcctaatactaactacctgactcctacccctcttttatcatggcaagccaacgccacgttatccagtgaaccacgtatcacgaagaaacgactctacctctctatactaatctccctacaagatctccttagttataacatgcacagccacagaactaatcatatgtttatagtcgttcttcgaaaccacgacttatccccacctgggctatcatcacccgatgaggacacccgagccagaacgcctgagaccgcaggcagcagtactggtccgtattctacacgcctaggtgaggctcccttccccttactcgagtcgcagctaaagtttagcagctcacaaggaccctagggcgtcactaaagtattctacgtacatccactctgcacatgtcccaaagaagctatcaaacgtcccttgaggccatacgagtttcattattgacgtaaagcattacgaacaaattaggcatgttacttctgttcaacggccttagcctccatttacaggacctccacactgtaggcacgccccctaaacgccgcaggtgtcgaaagcccccccatccggctgggtaccacgatagtgctatgacagcatagtactactggcaagactaagcggaattggggacatagaaagcccatacaagtcactagttcaagcccctgagaaaacagatgccttacac

SEQ ID NO: 679369 - DNA, 432 bp, Homo sapiens
gtcgacacgctagaaatctgcatgatcatggctaaatgtttataggaggctagagttggtatacatgcaaaaaagatctgacagagtacttgtctcgatataggggaagttgttgactgcacaattcaaacagatccagtcactgggagatcaagaggatttggatttgtgcttttcaacgatgctgctagtgttgataaggtttaggaactgaaagaacacaaactggatggcaaattgatagatcccaaaagggccaaagctttaaaagggaaagaacctcccaaaaaggtttctgtgggtggattgcgcccggatacttctgaagaacaaattaaagaatattttggcagcctttggagagattgacaatattgaacttcccatggatacaaaaacaacatagtcagcagcagggtaccgcagctcgca

SEQ ID NO: 679370 - DNA, 425 bp, Homo sapiens
  misc_feature (351)..(351): n is a, c, g, or t
  misc_feature (376)..(376): n is a, c, g, or t
  misc_feature (390)..(390): n is a, c, g, or t
  misc_feature (418)..(418): n is a, c, g, or t
agtgatcttgagtattttttaatgtttgttggcaacctgcatgtcttcttttgataaatgtctgtttatgtcatttgcctactttgtaatgacataatgtgtttatttatttatttactgggttccatgtagattctggatattagtacttcgttagatacataatttgtgaatattttctcctgttctgtaggttgcctgtttactctgttgattatttcctttgctgtgcagaagatttttagtttacttaggtcccatttgcctattattatttttgtttcatttgcttctgatgacttagtcataaattctttgtcagggctgatattcagtaaagttttcctaggntttcttctaaggaatttataggttnttacatttgagtanttaatcaatcttaatttttatatatggngagatat

SEQ ID NO: 679371 - DNA, 716 bp, Homo sapiens
  misc_feature (476)..(476): n is a, c, g, or t
gattatggttcccataccaactgtgcgtcccctactaaccaagggttatattttcttataaaactcacccatccccccgggttccagctttaataaaagtcccatacttttaaaaagtttttataacttattcttttataccaaatgtcccgctttcggtcgcgttgtctttttatagttcacccaccttcttgaccacttgttatacctacatttcaccacggcttacacactccatcttccaccacagtgttcgagtgcctcaacaccactaagggcgggtcaaactataaagcaccccgtctaattacatttctctcccattctataatcccaataactctttcccagacaaataatatttctcaacaccaccacgagtttgtaatatttcaaatggtttaaaatatcaaaccttcttagttatgtacactttcgtctcttcaaaataatgttggtctcctacacaattggtnccgactcaccgcagtaagtgccccaatatagaaaataatttgtcgcccaaccgctagtgctcaccacatctaagattgctaccaaagtaaagaagacgcggtactaggtggggtcccacggttccctatagtctgttcgtctggggggtggttctaaatggattcttctactgggtagttcgctgtgctacagtgggggctcgcccaatatcaacacatcttccttcggcccacaaaaca

SEQ ID NO: 679372 - DNA, 144 bp, Homo sapiens
ccacacacccgacaccagacatacacagaccacacacaacacagacaccacaacacacatagcccacacacatacacaacccataaacacacaccacataccatacacacatacacacacatgcacatacacttgcacacgggg

SEQ ID NO: 679373 - DNA, 557 bp, Homo sapiens
aagatccttgcaggctctctacctttgtgagcgtgcttccacggagctaacgagtcaggaagcagttgggttgaagaggaaatgggaggtgaggaaggaagacagcaagtgtagacatgtgccttacaagaaagcttgtgctgtgaaaggaaagacagagactgtagtggctagaaaagatgacagcaggaacctgggaggctccaggctgccggcacagcaaagtcagaaatgcagagggaggccttcgggaggtggccgggactgagacaggtacaattcttcctctagaactcagggaacaggggtccaatgatccaggggggcccaatctgtggagcctcttgacagcctctgtttccctgggagtggcagtggccggtcctggctcaggacagggagtggtgaggatcaaatgaatggagggttgcaaaaagtgacagaaacattcactaccattactcatggggagcaggactctcgattttacagcccactcgaatcgcaggggggccgggatttgcacgtgaccataaattattcggcctgaacattag

SEQ ID NO: 679374 - DNA, 701 bp, Homo sapiens
  misc_feature (1)..(1): n is a, c, g, or t
  misc_feature (62)..(62): n is a, c, g, or t
  misc_feature (112)..(115): n is a, c, g, or t
  misc_feature (136)..(136): n is a, c, g, or t
  misc_feature (170)..(170): n is a, c, g, or t
  misc_feature (172)..(172): n is a, c, g, or t
  misc_feature (175)..(176): n is a, c, g, or t
  misc_feature (179)..(179): n is a, c, g, or t
  misc_feature (181)..(181): n is a, c, g, or t
  misc_feature (187)..(187): n is a, c, g, or t
  misc_feature (206)..(207): n is a, c, g, or t
  misc_feature (209)..(209): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (236)..(238): n is a, c, g, or t
  misc_feature (240)..(240): n is a, c, g, or t
  misc_feature (242)..(245): n is a, c, g, or t
  misc_feature (253)..(253): n is a, c, g, or t
  misc_feature (257)..(259): n is a, c, g, or t
  misc_feature (263)..(263): n is a, c, g, or t
  misc_feature (277)..(277): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (314)..(314): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (339)..(339): n is a, c, g, or t
  misc_feature (391)..(391): n is a, c, g, or t
  misc_feature (403)..(403): n is a, c, g, or t
  misc_feature (408)..(408): n is a, c, g, or t
  misc_feature (459)..(459): n is a, c, g, or t
nttaatatgttgctgctttttcatgttattcttggaggtgaacgagttctcagcctgtgtgntccgaccatcccattaactttgaagtttctcttgattaatagaagaaaannnnggggggtggggaaaaggaggnacatgctaaaaaccttatgacaatcatccaaatntnagnnccngnccgccncttccccacctcccctttnncnttttnccccctntcnccctctccctcnnncntnnnnccttcctngctnnncctncctggccgtccctngnccccctgcncngccccctggttctcccnttntntnttntngtgntgccctgctggttgcnctgaccacttcccagatatctgacagttcgtgctcccaattttttgttccancagccttttgtnaaatnttactgcactgaaaggtaatgttggaaatggtgatgatctgggcttatgtnagattgtttattttttcataacacagccccagattctttctctcagttacagcctcaggcaaaccacgttctggttggtgggttctgcagggatctctcccaccactgagcctctagtcccaaaaccatccttgacaacatcgtgtgtttgttacttccctttgcccacctccaggccacctggggaagcccacaggcagccaagaccctgaaatgaaatgaacacaaagtctgactcggta

SEQ ID NO: 679375 - DNA, 411 bp, Homo sapiens
ggtcgactgccagaagacgttattcttatatgcgtggccagattctacatggcgtaacccggtttgtccgtatcccttttttatttcgacccgggcagccgcaaagccactcggttgcacaggtagatccccgccagggtcagcccgccgcccaggcacatgatcagcgtcaactgctcgcccagcaatagcgcgccgaggatcaccgcggtcaacggattgaggccgataaacacgccagcacgcgttgcaccgatatgctggatgccgtcgtaataccagatataggccagcgccgaacccaggccgccgaggtagaccaggctcatcatctgttgcggactcaaggtttcgatgaccgcaagactcgcctccccgcgcagccaggtggccagccagagcatggccgta

SEQ ID NO: 679376 - DNA, 677 bp, Homo sapiens
cagcgtgactcggtatcgagtactgcgcgacgatcctcagagacaacgtgacaagagcgcctgtaacggggcttgtgaggtgacgcgaagtccccgaacgatgacgggtgcaacaattagcggccttcgcgcgtgtgggtctcagtctcataacatgagcttgctgtcggaaatgatgagaaagtggtgccagagtgagcaagcgacgtctggcctcttggaagatgccacaacgcagccttgtgagtaacgatttaacttgggccggttcattgaaaagccgtgtgtattgatatgaaacagctgttctcaacactacccaaatcgttttaatagaaaacattttgcaacgatctagcccttctatgagctagatggaaagaggttgctgatgtatgataaagttagaaaatcacacatcttgtaaattctcatttgcttaaaagaaatcagtagaaaataaatgtcttctggagacgacttttggaaatggagttgttaacacggcctctggaagcgagacgtccacgtttgttaagtggtttagaggacatggagctggaagacctgagaaggatgagaagaagcttctgtgccagactggtcatatttagaggacattttcatattctctccattgttttgtgtgcatttcattcctcactactgtgtatatg

SEQ ID NO: 679377 - DNA, 301 bp, Homo sapiens
ggtcaagagactgccagtcagtacgagccagatgtatccagatgaggtacacatgttagggataggcgacggaacgcgggccatgccacaatctgagataggcgccttgagtacttactgtggcctttaacactgcttagaatctattggtggaaccggtatacgacatgggtcatgcatgaactctatgtatctcatgaaggctatccgaagctgaaatccttgcgacccgacgagctacctgtgtatactgatgctccacggatatgtatgaccacagtgatatgatgcttagggaggg

SEQ ID NO: 679378 - DNA, 880 bp, Homo sapiens
  misc_feature (6)..(6): n is a, c, g, or t
  misc_feature (68)..(72): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (124)..(124): n is a, c, g, or t
  misc_feature (150)..(150): n is a, c, g, or t
  misc_feature (164)..(164): n is a, c, g, or t
  misc_feature (179)..(179): n is a, c, g, or t
  misc_feature (181)..(181): n is a, c, g, or t
  misc_feature (188)..(188): n is a, c, g, or t
  misc_feature (199)..(199): n is a, c, g, or t
  misc_feature (219)..(219): n is a, c, g, or t
  misc_feature (222)..(222): n is a, c, g, or t
  misc_feature (226)..(226): n is a, c, g, or t
  misc_feature (238)..(238): n is a, c, g, or t
  misc_feature (250)..(250): n is a, c, g, or t
  misc_feature (262)..(263): n is a, c, g, or t
  misc_feature (268)..(268): n is a, c, g, or t
  misc_feature (272)..(272): n is a, c, g, or t
  misc_feature (318)..(318): n is a, c, g, or t
  misc_feature (324)..(325): n is a, c, g, or t
  misc_feature (336)..(336): n is a, c, g, or t
  misc_feature (344)..(344): n is a, c, g, or t
  misc_feature (348)..(348): n is a, c, g, or t
  misc_feature (355)..(356): n is a, c, g, or t
  misc_feature (372)..(372): n is a, c, g, or t
  misc_feature (380)..(380): n is a, c, g, or t
  misc_feature (382)..(382): n is a, c, g, or t
  misc_feature (388)..(388): n is a, c, g, or t
  misc_feature (391)..(391): n is a, c, g, or t
  misc_feature (402)..(403): n is a, c, g, or t
  misc_feature (411)..(411): n is a, c, g, or t
  misc_feature (442)..(442): n is a, c, g, or t
  misc_feature (474)..(474): n is a, c, g, or t
  misc_feature (486)..(486): n is a, c, g, or t
  misc_feature (528)..(528): n is a, c, g, or t
  misc_feature (732)..(732): n is a, c, g, or t
  misc_feature (754)..(754): n is a, c, g, or t
  misc_feature (757)..(757): n is a, c, g, or t
  misc_feature (760)..(760): n is a, c, g, or t
  misc_feature (766)..(766): n is a, c, g, or t
  misc_feature (772)..(772): n is a, c, g, or t
atttcntgaaaattacagtattttgtaaacataagatttacagtttaaccatacacaaagcctatttnnnnntttcttgacagaataaattacttttcttcaaaanantngtcaagtgcaattntgcccaatatttaatgcatactaganttaaagcctatganactaagtagtaacanangcaattntcaaacctttnatttgaaaacattcactttnaantttnatttcttatttngccccatttaanaacattactttnnttganaatnacccaattaagcagttaacagtgttggataataggggacaggggangggggnnggggggggggnggcgaagnggtnaagaggnntgcgatcgaacgagancgagagancnacagangcncacagcaaacnntgcaaacntccagggtgacctgtgtttcagtggaaagcnttgcgacagttcctcttatctcattgtttgcnctctgtataggntggggctctctttagcgatgcacacaactttgcagcactgtnagagtatgaggacaaagtcctaatctggcttgcgcggcctctcacctctgtggtgctctgcatcgtggtgcttcttgtcatcttttattgccaagtgagactgcccactcagagcactagacagcgcaagaaggccggcactgcccccgaggggcgggattccaggaggctgaagtcccgaagttgagggcgtaaggggaactnggggtccgtggccatgagaaanatnctnagcttncaactnctgctgtgtaggaggtagacctggtaggccacgtaccccgatgatggcattcaactctgccatggtcacctgtttggcacgttcaacagcctgggccacctgttgttg

SEQ ID NO: 679379 - DNA, 339 bp, Homo sapiens
aagctcgggaccgactactgcaccactgtcacaccttttaggatggctaaaacttaaaaaacaacaatattaaaactgctggtgaagatgccaagtaactgaaaccctcatactgttggtgaaagatgcaacaagtggtagatccactttggaaaacagtattactctgcaaaaaaaaagagaagaaaaaagaataagaattgatacccactacaacatgaattaatcaactgcattaggctaagcgttagaagccagactcaaaaggttatacacaatttctaaacacgacttctgaaaaggcaaaactataggttgggaggacagttcaggggtttg

SEQ ID NO: 679380 - DNA, 564 bp, Homo sapiens
attaggcttctgagtgggctatgtcaaatattgggctattgagtggtcagcgttctccatggtagccctcaggcagccggatgtcagctgtgtagtgataggcgcttgttgatttcctctgtggagatcctgctgtgagggatgtatgcgcatacgcactctcactgtagactgcacctcatcctgatggacgtggctgaagcctgtgtcactctccccatcagacactatcttcaagtcctcgtgcacaatctctggtgcagagctgatgtgggccccgtgcagaacgaagttccccagtgagcagcacgtgtgggggcctctccagggtcactgccgtcatcaccaccattctcatccaggcctatctgctcaggggcaccattggtcttgtggcttagaactcggttgtccaccacgcggaaagctggcctgcctgagtcaggcatcgacgaagaccgaaggcttgcctcctttttgtagcttaatctcctttagtgccaatattgcagtagtgtcaggcacgttttgtggatccgctccccagactgaggaagactggtg

SEQ ID NO: 679381 - DNA, 1636 bp, Homo sapiens
  misc_feature (15)..(15): n is a, c, g, or t
  misc_feature (117)..(117): n is a, c, g, or t
  misc_feature (131)..(131): n is a, c, g, or t
  misc_feature (134)..(134): n is a, c, g, or t
  misc_feature (138)..(138): n is a, c, g, or t
  misc_feature (585)..(585): n is a, c, g, or t
tggctggattcagcnactctcttactacaacaaggctgtttcgtttcggtcgtctcacccagaccgctaggtgtgggttggtagaataatgttcccgcgcctgctctcctctctctngcggcggtctatcnttnttgncggggtagagattaccgcctgccgctccccactccccctcgccgcgctgaataatagttgatgtggtgtggcgtcgacaacgcccaccctccgccttgttcgcctcgctcgctgttctacagaataagttgtgttgtccttcctcctttatgtacacctagggcgttctcccaccacaggagagtcttggggttgtcggtctgtttttgccacaaacagggcgccacccaaacagagaattggggcggcccccattaacaggggggggggtagaaccacaccccccccacacgactttttttttgtagcccgccttgtgttgggtggaaaccccccgcttattagggcggccccctcctctctcttgtggtcaataaagacgtgttggaaaaaattggtgagcccgcccacaacaaaaaatgtgggttgataaaagggccccttttnttatataagtgtctcccccaccgcgccgggaacaccaccttgttaatagtccaccaaagggggcgcttttctcctaataaattttagagtggccgccgccctcctcccccaggaggacacaccggggtttttgttgtgcgcgttggttgtgaccgcccaaccggcggcgcagctcttcttggggggaaaaggacaccacaacatttgggcggggaaaaatttttttgggggaaaatattattctctttggggtggtttataataggtgtggcccccccaccaaaagattatacgaggtctccttgggagagtgtgggccttttttatcgccgtccgctgtgtcgtttgccaacagacaacaactctcaaaacccgctcgcacaattcccccctcttagagccccgctgcgagttatgagatttaaaagagagagaggggtgtcctcccgcctcccacagagagaaacacccaccctgcggtggttttaggaagacgcacactctggagagggcactctttatagagacctcgaccacatgtggggtttacacatgttcacggggagcgcgcaccttatggctgcacacacatatatgagacatatattttatacagatgtctatacaggttagtaaattggatatatgtgaaaatattcacatttcttctcacacatgtgcacatgaaggccaccacattttttgaggtatatttcacatgctgggctggtaagagatttctgtatattatgcacccaaagaatattggagaacactttctcactcacccaccacgagaaaggtttctcgtttggaacacaccacctgcacattatgagaataattttcacatactgctttttccctcacaattaaatttttgttgtttaaatgttgaatgtcttcacattggagatgggtcaataaatggttccactggaacctttcaaggacaccacactgtgtaatggttttttgtatcccctacccccaatatttcgctttgctcattttttttgcagcttcctataaagtttgttttcctcatcca

SEQ ID NO: 679382 - DNA, 422 bp, Homo sapiens
  misc_feature (153)..(154): n is a, c, g, or t
  misc_feature (191)..(191): n is a, c, g, or t
tagcactgctgctctccagaactctcgcagcagagctgaccaagtatgcaccataaccagtggccagcgaggggctcaatagctacaccaagcattccacataaccgagaagctctctccatcagcatagcctccgatgaccatggtgttcanncaaagggttcatcttcgagcgccggctgtacatggcnctggtcagccatgaatgaatagctctaggactatagctgtgtccatctcccagaagctcctcatcaatcaccatctggccgagaacttgcttcaaatactggaaatcagcgtagtccgcagaggcacccagcatggtactgttgtgactcgcataatgcgagagatttttgggaaaccgagccaaagagccgttggatcccagcatgtttgcggcaaacaccaacccgccc

SEQ ID NO: 679383 - DNA, 117 bp, Homo sapiens
ctttctgcggctgttctagaggatcccggtaaagcctcaggcctgcctcacaccaggaggcagccagagccacgtacaggtggtgcccccagatcatacagcagtgggcacagtgga

SEQ ID NO: 679384 - DNA, 255 bp, Homo sapiens
ctgtgcaattactctgcattaatgtaagcaagctgaacattttgcagcttgctctctggtgggcatgtgggactgtttctgcatttgtgactgaaagtgctttcctggaagttagatgaattgtacggcacttgtgctgtaaatgccgcttccctcaagagtaactacaatcttcccatgcacaagatgattaatacatgctacttagcagaatctatgacatgcccagagatccaaaattttttccttcgcgca

SEQ ID NO: 679385 - DNA, 318 bp, Homo sapiens
ctgtttggtcagatactgatctcgatggtgtcagctgatccattgagttcagggtctgcaacatatctggagcacagatcttaggttttacaatagtgatgttgtccccaggagcaatttggggaggttcagactcttggagccagaggctgtatggcccctaaactgtaatttctaatcttgtagctaatttgtcagtcctgcaaaggcagactggtccccaggccaaaagggggtcttttcaggaaagggctgttaccaattttgtttcagagccaaagcatgaactgaattccttcccaaagttagttcgggcta

SEQ ID NO: 679386 - DNA, 209 bp, Homo sapiens
gtttaaccggtgtagccaggatggtcgcgatcttctgacctcatgatccgcccacctcggctcccaaagtgctgggattacaggtatgagccaccacacccggcctttttttttttttttttggaaagggattttcttttttgtggcccaggttggagtgcaagggtacaatctgggttcattggaaaccttctgtcctccgtgggttc

SEQ ID NO: 679387 - DNA, 931 bp, Homo sapiens
  misc_feature (17)..(17): n is a, c, g, or t
  misc_feature (28)..(28): n is a, c, g, or t
  misc_feature (37)..(37): n is a, c, g, or t
  misc_feature (43)..(43): n is a, c, g, or t
  misc_feature (53)..(53): n is a, c, g, or t
  misc_feature (58)..(58): n is a, c, g, or t
  misc_feature (272)..(272): n is a, c, g, or t
  misc_feature (312)..(312): n is a, c, g, or t
  misc_feature (343)..(343): n is a, c, g, or t
  misc_feature (355)..(355): n is a, c, g, or t
cacctttagttacctcncgcggcgacangcctggaanagttanctatctagcngagcngacacacggcaatggcaagcctcactggcaggctcagcacttaagcccagccttcccaccatgcatctaagcttgcgatctcatcagacccaacttcaatcataaataactgagacgatgccagaggccagaatctttgagaacccaatgtgctgtcatcaccatggctgaaacaaggcgctaggcatctcgctccgctgagcagcgagaaacnaccaacagagcccaatgatgctaagccaaaaaggcacaanagcatcaaggacagacactcgagataaaacnaggctgggaccnaaaaacaacaaaaagacgagaagaatagcaggagtggtgactactttgacacaggaatgctataaacaaatggcttttttctggtgcctttcaacaacttctgggtctaaccaccagccaaagatgacagcagaacaaccataattaccactgcgatccatcttttcggctgacgggcgaaaaaatgaaaatgccctgacaatcccactgctggcttctgaggaaaccgtctcagcccaaggcttttggtaggggggaatacgggaattccaaaaaaaaaacccacgctgcccctgggtctccatttcaaccatctgatggagttcaaccacggggcgagcagaactgggtcccattggaagggaaccggccaaagaatctcgacatacaaatcgtaccaaagaacccacctttacccaaagaaccccctttaatgcgcttcacaagccccaccccataaaacaaacgaaaaacaaaaacggagaggaagtgccacaccaagggggacccttgtcgacatgacgggccaaatcctaccgttataaataaaatttctgtaaaccaaaaaagacataa

SEQ ID NO: 679388 - DNA, 1106 bp, Homo sapiens
acttgaaaagagacaagttctggccaggcgtggtggctcgcgcctgtaatcccagcactttgggaggccgaggtgggtggatcacgaggtcaggagatcgagaccatcctggctaacacagtgaaaccccgtctctactaaaaatagaaaaaattagctgggcatggtggcaggcgcctgtagtcccagctactcgggaggctgaggcaagagaatcgctggaacccaggaggcggggcttgcagtgagccaagatggcaccactgcactccagcttgggcgacagagcaagactccggctcaaaagaaaaaaaagaagaagagacaagtgctggacttaattaagtgggagacctcgggtgggtcaaaaaagcctgtagtggtggcaagggtggatgcagagagaccagttgggctacggaatggaatataggtgagaatcggatgtcggtttggattcagagtgctaacgggtagacacatgaagcagtggggtaatgggaaatatgtggaaaggcaaactggagcatggggatgcggggaatgagagggtaatcagaagaggatcccgggcctgtgtgcaggggcgtcatgcctgtgatcccagcatctggggaaggcaaggtgggaggactggtggacatccaggacgttggaagacccgccggggcaacagtgaagaccccggtctaacacaaaactacaggaaatagggtgtggggcatgccctggaagcctaagctccacacagggctgaggccaaagggtccccaactagcaaagacggtacacacctttacacgaacaaaaacaaaagatcgtccacacaaaggagaggaccccagagtctgggagaacgtgcacaccaatcacaagcggcctgacacaaagaaagcgccgacgcggggcgggccaccactgagggaggagagcaaacggagaagggaggacgcgcagatacggagcacgtacaaaacaacagcacgagcgaacaagagaggccgatacacaaggcgggggccagagcaacacaacaaggcgggctgaccaccaacgcgtcataagcaacaacaactagtccgagcaaagagaagggcgcaaggaga

SEQ ID NO: 679389 - DNA, 854 bp, Homo sapiens
cccggccaggtgccccttccgagagccccgggacgggttagcagcccacgtcttgtgaaagccgacccctcagcggtgatcaaagactccccaaccggtggctccgaatgcgcctaaagcccagacacatgggtgctggcctaggacaggggacctcacagggacatccggggcctcggctagctagaggtccgccggacctaacgtttcctctttaggtcccctattttcaggaccctagtccgccaagggaacacctcgttcctgtcttgacccatacggtgaatccttcccctataatcaacgtacgggcccccccccccttcaagctttctgagatcaccggtcccgaaaatgttcctcttgaaacgtctttgtaacaactacaacctgagaatttttctctttaagcttaccccagaattcctccattattccaatcgaccttatacccgtgctaaaactccccccagtgataatgtttaaatctgcaccatgtaaaccacaaggcgtagatatcccatttatatttcgaaaaccttgccgaggtgagcctcaactggtagtccacacgcacctgatcccctccacttccccgaaatattgaagtttaaaatgtacagtgcacattcctagcatcattctttaattcacttataccataaaaccttttttacacacaaaatctttctaaacaatgtgagtttatgcatatactcccagattattacacggcagaaggattattccaaatcaccagcggtctgccttttgaacaattactaaatcaatttttcctgctgcaacattcctttgtcaaacaaaccaaaaaacacacaactttaaacaaaaca

SEQ ID NO: 679390 - DNA, 216 bp, Homo sapiens
cttgtctatgtgaaataggagataccgtgtgtagctaggacgaaagggagtgagctctaaagtgcagcaaggacagtgcagaacaatggggcaattctctgatggtcttgacttgcagttatgactgcttattatgacctaatcaaaaagttggccagagaaggctgcaggccccactgacactgggcatctagaacagtgattgtctgcatggtg

SEQ ID NO: 679391 - DNA, 349 bp, Homo sapiens
  misc_feature (335)..(335): n is a, c, g, or t
tccactagtgtaggcccaccttatgaggccacccaggcatggcctgggcgcagcgacccgttctccagctatgtctatggttttgagctcaggacgcgacaactgtgtcggcaggtgctgatgttccactgctttcccgatgagccagacatggggtcggcgcccgtgctggtgcgccgactactgcttgaatatcggccatcgccactgggttatagcctgctgcatgctgcccatgaacaagccattgaccgggcggggaaggtacagagtcggccaccgttggagttcatctataacgcgttcgagctcgcaccggatccacggcgctatcnagccattgaaacaa

SEQ ID NO: 679392 - DNA, 103 bp, Homo sapiens
gactctagcaggatctcgcaggttaagggctacccagtgctggcacaggatctggacatcatagatgttcaataactctttgaaaaaattatttatatattga

SEQ ID NO: 679393 - DNA, 301 bp, Homo sapiens
ttgcccacccggtgccaggtctcttcccgcgtctatccagcgtcggcccgcttacatcccgcccctgttcctccggtgtggcctacaggagcccacacgccgctcacaattacccttaaacacctccgggtaagaagaggagaggaggatagccagccagaagagaagaagaacccggatgaactggaaacggattgcccgagaattggccagaagatgaccagccatattataagtgagtgaccctgcgaccccctctttggaccccccgccggatgaataaagcttcctgtgttgtgtg

SEQ ID NO: 679394 - DNA, 143 bp, Homo sapiens
caggcagatagcctgagctcacaagtttgagactagcctggggcaacatagtgaaactctgtttctacaaaaaacaacaacaaaaaacaacaacaaaaaaaacttgaaaattagcccagcatagagatgtgtgcctgtagtcc

SEQ ID NO: 679395 - DNA, 104 bp, Homo sapiens
ccatgtactgctaggggtgctcctggacttggacgtggggggctctgccttggcgctggctgtcagcacagctcagcccggccagttccataagttggtccatg

SEQ ID NO: 679396 - DNA, 122 bp, Homo sapiens
gccatccagactgaggagaccggaaacttaggggcacgtgagccacgccacggcccataaggaaagcaccggagcaccccgcgccgcgtaatactgtggtctgcatcacacagtcacttcgc

SEQ ID NO: 679397 - DNA, 152 bp, Homo sapiens
aacccagaacagcagtggggaagagggcaaaaggcatttagcacaaaatctcattaagaaatggacattcagggccaccggatagtgtatgaaacactcttataaaatctcaaggggctcccccaggttgggtcctggatacgggtttggag

SEQ ID NO: 679398 - DNA, 468 bp, Homo sapiens
gcggatgccgagcaggccccacaggcgccaggtcagcacgatcagctcggcgtcgatgtccggaccatcgaggttgaacacctcgaggccgatctggtggaactggcgataacggcctttctgcgggcgctcgtggcggaacatcgggccgatgtaccacaacttctgcggctggccaccaccggtgaggccatgctcgagcacggcacgcacgcaagcggcggtaccttccggacgcaaggtcagggagtcgccgttacggtcttcaaaggtgtacatctctttttcgacgatgtcggtcacttcaccgatggagcgcttgaacagctcggtgaattcgacgatcggcatgcggatctgcttgtaaccgtagttatccagcaggcgcgcgaccgtgttctcgaagtagcgccacagtggcgtctgctccggcaggatgtcgttcatgccacgaatggcttgcagaga

SEQ ID NO: 679399 - DNA, 478 bp, Homo sapiens
  misc_feature (343)..(343): n is a, c, g, or t
tttgggaatacatgtgaagagcgagggctctgccaatcattatcatcataatgaatattctaactaatattaatcagttactatgctccagggttgtgttcagtgcatcattcctattaccgcactaaattatcacagcgtcagaacaaggcctccgttttacggcttagggaattgaggcacagatgggctaagggagcacctgtagagcagggatgtggtttggtaacagagtgcatgctctttatactgctcttctgcgattattgtgaataaagcgcctacaagtgcctgtggaactgtaagtgccccatacaagatagcttttattaattttagggtnctcacggggcgcttacttagatttttgctgtgataattgataaagttcagctttcaacactccatatcaaattctgttactttagaagtctaggcaccaatcacgtctccgaaataaacgcaaggcattgcataa

SEQ ID NO: 679400 - DNA, 228 bp, Homo sapiens
ctgttctgctttggataggtctggcagtcagaccgggttgatgccatcgcaggcaagccagctcccacattgatttggttgagtcagggaaaccgggttatttccccggcaccagcgtcaaccgcgtcttcccatacaccccgtcaaagttctgcggctgcattgggaagctcaggtattgcgctttcaaccacgggtcgatgccattggcatagtccaaaggcagac

SEQ ID NO: 679401 - DNA, 824 bp, Homo sapiens
aaagaggcgggctgccggatcgaatgtagcccccggcgcctccccacattggtggtagtacacaatctgcggcgcaacccctgcaagcagaggcaaggcgaacatgccacaacgtgagggggggcgcacgcccacggccacacacaaccaaccgcatcgttgcggtagtgatcgcccaacactcacacatagccaaggtaggccggtccatacctcacctccccgggcggtcgttcgtagactccatgagacagttgattctcgccaatcatgccagccgccgacagcaccagggcaagctccatacaggaaccacgcctgggcgtaccgcccattctcaccacaccacacacaaggaacacacaactgtgcgcctcgccaagtaaacaacgtgcgcaagttgttgtgtcgccgcccgccctcacgagcacacccccctgggttttttttccgccccccctactccccttccccaccgccgctgtctttctatgaccacgcgcgtgcgtcaccacccgcgcctgggccttgcggcccctccacccatcctcggtaagggtcgcgccccgcggcggcttcttgtcctccccccccccatgctcacagcgcgacacgcgaatgtccgcaccctgcttctcctctctcttcctctcacggaaagaatatttctccaccaccccaagtgtgctctcgcccgtcgtcgcgggcgcaccttcccaccaccctccccgccccaccccctcttgtcctcatcccccccccaggagaggggggggggggggggcattttttttcctccccaaacattttttttttttcaaaca

SEQ ID NO: 679402 - DNA, 111 bp, Homo sapiens
cacgcgtcgactgagttaattacttctcaagtctgcatgagaggtgatgagttattaaggagaagattctataattgagagacaaataatggaacacatgagaacttccag

SEQ ID NO: 679403 - DNA, 1639 bp, Homo sapiens
  misc_feature (1639)..(1639): n is a, c, g, or t
gaagtaggtctactgagtacgctacttcccctatcatagcaagagacttatcacctttcatgatcacgcccgtcataatcagtcatccgttatcatgcattcctagttcctgtaatgcccgttttcctaacacatcatcacacaagaacgtaactacactactcaacattctcacgcacagtctcagcgcagacactcaggacaaccggtctagacactatccgtgcccgctcactcatgcctagctcctcaatcgtccctgcccactaccctaacgacataccttctacatacacacgaccgcaggtcaactgatcccatccccttcaccactcacaactcaactcgcgccacccacacctcggatcacactcgcaacccctcaccgcagatacacccagaactgtaccgcgacgcgacctaccattcgtctcccacatccctgaccactcagctctcccaccccactctgattctcccataccaacccacgacgcgcacccatagccgcaaactcacctatgcacccgcttcagacccacatccccgcacgctaacgtacctcacccccgactcccgacacgcccccccccgactcccgccacctaacaccgacactccaaccaatcccacccaaccgcacccgcccacagcgccaacctcccgaatcagcaagacctcggtcacacaccaccacatcccaccgcgcctcgtacgcccaacaccccagcactccgaccacgccctcccacccccgaagcaccccgctacattcaacacaccccccaaccaaccagcaaccgcacaaccccacacgccgccttcacccacaaccgagacccccgcgcaacgcgcctcactcaccctcacccgggccccaacaccacgccccccatgcacccctccccaccgaagcgcacgcccaacacaccacacccacgcacaacccactccgcacgccaacacacgcaccccgcaagcacaccttctaacctcaacaccacaccctcacccacacacaccaccccaccccgcacccacactcacaccagcggcccccccgcccaaatccccacaccaccctccaccaccgccacacaccccccgaccgtcactacaacccccaccaccaccgataacgcgaacggccacgcacaccccaacccaccacgcgcaacccacacccccacacaccaccacacccccccagacggcccccaccacacacacaccacccagcgagcgacacgcagcgcaacaccagccaaccgcccgcgccaccccgaccaaactcacgccccaacagcgcgacaacacacacacacaccagcacaacaccaccaccccacccgcacccccccgcgacacccccgccccgcaccaaaacacaccccacacgaaacccccccaccccaccccaccaccacacccacacccaccacccacccccggcccacccgctaaccaccccacggccccacccaccacacaccccaacccgcccacccaaccccccaccccccacaccaccccacccaccccccaccacaacccccccacacacccccccccccccccccacacaccacccaccgaccacaccacacccgcccacacccaccacccccacaccaccaan

SEQ ID NO: 679404 - DNA, 146 bp, Homo sapiens
tagaggatccccgtcgctgcccgctgaccgggcaatacacccactactcgctggacaagaaaacccacaaaccggattacgtgactgatctccgcgcgcttccgccaccgctctgggccaccggggtgaaaacctatgacggcgcg

SEQ ID NO: 679405 - DNA, 253 bp, Homo sapiens
ttctagcaatcatgacataaccccacactgacacagcacaatttgtctcttcaattctcacagatttccatagcattattttataagcgcaaaggtatgcatctttatcatacaggtaccagcagttataacgggcacaataattcaagtcacgacagttaccaactctactcaatacgattaccaaatgcacgcacagcaggattatcaagacgcacaatcgtccagagcaccacagaaggagtcggccatg

SEQ ID NO: 679406 - DNA, 514 bp, Homo sapiens
gggaggcctcaggaaactgacaatcacggcagaaggcgaaggggaagcaggcacgtctggccatgttggagcaggagagacagagagagtgaagtgggagggctgcacgcttttaaacaatcagatcccacaagcgctcactcaatatcacgagaacagcaagggggaagtcggcccccatgagccaatcacctcccaccaggtccctcccacaacactgggaattacaatttgacatgacatttgggtgtggatacagagctgaaccatgtcaggggtagttcaaccgctgagattgattgattgattgattgactgagatggagtcctgctctgttacctaggctggagtgcagtggcacaatctcggctcactgcaacctccgactcccgggttcaagcgattctcctaggttcaagcaattctcacacctcagactcccaaagtgctaggattataggcatgagccaccgcacccagcctgaccagctaattttaaaaattttttgagat

SEQ ID NO: 679407 - DNA, 479 bp, Homo sapiens
  misc_feature (6)..(6): n is a, c, g, or t
  misc_feature (9)..(9): n is a, c, g, or t
  misc_feature (12)..(12): n is a, c, g, or t
  misc_feature (65)..(65): n is a, c, g, or t
  misc_feature (73)..(73): n is a, c, g, or t
  misc_feature (82)..(82): n is a, c, g, or t
  misc_feature (130)..(130): n is a, c, g, or t
  misc_feature (138)..(138): n is a, c, g, or t
  misc_feature (334)..(334): n is a, c, g, or t
  misc_feature (352)..(352): n is a, c, g, or t
  misc_feature (410)..(410): n is a, c, g, or t
cctggngtnggntccgaggggtccgtccaccaaggagcccgcgtcccagtctatgccgtatagcntgctgggntgtgtcccntcaggcacaggttggtagacggtgacagcttgtgctgggcatatcganggagcaancggccgtgagtgtctggtgtgctgggaggggcgcttgctctgcagaggaaatagccacgtccagagaacgtcctccatggatgccctccgtcctccgtgtcacttggtgggcgctgtcggggccgcgtcctccatggctgtcctccgtcctccgtgtcactcaggtttgctggggctttcactctgcggcacgaantgctcaacttcgtccaanaatattcaatactacatgatgttcgaagtgatggaaccgacctggcacatcctggganaaaaacctgaaatccgcctccaacatttgacgacgtccttggccaccacacaggcttcctggacacctg

SEQ ID NO: 679408 - DNA, 120 bp, Homo sapiens
  misc_feature (29)..(29): n is a, c, g, or t
  misc_feature (47)..(47): n is a, c, g, or t
  misc_feature (73)..(73): n is a, c, g, or t
  misc_feature (110)..(110): n is a, c, g, or t
gatctacaatgggaagcttgtgagtggcnatctttgttggctacgtnctttggtttgatgcagtcatgtgcanatgagacctttgctgagatgcaaataaagtaagagantgttttcctg

SEQ ID NO: 679409 - DNA, 137 bp, Homo sapiens
tgccttgaactctgccaggatttacctgtcgcctttgacacggctctccaacctgttggtgcctcagtctactgctccagtcttgcctgcaccaaccacaacctgcttcaaccctgaggattcttccacctaccagt

SEQ ID NO: 679410 - DNA, 435 bp, Homo sapiens
  misc_feature (79)..(79): n is a, c, g, or t
aggtaggagaactgcttgagctcaagagttcaagatcagcctgggtgagatctcatttctactaaaaaattaaaaaaanacaaacaaacaaacaaacaaaaaactgggcatcgtggcacgtgcctgtagtctgaggtgggagaatcacttgagcccaggaactcaaggctgcagtgagctatgttcatgccactgcactccagcctgggcaacagagcaacacgctgtctcaaaaaaaataaaaataaaaataaaaataaaagccctgctggcgattctaatgtgcaaccaaagttgagaattgatgccttaaaatcattgctccaatggagggaaactgggagatgggtgctccaaaacagcaaaagactctgaaagtcacacatgatgtgaccacaggtgtatacatagaaaaaaacagggagaaccaaaaaa

SEQ ID NO: 679411 - DNA, 1184 bp, Homo sapiens
  misc_feature (31)..(31): n is a, c, g, or t
  misc_feature (35)..(36): n is a, c, g, or t
  misc_feature (39)..(39): n is a, c, g, or t
  misc_feature (44)..(44): n is a, c, g, or t
  misc_feature (115)..(115): n is a, c, g, or t
  misc_feature (125)..(125): n is a, c, g, or t
  misc_feature (143)..(144): n is a, c, g, or t
cctcggagcgggctgcgtcaggtggctggcnggcnnggngcggngctcccctgctctctggctccgggctgcggcgcggcggctggagcgagcccctgtcccggcgcggggcggnggcgggcggncggcaggcgctgccttgnntgtgagtgcacctcactcacatgtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccgtggagctggccaaacccgagaaccaagtacagagtggactacatatctgagtgtagatgaacgtgcctagactatttgactataccctacccgaatactatgagcatgccaaggggtctgtgggaggatgaaggagtgcgatgccatgatacgaacgactccaacgagataccagctgatatgacttgtgcccagtactatcctggacacaagatcgacgatgaatcaagcatgctgactatgtgccgagcgatcaggaccatgactatctgctgccagtgtcctgacttctggaatctattgaggacaagtaccaggtggacaaagtacaactaccacaatgtatgacgtgggtggccaacagcgatgaactgccgacaagtggtatccaagatgcatatcaacgatgttgaatgccctcaataatactgaggatagacagcaagcagcatacaaaatggatcatccagggaaggacacaccaaaacaaccggcatgatagaaggatctaagcctcatcaagagcaatatggaaaaagcaggatggcatggacaccacaacaagtaggaaacaggatcctacacaaggaagagacagtagcgaggagaaaagcccatggcggggaaagcggaaacatgggacatacataaggcaaataggaccggaagaaaaacactgagaaagaacacccgaggacgatagcgacacgagtaacagatgccaacaaacacccagacaggaactgacggataccatcgccggtggacgggggaaaagtacacaacacagcagagacaggaaagccggcacaacgagacacacagagagaggcagaaagagcccgaaacg

SEQ ID NO: 679412 - DNA, 783 bp, Homo sapiens
ttcctggcctgtagaaatcattatacatgccttgacaacaaaggaagttcattaagataagccatgtcggctttttcctctactagatacagattggtaggtagatgaatatttgccattatggacatcttagacaagtgctagtcagaaaagactaactgttttccagcttctcaaaaagccatggagagtagatatacctaatacccacagggtaagatatataaccttgtaaagtctcactttctagttgtcccatgcaggggcttgaaatttgattccaagcggaaagtatattatgttttttcaggccttcacatctagagagatggataacttccaatcctgatttttcaggtaatataaagctgctagtggattttaacccctgcctaaagaagacatatacttcatttgggagcaaatacttattgccttgaacaagtagcactgtcatagcctatgataattagttgtagaataacctgttatccctttcaaaactatgcaaattaattaaataagtgtaaattaggattcaattaaagatgagattgattatattgcaatcagatggaccattcacatacttaactggagcatatacaaatatattagtctatagttttgtatgctaacagaaagatataatttagcatacgtattcataaaaatggtgaatattattaatattgatataataggagtgggaagactgcctccttttttgaagagagagattaaggatttttataattgtttttcactactctaaggtatatt

SEQ ID NO: 679413 - DNA, 515 bp, Homo sapiens
  misc_feature (246)..(246): n is a, c, g, or t
  misc_feature (257)..(257): n is a, c, g, or t
  misc_feature (266)..(266): n is a, c, g, or t
  misc_feature (269)..(269): n is a, c, g, or t
  misc_feature (274)..(274): n is a, c, g, or t
  misc_feature (279)..(279): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (308)..(308): n is a, c, g, or t
  misc_feature (318)..(318): n is a, c, g, or t
  misc_feature (323)..(323): n is a, c, g, or t
ctccgccacaacagtcgtagacgctaatgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccccntggagctggcnaaccccaanaancattncagantggactacatnctnantgtgatnaacntncctaactttnacttncgctcccaattctatcagcataccaatgctctatgggacgattaacgacttcattcctactacgaacactccaacgattaccatcttattaactgtaccccatacttgcctaacaagatcgactttatcaaccaacctaactttatccctatctatccaaacctactttgcctaccatatcctcactttcta

SEQ ID NO: 679414 - DNA, 647 bp, Homo sapiens
  misc_feature (31)..(31): n is a, c, g, or t
  misc_feature (35)..(36): n is a, c, g, or t
  misc_feature (39)..(39): n is a, c, g, or t
  misc_feature (44)..(44): n is a, c, g, or t
  misc_feature (115)..(115): n is a, c, g, or t
  misc_feature (125)..(125): n is a, c, g, or t
  misc_feature (143)..(144): n is a, c, g, or t
  misc_feature (247)..(247): n is a, c, g, or t
  misc_feature (258)..(258): n is a, c, g, or t
  misc_feature (261)..(261): n is a, c, g, or t
  misc_feature (378)..(378): n is a, c, g, or t
  misc_feature (389)..(389): n is a, c, g, or t
  misc_feature (398)..(398): n is a, c, g, or t
  misc_feature (401)..(401): n is a, c, g, or t
  misc_feature (406)..(406): n is a, c, g, or t
  misc_feature (411)..(411): n is a, c, g, or t
  misc_feature (422)..(422): n is a, c, g, or t
  misc_feature (425)..(425): n is a, c, g, or t
  misc_feature (427)..(427): n is a, c, g, or t
  misc_feature (434)..(434): n is a, c, g, or t
  misc_feature (438)..(438): n is a, c, g, or t
  misc_feature (440)..(440): n is a, c, g, or t
  misc_feature (450)..(450): n is a, c, g, or t
  misc_feature (455)..(455): n is a, c, g, or t
cctcggagcgggctgcgtcaggtggctggcnggcnnggngcggngctcccctgctctctggctccgggctgcggcgcggcggctggagcgagcccctgtcccggcgcggggcggnggcgggcggncggcaggcgctgccttgnntgtgagtgcacctcactcacatgtgctggagaatctggtaaaagcaccattgtgaagcagatgaggatcctgcatgttaatgggtttaatggagagggcagcnaagaggacccncangctgcaaggagcaacagcgatgcagtgagaaggcaaccaaagtgcaggacatcaaaaacaacctgaaagaggcgattgaaaccattgtggccgccatgagcaacctggtgccccccntggagctggcnaaccccaanaancattncagantggactacatnctnantgtgatnaacntncctaactttnacttncgctcccaattctatcagcataccaatgctctatgggacgattaacgacttcattcctactacgaacactccaacgattaccatcttattaactgtaccccatacttgcctaacaagatcgactttatcaaccaacctaactttatccctatctatccaaacctactttgcctaccatatcctcactttcta

SEQ ID NO: 679415 - DNA, 315 bp, Homo sapiens
ctccgccacaacagtcgtagacgctaatgcagaaggacaagcaggtctaccgggccacgcaccgcctgctgctgctgggtgctggagaatctggtaaaagcaccattgtgaagcagatgaggatcctgcatgttaatgggtttaatggagacagtgagaaggcaaccaaagtgcaggacatcaaaaacaacctgaaagaggcgattgaaaccattgtggccgccatgagcaacctggtgccccctggctgtccacctcctctgtgctgtccacctcctctgtgctgtccaggcaggggacctcctgggctgtcca

SEQ ID NO: 679416 - DNA, 1070 bp, Homo sapiens
ggagagccccagccacgccggcccagtgtggcctcagcgagggatgcggagacgcccctgaacgaccatggcatcgtgccgacgagctgaccttccatgaattcgaggaggccactaatcttctggctgacaccccatgatgcagccaccaccagcagaagctgatcagctgaccccacaatgggcacgtggctgtggccgtgggctcatggtggcaagctatggagccgaggatgaggtggaggaggagagtgacaaggccgcgctcctgcaggatgcagcagcagcagcagcagacgggattctggaccttcagctactatcagagcttctttgacgtggacaacctcacaggtcctggaccggatcaaaggctcactgctgccccggcctggacaacaactttgtgcgggcaaccatctgcggaaatcggccggatctgtatggcccccttctggatctgtgccacgttggactttgtccatggccgtcaacttgggaactgacgcctggttgctgagccagaggagggacccctacatccactacaagaccccagttccaccaaggttgaaccgtggcaggcatcagcaatctactgctatagcgtggctggtgccccgtggaccctgtggaggcttcctgacggtggcgcaagggtgtccaggagcgcatggggccataaccatttcctgtagactgtgtgcatctacgggcgtactccctctttggcttcatccccatggtggtccttgttggtcgatccctgtgccttgggttgcagtgggtctttgggagcggctggccctggggcctgtcagcgccgggctggtattcacccttctgacgcgtggtccgtgaggaacaaccatggcttggtgggcaaaagtggttgaatgtacggggagcagtacattgatccacgcccctcctgggccatggtgctggtaagttgaactcctcagagtcgctacgcctgacacaggtggatcctagagccaaattcaatccttgcctcacaatcgggtgcccctatttcagaatcgtgcccttctagaagccggtccaag

SEQ ID NO: 679417 - DNA, 359 bp, Homo sapiens
  misc_feature (159)..(159): n is a, c, g, or t
  misc_feature (170)..(170): n is a, c, g, or t
  misc_feature (173)..(173): n is a, c, g, or t
ctccgccacaacagtcgtagacgctaatgcagaaggacaagcaggtctaccgggccacgcaccgcctgctgctgctgggtgctggagaatctggtaaaagcaccattgtgaagcagatgaggatcctgcatgttaatgggtttaatggagagggcagcnaagaggacccncangctgcaaggagcaacagcgatgcagtgagaaggcaaccaaagtgcaggacatcaaaaacaacctgaaagaggcgattgaaaccattgtggccgccatgagcaacctggtgccccctggctgtccacctcctctgtgctgtccacctcctctgtgctgtccaggcaggggacctcctgggctgtcca

SEQ ID NO: 679418 - DNA, 145 bp, Homo sapiens
cgcaaagtgagtgcacatatcataaaactgcaatcatgatataagcactgtatgatacatttctgcttttgtcacaccttcatgtagtcgttgtgtgaaatggtccaggtcatggttgtacattgagagacgaggcagtgaagag

SEQ ID NO: 679419 - DNA, 294 bp, Homo sapiens
gcgggacttgtcaaagatttctctgatattggtctcagactccccagaccacatggtaagaagttcagtacccttgatgtagatgaagttggccggggattcataagtaattgttttggtcaacaaagttatcccacagccaggaggtgcatagaacagtactcccttgcaaggtatcatgccaaacttcaggaatttgtctgggtgctccacaggatactggaccagctcctgtagctcacgtatgacatcctctaggccaccatgtcttcccaggttacctgtggtagctct

SEQ ID NO: 679420 - DNA, 455 bp, Homo sapiens
  misc_feature (423)..(423): n is a, c, g, or t
  misc_feature (445)..(445): n is a, c, g, or t
ctgacaatactgtcatgtttatgcagggaaagaggcagaaagaaatttggcacctccttaaaattgcctgtacacagagttctgcccagctctcttgtaggatacagtctagaaggcacagtaacccctccagtatcagcatggctgccccctacattagcagaccgtgaacatcctctgacatgtgtggtaactcctcaagatggagagaccgttagcacaaatgatagaagaaaatctgaactgtcttggccatttaagtactattattccgtgaagcaaatgaggaccagagcagtagtttgatgagtcttgattggagttggttagcagaatgactcgacactcgtttactgtcctggagcctacgaagctggtttgtcattttactccaaagtcatctttactttgctgaagccattnctcacttaccagtccgtgagangatgggctgt

SEQ ID NO: 679421 - DNA, 123 bp, Homo sapiens
  misc_feature (5)..(5): n is a, c, g, or t
gggtngtaagcctttccatttgtgtagtctggcaggttaggatttccggggtggattgaaggtggggccggagttttgggacgggacctaatggatatctgccagggagggcggtgaccaatg

SEQ ID NO: 679422 - DNA, 300 bp, Homo sapiens
tatggcgatctggtcgaacttgccagcgagctcattcagtcaccaccagcagctccttgggagaacagtcgctggccagctgcgtgaagcccactatgtccgcatagaggatgctgacattctggtagcctacttgacgtaaaggctagtgagaactagtatagtcaggcatgcagcgacggtcaccatgctccttgagccgtacgatgatagccagctacatgcccatagagatatgggccggaagcactcacagcggcatgtactcctgctggcgcgtctagatgcgcagctaccggc

SEQ ID NO: 679423 - DNA, 354 bp, Homo sapiens
  misc_feature (216)..(217): n is a, c, g, or t
  misc_feature (224)..(224): n is a, c, g, or t
  misc_feature (234)..(234): n is a, c, g, or t
  misc_feature (241)..(241): n is a, c, g, or t
  misc_feature (271)..(271): n is a, c, g, or t
  misc_feature (275)..(275): n is a, c, g, or t
  misc_feature (317)..(317): n is a, c, g, or t
  misc_feature (328)..(329): n is a, c, g, or t
gcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactctttgcttgtcagggcttgcaaaaaccaaccttcgagaaagaaaagggaacttnncacgtgnaatgtgactntgtgtgntgcgtgtgtgttgggtttgtgtgcccgccncgtntggcgtgtttacttcatggaatttttgtttgtggtgaaattnccctccaattnngtgtcaagaattttacctccatgcc

SEQ ID NO: 679424 - DNA, 132 bp, Homo sapiens
taagttccagcacttgggaggccgaggcaggcggatcacttgtggtcaggagtttgtcaagaccagcctggcctataagcctcttctgcaattcttctattcctagttcttgctcttgcctgtctctgcctg

SEQ ID NO: 679425 - DNA, 676 bp, Homo sapiens
  misc_feature (487)..(488): n is a, c, g, or t
  misc_feature (569)..(570): n is a, c, g, or t
  misc_feature (595)..(595): n is a, c, g, or t
  misc_feature (608)..(608): n is a, c, g, or t
  misc_feature (643)..(644): n is a, c, g, or t
  misc_feature (652)..(652): n is a, c, g, or t
  misc_feature (656)..(656): n is a, c, g, or t
  misc_feature (658)..(658): n is a, c, g, or t
tgttgggactgctgataggaagatgtcttcggaaatgctacaatggggcaccctgcccccacttcaaagccagagctgttatgccagatggtcagtttagagatatcagcctgtctgactacaaggagaatatgttgtgtgcttctttaccctcttgacttcagcgtttgatgtgccccacggaagtatcatcgctttcagttgatagggcagaagaatttaagaaactcaagctgccaggtgatgggtgctctctgtggacttcgtcactatcgtgtctatctagtcatgggtcaatatcagcctaacgacacaagggaggactgggacccatgaacatccctttggtatcagatccgaagcgcaccattgctcaggattatggggtcttaaaggctgatgaaggcatctcgttcagggcgccttttatatccattgagtgactacagggtattcttcggcagatcactgtaaatgacctcccgtnntggccgctctgtggatgagactttgagactagttcaggccttccagttcactgacaaacatggggaagtgtgcccagctgnntggaaacctggcagtgatacatcangcctgatgtccanaagagcaaagaatatttctccaagcagaagtgagnngctgggcntgtntnagtgccaggctgcaggtg

SEQ ID NO: 679426 - DNA, 134 bp, Homo sapiens
gcaacccaaaccacaaaagaaaaacccgcaacaaaaaaaaaacacaaacaaggaaaaaaacaaacaaaaaagaaaggaaccaggcaggaggaagaaaaaagaacaaggaaaaaaaaaaaacccacacaagacac

SEQ ID NO: 679427 - DNA, 362 bp, Homo sapiens
ctgctggagctctactacagcatgcgccgccctgcctggatgattacagtatccttagctgagccagccctggaccatgttagccaggctggtctcgaactcctgaccttgtgatctgcttgcctctgcctcccaaagtgttgggattacaggtgtgagccaccacgcccagccgaggttttcttttcacacaattctttgtttattatttttatttttggagagacagggtctcactctattgccgaggctggagtgcagttgcacaatcgtaactcactgcagcctcaaactccaggctcaagtgatctttctgcttcagcctgctgagtaactgggaccacaggcttgcaacaccacac

SEQ ID NO: 679428 - DNA, 762 bp, Homo sapiens
  misc_feature (750)..(750): n is a, c, g, or t
cgtggtgcgccgtttttcaagcctgtcggaaaagcgcagtatgcgggtgggagtgacccgattttccaggtgccgtccgtcacccctttctttgactcagaaagggaactccctgaccccttgcgcttcccgagtgaggcaatgcctcaccctgcttcggctcgcgcacggtgcgcgcacccactgacctgcgcccactgtctggcactccctagtgagatgaacccggtacctcagatggaaatgcagaaatcaccgtcttctgcgtcgctcgcgctgggagctgtagaccggagctgttcctattcggccatcttggctcctccacaaaacaattaaaattggcgtacaagggacatacctcaatgtaataaaagccatctatgacaaacccacagccaacataatactgactgaggaaaagttgaaagcattccctctgagcactggaacagacaaggatgcccactctcaccactcctcttcaacatagtactggaagtcacagccagagcaatcagacaaagaaaagaaataaaggtcatcagtaagaggaagtcaaactgtcactgtttgctgatgatatgaccatttaccttgaaaaccctaaagattcctccagaaagctcctagaattgataaaaggcattcagcaaagtttacagatagaagattaatatacacaaatctgtagctgttctatataccaacagtgatcaaatggagaataaaatcaagaactccaccccntttacaatagct

SEQ ID NO: 679429 - DNA, 468 bp, Homo sapiens
tgatgcgaggtgatctagaggatccctcgaagatggcggtgggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgaaaaaaaaaaaaacaaaaacaagaaaaaaaaaaaaaaaaaacaaaaaaaatggaactatagttgaaaagtacttgcgagaagatacagtacagtcagttaagccatggttaactgaaatcatgaataattataaggttctgatctacaatgg

SEQ ID NO: 679430 - DNA, 982 bp, Homo sapiens
gccgcacctacaccagccaacccagatccctgagtgtcctgacagctgccctggcccagatccccactgcctgccagtgagcaatgcctgagatgccagcctgtgcctggctgcactcctgactcctgagcatgtctctgtccttctgaccctgagcccctgctgcccatttcctgtggacccactgcccctgctgggcagctgctgccaacctgcctgtgccatggagacccctgtcccagctggctgctgccaccctgcagctgtgggctggcagtgccagctccactccgctgtctgcccaccctgcatcaccctggctgcagtgagaaggaggacctgcagtgagctcaatgatctgcttggcggtctacatcgaccgtgtgcgctcgctggaaactggagacacgcagggcttgcgccttcgcatcaccgagtctgaacgaggtggtacagccgcgaggtgtcctggcatcacaggccgcctacgaggccgagctcggggattgcccgcaaggaacctttgactcaggtaagccaaaggagcgcgccctgcctgcagctggagctgagcaaacgtgcgtgaggagtttaaggatgctgaaatgcgcgcaataccaaggcacggacgggtgagctgataggcttgcttcaggctccggcgttgaagggacccttggaccgctcctggcatggaactcccagatgaaggccgcacactgtaggccacctggtcctacaagtggacaaaagtgccacgtcgctggaagggccagaccgtcacttaacattcctcgggagcccactgatgtgtgccccaatgcatttcacaggcacgcgcccctaactagagtacaggccccaagaaaagccaccttcacgggtatggacacggtacatgtgccgcgggttgtgacatctcttcaaaaacaggtgcgtgaggaacccgttagatcgggtaccagtagacttagcgaagtaa

SEQ ID NO: 679431 - DNA, 352 bp, Homo sapiens
ggcctagacgatccccgtcagccacctggtgatgctctggtggatccgggcaagtaaactgattaccttctagaaaggattcacgcattctagatgccatttacaacatttgtgattctattgcaggaggtgaaaatatcaatcattatagcaagagttgggaataagtagactcctagcctcatgcatgatgttgaggggttcacgacttcagtggagtaagtcactgcagatgtagtgtaaacagcaagagaactagaattagaagtggaacctgaagatgtgactgaattgttgcaatctcataatcgaatgtgaacgaataaggagtttcttatgatgaacaagtttc

SEQ ID NO: 679432 - DNA, 162 bp, Homo sapiens
cccccaggtttcctgtctgtgagcattcttgaggcaacggaattctggcgttggtgcactgggcagtggtgtccaggggccgggtgtggttttgaaggggtggctcccttgtgatgattcaatatgctgtgtttgtccgttgtggttttctgtaaaaatgga

SEQ ID NO: 679433 - DNA, 323 bp, Homo sapiens
ccaaaaggtgattctttttaaagactgataagactgctgccgggtgtagtggttcacgcctgtaatcccagcgctttgggaagctgaggtgggtggatcacttgaggctaggaattcaagacctacctggccaacatgacgaaaccccgtctctactaaaaatacaaaaattagccaggcgtggtggtacatacctgcagtcccagctacttgggaggctgaggcacaagaattgcttgaacccaggaggtggaggttgcagcgagccaagattgcgccactgcattccagcctgggcgacacagagcggactctgtctccaa

SEQ ID NO: 679434 - DNA, 844 bp, Homo sapiens
  misc_feature (382)..(382): n is a, c, g, or t
gcgtttgcagatcgcaccgcggagaaaaccgtgtactattagccatggtcaaccccagcgtgttcttcgagattgccgtcgagggagcccttggaccggtctccttgtgagctgttggcagacaaggtcccaaagacagcagacaattttcgttgctctgagcactggcggagaaaggatttgttataagggttcctgctttcacagaattatcgcaggtttatgtgtcagggtgtgacttcacacgcataatgcactgctggtaaagtccactctatggggagaaattgtgaccgatgacgaacttcatcctagagcatacgggtcctggctatctgtgtacatggctaatgctggacccatgcacaaatggttcccagtntgttcatctgcactgcaagactgagtggtcgcatggcaagcatgtgtgtgtttgcaaagtgaaagacggcatgaatatgtggaggccatgtacgcgcttgtgggctccacggaatgccaagaccagcaagacgatcatcattgctgactggggccaattcgaataatttgcactgtgtgttttatcttaacagcagataattcctttgtgtagctcaggagaggcacccttcaacgcattgtgctcgagatcttagaatctgtgtgctctcgtgcaggtccctggggatccaggttaccttgtccctccatgctagtggattgaagagtaagttaggagtatgacatacacataattaccacagacttcgaacaaattttggcgcgcgcagaacttatacacttgggcggccaaatgaatgtacatgtacaatcgtccttgggttccaaaccgccgtcacac

SEQ ID NO: 679435 - DNA, 268 bp, Homo sapiens
tcatggtggctcacgctgtcatcccaatttgggcaggcgaactgggcagatcacttgaggtcaggagtcgagacagcctggacaaaatggaaaaccccatctctgtacctaaaaatacaaaaattagccaggcatgatactgtgtgcctgtaatcccagctccttgggcggctggggcacaagaatcacttgaacccaggaggcggacgttgcagtgagccgagatcagaccactgcactccagccggggtgacggagcgagatctgt

SEQ ID NO: 679436 - DNA, 286 bp, Homo sapiens
agtcactgatcgatgcattgtttcatgctgtgtggcctgctcggtatcccactgcagctcgttctctcatgaaggtccgggtgacactatatgttacgaccatcaaagtgatttgggggatgctcgatagtctcactgagtgcttcttcatatcggtatatgaccttgattctctcggtacccgattggcatgaacccacgccctctctggctggttgctaaaaaactggacatgatattctcgggcacctcttgtgttaattttagtatgaacctcaagctgggg

SEQ ID NO: 679437 - DNA, 129 bp, Homo sapiens
tcgctatctcggcacccgtattgaattcaagtatatattaagtatgcagtggacctctagagctatggtgccgatgaatatgcgccctcgagcagtactccccccggaacccaaagctctttgagtttc

SEQ ID NO: 679438 - DNA, 338 bp, Homo sapiens
  misc_feature (16)..(16): n is a, c, g, or t
  misc_feature (67)..(67): n is a, c, g, or t
gatattgaaagaaggnaagaagttgaaagcatcttgaagaaaaactcagattggatatgggattggncaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagc

SEQ ID NO: 679439 - DNA, 241 bp, Homo sapiens
atcacgctgttcagtgtgcttaagggggattaccttataattctctcactacacagtgacgggcctgggtagcgtaggggactcaggcgaccagctgcgcggttaggaagtatcccagggcatggggctgcctaggggcttacatggaagtcaaagcttctcacaggcagtcagagcagggagtgtgccagccaccacgaggctctgttggcactgaggctgaagcctgtgggtatgtccc

SEQ ID NO: 679440 - DNA, 245 bp, Homo sapiens
cacacgaagcacacaggaaggacttcccctgaggacaacaggcacgggagagtcctgagggcagcatgcactgtttccagaaggggggtgggcacctagagctggaaaccccagagaccattcccaaaagcctgatttccaggtgacacagccagctgacttcacaaggtatggcatcacacaggctcaggagagagaggcagagggaggccagaatccagtggctgtggtgccgatgaatagcg

SEQ ID NO: 679441 - DNA, 1305 bp, Homo sapiens
  misc_feature (333)..(333): n is a, c, g, or t
ccagaagtggtgcgaatgagacagagacacagaggtgtccagaagagctcaactccaaggaatgtgtctcccactctccctttgtgtagagcccgcacatgcttttttcttgtcccccactgtttgtgtccctccaaaacggccctttggtgggtacgcgcaacacctacttctatatcgagcggacatccctttttcatcgaggggtgccccccggagaattattgggacgaccttctcctatgagtttctttcatattatggctcctcatgtcaaaagcaaaaattgttttgtgacactcgcggggattttgtttgtagcctcccacgcancaggcaaccacacttgggggggcgggagatattcagcatctcaccccacccgctgggggggccctacaagaagcagtgtcattatttcctaacacatgggggagtcccgaggaaatgtttacccccacgttgatgagtgtgaaagcgctactagatttgtgcctcacaggaaatgttcctttatattcctcatgtcgcagaaaacccccactgttgtcccacatggcagctgttttccttttttgtctcggaaaaatggggggatctcccccccacacgcgaagaagtgcccaatggacaacacccccccgttatgttgtaaaaataagcgcgcgccttttaattggcgccatcgccacagaatgggacatattttccaccccgtgtcaaatagtgcctaatttaacacaccctgccgcattcctctgggggatactctttcacagggacccagtttttctgtgtatacacggtttgacacatgggcccccaagatgtctcataccgcgtaaagagccctttaccttcgccacattggggaacccaccgcgtcgtatgcgcgcccacttagagccataaagtggggattttcccacgatagagctgaggaggtctctctcactgaaacagatctctcgttctttatgagggatatccacaacctatggcaccgggagtttctccacacccacgagaacatgcgagaggacgcgctttctcgcgatgtgtggaagggcccacatataaggtaaaccctaaatgccaagacgcccctatcttcacttccgagagttttcaagactctccttaacccctgtaacatccttcatacaccgccattctcatcactccccactaagtcactttatttttcaaccctctataattgcttttttgttttttttttttggggggggttttagaacagtgcactggcaaatagtaggggctcaataaaaaagtgtttgttga

SEQ ID NO: 679442 - DNA, 165 bp, Homo sapiens
agcccaaacagggtgcaggtgctctggccctgaagaacctgagtggagtggaatggcactggctaggccactacagctacagcgggcgacgtagcccctaacaagtatggcagcaagtggctagccactagctagggtattgtagtacagacgaggctagcgagg

SEQ ID NO: 679443 - DNA, 330 bp, Homo sapiens
ttagttttcagcagttttgttttacaagaaacttagcctggtaaagtataagaatgcaaaatactggctgggcgtggtgactcatgcctttaatcccagcactttgggaggccaaggcgggcggatcacgaggtcaggagatcgagaccatcctggctaacatggtgaaaccccgtctctactaaaaatacaaaaattagcttgggcgtggtggtgtacgcttgtagtcccagctactcaggaggctgaggcaggagaatcacttgaacccaggaggcagaggttgcagtgagccgagattgcaccactgcactccagcgcaagtctcaa

SEQ ID NO: 679444 - DNA, 972 bp, Homo sapiens
  misc_feature (46)..(46): n is a, c, g, or t
  misc_feature (82)..(82): n is a, c, g, or t
  misc_feature (142)..(142): n is a, c, g, or t
  misc_feature (181)..(181): n is a, c, g, or t
  misc_feature (241)..(241): n is a, c, g, or t
  misc_feature (255)..(255): n is a, c, g, or t
  misc_feature (264)..(264): n is a, c, g, or t
  misc_feature (271)..(271): n is a, c, g, or t
  misc_feature (277)..(277): n is a, c, g, or t
  misc_feature (279)..(282): n is a, c, g, or t
  misc_feature (324)..(324): n is a, c, g, or t
  misc_feature (327)..(327): n is a, c, g, or t
  misc_feature (608)..(608): n is a, c, g, or t
  misc_feature (614)..(614): n is a, c, g, or t
  misc_feature (683)..(683): n is a, c, g, or t
  misc_feature (691)..(691): n is a, c, g, or t
  misc_feature (762)..(762): n is a, c, g, or t
  misc_feature (778)..(778): n is a, c, g, or t
  misc_feature (793)..(793): n is a, c, g, or t
  misc_feature (795)..(795): n is a, c, g, or t
  misc_feature (860)..(860): n is a, c, g, or t
  misc_feature (871)..(871): n is a, c, g, or t
  misc_feature (907)..(907): n is a, c, g, or t
  misc_feature (910)..(910): n is a, c, g, or t
  misc_feature (969)..(969): n is a, c, g, or t
caagctctactgggtagctgagttaatagcgtccagtgtttaaagnctgggcgaagcggggagaaagaggaaaggaggaagnagcacacacttcgaagagcgccacttttaagcacgcgtacatttatgaagtattaaaaanaaaggatgcgaacaaaaaaggcaattcaggcagttttcngaaagagggtttggcggtatggaacgcgtaaggagactgtgcttggggccgatccactcnctccagcttctcanggtgtttgngggcatngggggngnnnnggggggtggcgcgcagaagggatcgacggatcttgacatgancancatcacgtacgtatattgaggtgaagatgtcgatgaaagcagcgaagttggaattcctaacttccatgctctggaaggaagcggccaatttactgcagctcagcttgaactgtttgatgatgtcgctgatcttctcaaaccggtggacgtcgcgctgctctttgcactggtagtgggaaataaccaagaatgtagctctctcgaacagcagaacttcatcggcctcaatgatttgggcaaaattcctgaggttcatctccagctaaagaacgttgggaatnagctgntagacgatgctggaccaggctttgtagagcgtctcatcacagatggacgtgcgaaagcaagcacactcnagcgggcngagagagacgcctcatgtctgtctctcgctctttataaatcaggtcacgctgatcctcctgaaccagatcnattttgtgcacagggngaagattctggcgtnangagagttctggaggatggcctccagacacgactggtaataatgcatgtctttttccagtgcgcgnctctgcacgtnacacacgtgaattaaaactctcacgtgacggaaganatngtctcgctggctggtgaagtgattttcatgaaggtgtctgaccgcacagtacacaggtnagc

SEQ ID NO: 679445 - DNA, 520 bp, Homo sapiens
tctagaggatcacgtatgagtccaggcccaagcacaggtccaggtgtccgttcgtgcagggggcccttgagccttaagtctgagacacatgtaattccaggagcgggggactgcctttccctcgctgatagcattcccggggtggatttcagacctgtctgggctttctttcttttatttttttggagagagtttggctctggttttccaggctggagtacaagggcacaatctcagctcaccacaaccttcgcctcccaggttcaagcgattctcctgcctcagcctcccgagtagctgggattacaggcatgtgccaccacgcccggctaatttttttgtatttttagtagagatggggtttctccatgtgggtcaagctggtcttgaactgctgacctcaggtgatctgcctgcctcggcttcccaaagtgctgggattacaggcatgagccactgtacccggcttggctttcatttaattgtgatttcattggaagaagatgttagacttctgttc

SEQ ID NO: 679446 - DNA, 87 bp, Homo sapiens
gatcgcagatatcctaattaatcacccatgcgtatgaatatcttgatccactatactgcctactccaatctggacctatccttaacg

SEQ ID NO: 679447 - DNA, 834 bp, Homo sapiens
  misc_feature (743)..(743): n is a, c, g, or t
gactagttctaggttcggcatgcttacaggcatgatatagtactaggttgttagctattctgggtgtgcttggagcagctctaagaccggcaacatggcccggttgcccttgcgatcagagagaaaagggctgggcgctccatgagttcagcctgaggctcttcgaacatccattctgcattccatgcaatggtgttctgcccaatatggattctcttccccccgagtctacctctagaaactgacgatgaagactaagccaatgccgatatccaggataaacttcagagagagtcatatattgggacgcgtcgaccatgaggtgtcctccgacctcaggtacactctgacagatggagaacgtcgcgatgggatgctagaatactggtgtatttaacttactgtagcgactatttgccaatgagttcgcttgggttcaagtgtaccacgagagttatggcgtagtaaagcgtgtaagagtgatcaatgcactgtatgtagatcctgatagcagttattcataacataggcaaagtggtttagcccacgattgtgagcacggaacgcttgaagcaggatctagcccatgtccttgcagaaagcgtggcgcttggtccgcatctactgacgtagacaatggcatccctctcgaggaggctactggaatatcaccctcaaatgcatgcttctcctgacatggccatctctagtatcaaggcgtcttgtgctttatgccatgtggnctgtgaagccgtcatctatagagacccaaatcacagtcgcagctttgaaagtgatagagtcagacaactcacaggacaaataagaccaagg

SEQ ID NO: 679448 - DNA, 383 bp, Homo sapiens
tgagacagagtctcgctttgtcacgcaggctggagtgcagtggctcgatctatgctcactacaaccaccgcctcccaggttcaagcaactctcctgcctcagcctcctgagtagctgggtcgagggtcaccaagcccggctaatttctgtatttttttttttttttggtagagacggggtttcaccatgttggccaggctggtctcgaactcctgacctcaagtgatctacctgcctcggcctcccaaagtgctgggattacaggcatgagccaccatgcccgaccagagagttcttatatttttaaaaaattgggtaattccctgatactgcatgataactttgttataaggtgtgtgtattatggattgaactgggttccc

SEQ ID NO: 679449 - DNA, 440 bp, Homo sapiens
agacaggtacattcaaaaatccctactacccataggccctagacgacgagtatctatatatcctactaaccactgaagacatctaacagctcctttctctccatagcagctgctatatactggttcaggtccatatgcaccaccagacaggactactgcagtgattttcctcatgggtctccctgcttctaggatcgaaactcttttagtgtgatcatctttctggagcatagctctgattagaagcatcactgtgtcgcatatggataaatgctctagcatggcttaccagccctatctggcaccagtctgtctgcctgtctttctttgccttaaatcatcctatgtgccaacaaaactgaaccattcacggacgggcatggtgcctcacacctgtcatcccagcactttgggaggccgaggtgggcggctcagtcgac

SEQ ID NO: 679450 - DNA, 827 bp, Homo sapiens
aaggaatagaagtatacagttccatgactagatatccccagtaccatcggcgtctcgtttcatcagagctctatctccagactacccgtcacaagcatggggagcgagaacactgaacatgcaagtccagaccatatgacgctgcgtcacagcatctccgctgacttgctcactccgagtgcagatggcttgtgagccctggtgccagcttcctctagtgcagtagtctgtcggccgtaactagagcgtgggtagtcactggctgccctcatagacaagctaactgtctcatagatcgtacctcaacagtgatctcagcagcgagagggcgatcccaacacagcatcgtattggtgcgagatgcattgtgcaagcatagtgtcatgtccccgcagtggaccttgcggacaagacgtcgttcagagacacagaaccgtatcatgcataccgttcgaccaccaaaacgtcaccagcaatcgactgcatcggctagctacctcacacgaacctagcgtgggctgcctctaacgtgcgttcagtgaatggactagtggaactagggtcgaggacagttcgctgcggcatacgtgcgagtgcctgctcctgttggaagggtaatcatgtggacttctaagctgcgccggtgtgagaatcccttgtggagcccttccgccagtatgctcatcctggcgccatgggaagtttgcccactcacagtgggcccacacagccctatgttcctcaattaaaattaaagttggatctataaacaaacaaacaaaaacaggagtgaactataagtagtcagacgacggcacggacacggt

SEQ ID NO: 679451 - DNA, 689 bp, Homo sapiens
  misc_feature (8)..(8): n is a, c, g, or t
  misc_feature (120)..(120): n is a, c, g, or t
  misc_feature (126)..(126): n is a, c, g, or t
  misc_feature (150)..(150): n is a, c, g, or t
  misc_feature (155)..(155): n is a, c, g, or t
  misc_feature (206)..(206): n is a, c, g, or t
  misc_feature (294)..(294): n is a, c, g, or t
  misc_feature (324)..(324): n is a, c, g, or t
  misc_feature (362)..(363): n is a, c, g, or t
  misc_feature (369)..(369): n is a, c, g, or t
  misc_feature (689)..(689): n is a, c, g, or t
agcggganggaacgtgactggtctcctaaccaaggtgcactgagaagcaatcaacgggtcggtcgtggccagtcctggggaggtctgagtggtggtctttgggataaccttggccttatnggattnggactcgaaattagaagagcctancattntcagatgcaatcactttggacatgcttgcagacagtcctaagctgaaacanagagagggtatcaagaggcttctttaaaatagactttgtgacacactaatgtaagtatgcaaggtcattgcgtgtgtcataaagtganttcttatggtgaggtcacgaagtagtggtngttgatggaaatagctacagctggtcccttcctgcttnnactttnctttgcttctcggagggtatctccaccatcttctgcacaaagatgtcttcgtctcctgaacattaaaaaatgcagaattatgtgactggttagatggcctcagaagttatgctgtgaattttacagaaatttattggcttatgtggataatgtatagtaccaaagctgtttttatagcacatagatgtgtgtaacaagtaatgttagcagttcttgcactttgaccaccaaggtgtaactagaccattatttaaatgtcagttgaaaattatgggtgtactatgcttgaaacaaaattggaacgggagtggataccatan

SEQ ID NO: 679452 - DNA, 483 bp, Homo sapiens
  misc_feature (22)..(23): n is a, c, g, or t
  misc_feature (27)..(27): n is a, c, g, or t
  misc_feature (211)..(211): n is a, c, g, or t
  misc_feature (473)..(473): n is a, c, g, or t
catgtattgatacagatttgtnntggntttaattttttatttattccttttactggtttcgaagtgatgatccttttattattcttttagcgcttaccttcaaattttaaatggacattattgaggcttgtcaacgtctacaaaagtgtactggaattttgattgggattatgttgaatcactggatcaatttttggagaactgacaactncacaatattgagtgtgtaggtttatatatgtgatatagctctccatgtatttagatttttagttctcctacacaatcttttatagttttaattaaacaaattgcacacatattttaaaaaatgtatccctaggtattttatcttctgatgctattcgggagtgctattagtgctttttaaaaaatccttgcagttttttgatgttttagttatatataataatgcacataattttgttataaaaacaaaaaaaatggcctcngttggcctca

SEQ ID NO: 679453 - DNA, 519 bp, Homo sapiens
aaaaacttcttatcactatcaaaagtaatctcacttggggctaatttacccctatcccacccaagctgggtaggtcaaccccttctgctccctcttccctgggaatggccctatcaccccgcttagcttgagtgtgcactggatgcccctcactgagttggtctctgggggcaagatctggttctcaaccactcctgcactcttgcacacagcaggggtggtgtctgggtccggggctgcagcggcaggtggggaacgggctgtcagtcacagccacccaaaggggggctggaccccacgtcacccccacagggacaggcaccgccctgcctttcttcaccctccagctctgctcatctccttgcccttaactagaggtaccttcccagatggccgtcttctggaagatgccaggggtgccttcctttcgccactcttgaggcacatcatactgttccctgcagacagaaatgccttgagcagctgtaggcaagagcagagctgaggagggacttggtg

SEQ ID NO: 679454 - DNA, 167 bp, Homo sapiens
cagtacctcgaggagggtcgggggtgggcatgatgcgtgcccagctctggctccggcctcggctctctggcttctgatagccagaactggtatcttctcaggaaccttcactttgtccttgtccctttaccattccccatcaaagagtagtctgctatatcaatttg

SEQ ID NO: 679455 - DNA, 159 bp, Homo sapiens
cgggtagactaaatccagcggccaggaagaaggacgtggaaagattcttcaagggatatggacggatacagatattgactctgaaatagaggctttggttttgtcggatatttgatggatccaaggagatgctagataattgctgtgtattgagcttcg

SEQ ID NO: 679456 - DNA, 1009 bp, Homo sapiens
  misc_feature (583)..(583): n is a, c, g, or t
  misc_feature (698)..(698): n is a, c, g, or t
  misc_feature (711)..(711): n is a, c, g, or t
ctatgtatgtccttcgtgccttgcattagctaataaaggtgcttgacgcgatgcttcagctggaggaccaaaggttaaatatgcaaatatacgttaataacatgtgtaaccgttatgtaagcttgtgtcacgtcaagtagcaagctaatctatttgtgtgcactggactagggctttgtgctccctacttcagtatttggatgcttgccttggatcttttgttctcagcaaagatgtagttgaaattccgggatcgttcaaaacgaatgacattgattaggtgttcattttcgaaacgatgtacagactgaagtccgcccaacttagaaaccggttggttcttaaggtgtcttgcgtctagcccatagaagccgctacgtgacctccaccacagcccaaatggagggctgtgatagccagatctggttggctttgtgggctgacccagacatttaatcaccatctcttatgtggtcgccgtaagaaatgcattccaggttgggacttgggatcctgagagcacattcgccccctgtggtggccgttgccaccttgcaagatggaagcccagtctccttactancaaactgtagttgtaagcagagggaggggtgagatgttataggacattccctaagctggggagtgattttatcactattcatgtcaactgtacttggtatagactcctatcattnataatatgaaagnctaaataaaactatgcatgctattctatgtgctattttatatcagtaaataagctaatgcttgccagttgaatacacagttatgaggtgatagaactgacttggccagtatttttggcactgtttccaatctgttttaaaaagtcttattagaatggggcccgggtgatggtttcccgggccctgggcttgcaataaaaaggtttaatgggcctttaccaatgtaagatctttatcctaaccttttttgtaaaagatatctattgatttccatatgcaataaacctttttttcagaga

SEQ ID NO: 679457 - DNA, 1002 bp, Homo sapiens
gggaaattaactataatgttcgcactaagattgctgggagtggtaggtggacatatctatatatcaataaggactaaccgtctttttgtacatagcgagatgataatactgtattgttttaagcccacaggtttactccactttcaaaaagatcaattgggcactattcttcatattttttcatggaaataagcattggtctctccatttcaggttaaatgataactagaaagcattaacactagcacagatcgttctaggtggagtcatatttttcaaaactccagaacatgtatattggtcctgtgttaccaagttccatatgtgacagcagcaaccgcagaaatccccttgcaaatgactcatcgacggttacacatcttctctcattagcgaggcactggggacgacaccaggctagctacggtacagacttagcccgactaacgatcgcacaacgtccaccacacgacacacgaggagacaatggcgtaacatggcggatggatcaacagccacggataaggacacgttcccaggtacagatacacaacaggcctggatacaggatctggaccagcagttcaaccaacgcgtacccctgagcgcagaacagagtacacgaaagagcccaccaggaggcgaccgtgcgtagccaccagacgcatgaaaggccccattggacaagcaacttacttaagccccacagacaccgctcctcaccacacaccggacaccacgcacacgtagaaccaacacacagcatcaaaattagagcaaaaaacgtaacacacccaacaagcgatccaccacaaaacagagccatcaccagcaccggctaccactccgccccaacccccacccatcaccacaccaaaacgaggtcataaatcacaacagaggcaaccaaacaacaccagaaaaccacacacacgctataacgagcatcaacaatgcaaaacgacaagcacaagcccaccagcacccacaaacaaaacgaga

SEQ ID NO: 679458 - DNA, 121 bp, Homo sapiens
aattgcttgaacccaggaggcagagggttgcagtgagccaagatcgtgccattgcagtctagtctgggtaacgagcgaacttcctgtctcaaaaaaaaaccatttataacaccattagggt

SEQ ID NO: 679459 - DNA, 190 bp, Homo sapiens
gttcgcggaacgaagtggctcagtcttccagagccacatcatcgcgggtcgaaatataagccgagagagaggtaggtgtcggaggcctggaggtactagttgagcaggctgtggacggctgcctccacgtcggtggaataattctgacgaatctgggagctcatgggcggtcggcgagaaggagctaacc

SEQ ID NO: 679460 - DNA, 497 bp, Homo sapiens
  misc_feature (40)..(40): n is a, c, g, or t
gttgagtctagaggatcccagcggggaacaatcacttgtncagtatagagttgtactagaaaacagccatgtccattcatttatgtatggcctagggctggtttcctctctacgagcagagtggagtgatggccacaaagccaaaaatatttactacctggccctttccacccccaccctctgccttcatttcccgcatagccttcgtatgtggctggtttatttgcgctctgctgttgggctcctataagacaatataagttcattatggcagaggtagctggaacacagaaggtgcttactaaaatatttaattgaatggaaggcgggatgaaacacacaccctaaggggaaagaattagctaaaggtgatgtggctggcccaaggcagagccagtattagaatcatttttttttttggtcttggagagggagtttggctctggtggcccaggcggggcaacagagtgagactcggtctcaaaaaaacaggtggt

SEQ ID NO: 679461 - DNA, 322 bp, Homo sapiens
ttactcgacggagccgccgcccgcgacggcctggaaatcctgttcgatcacctggcaccggtgcttgggccggagttcgccgccatgcacgtcgcacaccgctcgggacaagacttcccggggaccgtctaccgaatccgcctgacggaaaagacaggtcgctttgaaaagacggcgttctagtcacttctgacttaacttggcggccagggtagttcgcgttcggtcgcgtatgtgcaacaccaggccgcggttgtgcggaacgcggagggtcctgcgcgtatcgcacggcaccgacctcgcccgcatgcgggatcagcag

SEQ ID NO: 679462 - DNA, 487 bp, Homo sapiens
agccccaagtatgataataggcagactattcccaactttctgtctagtttccagccattgaagtgaactgctaaacaaacaccaataattgaaatgttgagagatatggtcatgtaacttagtcctctgctgtttacttccccaggagctgatccatttatccatgcacttttaataaaccatggaataccaaggctcaacatatctaccccattggatcccacgatgttagacatagccatatctcctttgccctcaaaaagaaaagcatactgttaaaatgtgcttaccaatactgtgttttattaataatcttcacaacaaaagaaactctgcatacttttttgttgttgattcgttttcaaaaattgttgttagagcaaaagtcttactcaatttgtatttttaaatctttcttgggttagcatttaaagtctcaacatttattcaataattatatttattaaaccatttttcaataaggtaa

SEQ ID NO: 679463 - DNA, 199 bp, Homo sapiens
tcccccagggggggggggggtgggcaaaatggggggccagggatttcctccccccccgggggggccccccaagaagggatggaaaaccccccctccctccctggggccattgaaatttagggcgggtccccttcctgccccgcccctttttttggggtttggggggaaagaacaaaaaaaattttattttttgtcctga

SEQ ID NO: 679464 - DNA, 1044 bp, Homo sapiens
atcgcaatggcatcctaatgcttaccgaacgaaaaatgctaggctatatacaactacgcagaaggccccatacgattgtaggcccctacgggctactacaagcccttcgctgacgccataaaagctcttcaccagaacgagcccctaataacccgccaccatctaccaagtcaccctctacatcaccgccccgacccttatcgtcggtcaccaatcggctctctcctacgtgatgaaccccgcgttcgcctgtgacgccaagcaccccttggagtggagaccttcaaactgaggccgtgtcctcagtgtcttctgcgtagtcgcactcagctagggcgtacttcggaagtacaccagaatctattcgtggatccccgaggatggatcatggaaggtcgcatcacaaccgacacctatgacctccggctagactggtcgacgtcggtcgatcgcaaagaacaacacgctagtagtaaatgatcaaaccactagctcgaatcggaatcctatctaaaacgaaacattcatcagaaaataaaagcaggctccttccaagaccttcgaccatacatataatgcgaccagacacaacagatccagcacttactgagtacaatagcagagaagagaaatgatatgcgaagtgacgacaacaatctagatgagtgtcctcatcacggagcatacgccagacgacgcgaaatcaagaagtcacacacatcaacagccttgagatagacaagtactgaggtactgaagactcgacaacacgcatacaaccaatgaaaaggaactcacgaagagccccatccagaccggcagacaggcgagtccgacgcgcaagtaggaaaaacactcataggaaggacgaacaaagccacagacgagataccacacggcaaaggcaacagacaagaatgacggcaggcaccccgagaaggacgaacaaaaacaatacaagcagacaaagacagcaaaatggaccccaccctggaaacaagaagcaccaacagcacaacccgcgataacaatacaaacaagaac

SEQ ID NO: 679465 - DNA, 141 bp, Homo sapiens
caggtttttgttttttgtttttctgccagaagaatgaagaaacagactctggtctatatagattttatgttgtcaggcctacatagtggtagtgcagttgtaacaagcttgcttttcaaaaatgatgattttaggtgtgtg

SEQ ID NO: 679466 - DNA, 993 bp, Homo sapiens
tgtgtggtcgcgtctcggaaagccggtacgcgcttgcagcatgggtgatcaagctgactgaatgagcagatcgcgagaattccaaaggagagctatgatcactgattttgaccaaaagcatggtggactggaaatctataagcaatcagaaggaacttggcgaatctggtagattggagcatcctctttgcggccatggaatcctcatcagcatacggacagaagctttagccatgtgatcgattgcaatataaactcgaaaccgtacagatttgtccttgcatcgcggtaaactcgcgccacaaaatttggtacctatcacactgaaaatattcccttgaacgaaataggaatgggcctgacgaaacaagattgcacgagggagcgcaacgatgcagcgcggatggatagccaacgcacagagttgtagagcagtgaaacgccattttccccgggttgctggttacccggacactaaggggacctggcgcaacctgggtcgttaatggactgtaagcttggcattgcaggaaaaccatttaggcccaaaatgcagcacttggacaaacaccccatttgggaggaacgcaaccgctttcaacctacgaatctggaagatgacaaacggcttcgaactggcggacattggactcgcagggggtaacattccgggacttacttctggactcgagctcgaattggcgtgcaacggctaaaaagcataattgaacgggaaggttgctggttacccattcattgcactgcacctggtcccaagagctggcaaagacctcgatctgctaccgcgcaaactggcttggtcacaagacttctccttcgctaggcaaataaactctgtggctacaactctgtggccccatttctctcctaccttggttgtgggtgccacgttcaacgtccttggttcacacagcggtccatctctacacgggtaagcctggtctacacccagcctacgtgccagtggctctc

SEQ ID NO: 679467 - DNA, 201 bp, Homo sapiens
catgatccgtgatcagcactgtctctaacatagcaagaagcctcgtccattcatttacaggcaactatattcctttcctgctctttgggaggccgaggagggtggatcacttgagatcaggagtctgagacgagcctgggcaacatgatgcgaccccgtctctacaaaaaatacaaaaactgctggatcagcggatcgagt

SEQ ID NO: 679468 - DNA, 362 bp, Homo sapiens
gcaaaaccagtttacgagcagcgggccaaggcttacctggaggaggagtgccctgcgactctgaggaaatacctgaaatacagcaaaaatatcctggaccggcaagatcctacctctgtggtggtcaccagccaccaggccccaagaggaagaaactgaagtgcctggcctacgactgctacccaggggggccgctgttcttcacaacggaaacggcacttaccagtcctggaagctggtggtgccccctcaggacacagccacctactcctgccacttgcagcacagcagactggcccagcctctcgtggggccctgctagtgcagttaggaagcaagggttgaaggctgtgggatctcag

SEQ ID NO: 679469 - DNA, 567 bp, Homo sapiens
  misc_feature (11)..(11): n is a, c, g, or t
  misc_feature (561)..(561): n is a, c, g, or t
gtgctctgaancttaggggaacatcaactctacaaaaaaatgtttttaattagctgggcagccaggcacagtggctcatgcctgtaatcccagcccaagattgttactttaaaaattaaaaaagaaaaaataacaagtgttggaaaagatgtggcaaaactggaacccttgtgctttgctggtgggaaatgtaaaatggtgcagtcactgtgcaaaacagtttggcagttcctcaaaaagtaaacacagaattaccatatgatccagtaattctactcctgtgcattacctaaggcactgaaagcaggggctccaacagatatttgtacaccaatgttcactgcagcattatttacaacaaccaaaaggtggaaataatccaagtgtccatcactgatgaggagataaacaaaatgatatattcatacaatgaaatattattcagccataaaaaggaataaaatacagatacatgccaccaccacatggataaacctcaaaaatgtgctaagtaaaataagccagacaaaaaagggcagatagtcctaagttcagagccanggggta

SEQ ID NO: 679470 - DNA, 936 bp, Homo sapiens
gcacgcgtcgcgttatcatgaatcaacagggtttcatgtcgcttatcaaagagagatgtggacagagctatagaaagcaccctttgttcctcaactccactttacccatattttatgcaagacaaacactgtccttttgggctccctttcttacagatggatcctcttgagaagaattatcgtatctccacgtatttagcccttcaggttaccgcgataaatatattgtatatataaccctttattatgtgcgtatatctttgtgggataatatcattcaggtggtgctggtgtgattatattataatctgaacctaggtatatcctttggtcttccacagtcatgtcgaggtgggtctccctggtatggtaaatgagccaggtataatgtaacttcacgccagcctttgtactaagctcttgatagtggatatactcttcttcaagtttagccccagtctagggtaactggaaattatctggcctgctgggttccccatttttactattaagaagaccagtgataatttaataatgccaccaaatctggcttagtctaagtgagagtgtgacactgtgtggcaagagaggctcacacctcactaggtgcagagagcccaggccttatgttaaacatcatgcacttgacataagcaaatccttaatctgggaaaggaacaggcagcaaagcattatacggtccatcttgaatgaatcccttgaacctattttgatggtcaggaggtaaactcaagcccggaggtgggaagcagtacataaccacccatactgggtggtccgtgatggtaactctctgaaatgcacatggtatattcaaaaaggaaccacggttaaatatccgcgggcaaggccatatgtttaaacagccgtacattataaaaatacaaatttcactcaaacctacagacatagaag

SEQ ID NO: 679471 - DNA, 81 bp, Homo sapiens
aagacagcagcatatatctctgcagcgtacgccgggacggctacgagcagtacttcgggccgggcaccaggctcacggtca

SEQ ID NO: 679472 - DNA, 112 bp, Homo sapiens
ggatggttctgcaggagattctgggacttgcaagaatgctagggcagatgactgatcaatgtggctgacctccgtgccagaggacaaggatcctcaccggtggccatgcaga

SEQ ID NO: 679473 - DNA, 107 bp, Homo sapiens
cgccacgccccgttggtgcccggatctgtagcagcactggctggtgtctgtggcagcgtgcgggcccgtgcggcccggtccgcggcaccatcttttgtctcttatct

SEQ ID NO: 679474 - DNA, 316 bp, Homo sapiens
  misc_feature (90)..(90): n is a, c, g, or t
agggaaatcagagcaagctttttaggacagtgaaactattctctatgattctataatggtgaatacgtgttggtacacatttggccaaanctatatgaatgtacaccactaagagtcaatcctaatgtaaactatgaactttgaaggagaatgatgtggtctatgtagggtttataaatgtaacaaaggtatcactccggtgggggaaaagaaagagagatcagactggtactgtgtctatgtagaaagaagtagacataagaaactccattttggttctgtactaagaagaaattcttctggcttgagatgctgt

SEQ ID NO: 679475 - DNA, 510 bp, Homo sapiens
cagtccccattatcaagatttaaaagaacactaattaattttcacactgcatatctcattccaacttctctgagggttacaactgattgcaaaaagtactccatgctctcaaatgtaaggattcatttatgaaaacgtgaacatcctgcttgtctctaaaacattacaggaaaccttaaaaaggggtataattggtccctatgcgaaaatgaacctgacatatttttataaattatttgcgcatgactatctttgtgtgatagcactaggaagacttctaacgtttaaatactttatttgccctcaattactatttaaaagccctatacatttaagtaattttaccacttgcaaagataaatatttttttcttttagcttctctaaatgcttggaggggacatggaaaatggccttgtttgacacattttttcttggagttaatttcgatcacttcaattggggttttttttcagtttcaagttttgtggtggataccttttcctgcttt

SEQ ID NO: 679476 - DNA, 1013 bp, Homo sapiens
agcctccgagagcgcacgtcggcaggtcgggtccctcgtggagcgaactcaccgacctctcttcccaggtgtatttccaaaatgtcgcttttctaacgagctgacgctggacaagctggacgttagagggaagcgggtcggtgatgaggagtcgacttcaagtgtacctatgaatgaacaatcagataacaaacaaccagaggattaagggctgtctgttcctcaagacactcaagatttctgcttggacaagtggagtccgaagatcggctatctccgttactgagaccagctacggcactggacctggctgcgtgtgcaccagtgccgtagagcaaagatagcatcgcttagaggccagattgcttgtacgaccactcaaaattctctactggcgtaaggcatgtacatgtacttgaaagggacgtgtgtagagccccagaaggtgggacggaaaagcgcatgatgaccataacacgcaagtatggcatagagagggtcattggtccaatccatgacgtgagatggaaccatcgcggattgcaatgatgcgaggcacagaaaagtggtacaccgggtgagacatacgaatgacgtaatccgtgagtgaaacgataggttcaaaaagccagaaggcccagccaaccattaagaagctttttccagacgctttcaacctttacccagcagtctagggggatgatctattgtcaaatgatggctctatgagtgctctgtatcacaagagtcccaacaggtccattgggtcggacgtcaaatctggccaccagaaaggcctggtgggtctcttcgatgaagaacggacgctgaacctacttggcaaagggccttggaaaagcccagaagcgaccttcctggtcattcctgggcggagctacacagttgaagaacaagaatccagctcatcaataaatattgtggacaaagtaatgagatgatactcggggtgggaatggtataaacttcctaaggtgctcacacaacattgggag

SEQ ID NO: 679477 - DNA, 1016 bp, Homo sapiens
  misc_feature (392)..(392): n is a, c, g, or t
gcggatgtgtcggtgtatgctccaccagttgtgaggcttctctttggataactgcgcgcaggatatgccgtcttggaagccgatctcgcagacagagggagtatacgacgcttccgagaagtgtcctggcaacaactggtggcacggaccatcgctggcgcgtggtctatatagggatggactactatgtatcttggagccatgattacaatgcagctagactgatacggtgatgtgttgtattgctgacgaaggaactgtctcgaatacatacacgttcgatatctccataaatattttagtgtgatttgtgcgtggcgtggagacacgacgtgcgaggacagcaggatcagttgacaaccccgaggcgtcgaattgtacgtgttccgaancacttggcaggctcgcgactctccatcttcacactgtgccggtctttccgcagtagatttgctgacgagccaattcaggatgcgtgacagcagcatggccttattgcaggcttagtcaagggtatgacagttgggtggcaaggcgccatagattataaggagggcaggtagagtggttagctggaaccgtcaggcctctacgagcgatcatatcctcgatggagtcaaactgagtaagtctgccttgatgtcacccatgggttctggctccttgtgcagccaagtggctgtacttgtgaacgagtaagttaaggccagaagatggacggacggacggacagcctaaggaatctggtggaggcgaagccaatcgcgagctgggcatcttcatacgacacttgggctccgagatacgcagacaatttgagcctcttgatgtcaatcaagggaagtaaacaaagcgtggaagttttcttaccgagccaataccacaaggtggcccaaatcaacagaaagggggaacccaggggcttgcgcccgcgtgacacagggtggtgacgaaaaaggggagcttactggaagtccctcatctgaagaaacaatcacatccttcttggaggaatg

SEQ ID NO: 679478 - DNA, 876 bp, Homo sapiens
  misc_feature (297)..(297): n is a, c, g, or t
  misc_feature (454)..(454): n is a, c, g, or t
agcggagtggatgacccgcggcgggggaggaggagataccatcagcaaaatgccagacgtcaagggagagtgtgcccccgaacatagtcctggcgactcagagggcaggtcctgtaagcccgaaacctcaggaccccccgcaggaagacgaagagcggcgtaccgaggagcccccgtcccgttgtctttgctgtcacagagtctgacagagaagccgttaatgagagtttccaagtctgagcaagcaagcattgggatgaacttgtgattactacactggtaagagaaggttgtacncggcaagcgagtctggaaggctagaggtcgaaggagactagtgcgaaaatgccgttttgggaccgatcttaaaggagcaatgtatgcaggcagactcgcccactgacttcagactgtggctcttgacacttctgaaacgaaagttacgagagatctngtgctattcactgctagtgagccacgccgaagaacccgcctggagaatcgagcctggaacgaagctctaggacatggatcttgctcagagcaggaggcagaacatggggccctgaaagtcctctatcgtctctaagtacgttctcaagcatgatggcttggctgtgtgcaccagttcgagatgaagcagtgcagaaactagaatagacattacggatccgtgtgtggctactgagagggatcttccaggttctgggccggatgacaactggacatggtgaactagactatccagagccttcaatcccagcgtgcaggaacattccagttcagtatgaacgggctaaatgcaggaactcctcaataaggcagctagtttccttaatcacaacaactaaatggtgaaccaagcagcagggagac

SEQ ID NO: 679479 - DNA, 1330 bp, Homo sapiens
cttcttcatagtaatacccatacataatcggaggcttatggcaacatgactagttcccctaataatcggtgccccacgatatggcgtaaaccccgcataaacaacataagcattctgactcttacctccctctctccatacatcctgctcgcatctgcatatagtggcaggccggagcaggcaacaggttgaaccagtctacccatcccttcagcagggcaacatactcccaccctgatagccatccgcagcacctacaacatcattactccttacaccatagacaggctgatcatacctcataatacatataggagagcccactcaacatattcagtcaacccaacaaataatcacctattacaaaccccccatgaaccactaacaccaccacagtacgcacaaaaccgcccacaccttcattacaggatcctggcagtcccagggccgctacagatgaacacgacaatagagcgtaaatgtacgtccctcatcttgtcttccaccagagatcacatcgacaatgcaatgtgaaactcaccatcagtacgtccgatacacaaccacgccaccacgaaccacccgcaccacagccacgccgacgcaatagacagacgccacgacccgagccgggaaacgggcagcgcagcacgcaccacatacacagtaaccgcacagcgaaagcgaagagacctcagcagacacgaacaccgccccaaacaccgggaccggcacaacgctcacgccacaaacacccacaacccacacaccacaccgcagccacacaaacaacgagcacaagaatgcgggcacacatacacagacccacccgccagcacaaaaacacaaaaaaccccacaaaccgaacaaccacacataacacaacccgggcaccgggcacgccaacgcaagacacacacagcggcctaccccaacgcggacaacacacagacggaggacacgcccaggacaaacatgaagcaggggagcgcaagagaacgcgacagcccccacgagccgaaaggacaaggccggcgacacacatacgacaagccaagacaccgcccggggcacgaagagggaccgcaagcgaccgacggcgaggacagagagcaagcagaacaacagcacacgaagcggagcgacccccaacagccaccatgccgacgaggcaccagaacgccgcacaaccgcccccacccggacgcgcgaggagcaggccgaacaaccagaacaaaacaccgccaggaaagggcgccccacgaccgcaagtcggcgaagaaaacaagaaacacacagcagcggacaccccgcagggagccacgaacca

SEQ ID NO: 679480 - DNA, 244 bp, Homo sapiens
taacattattcgggctacacgcagtgcagtgttgtggccctacatttaagttgttttcttatattattctgcatttaacatgacggttaacatggaaaaatcaacatcacgaagatcctccattgcgtggagccacactttaaatgataatttctctttgactatcctcagaataaatattcgaattttgaatatatttagcatatgttgtctatttttaactaactccatatgctgccagtat

SEQ ID NO: 679481 - DNA, 241 bp, Homo sapiens
agcaactaagacgacatgagctacaacaacagaaatcatacacaaacataatactgagataaagaatacagacacaaaagagagatagtggaaatggcgcgccattcacaactatctcaagactatagtttgggttacaaaagtgtcttctcccgactattatgttcatctggagagatccccgtgggaaaggactctccagcaactgaccaagtgagaactgcccagccactgtccctct

SEQ ID NO: 679482 - DNA, 741 bp, Homo sapiens
  misc_feature (741)..(741): n is a, c, g, or t
cctaagcagagtgattacaacgttatcgaagcatacttcaacagcttggtgggggtctacctccaggattagtacacctacctctatgtcctatcacgatgtagacaccgatcatattctctatataagacgcgatccacgttttcagataactgaccccgcagacccatgatgactactagcgtctccttaagacgcaaaaaccgagcgacctaccaactctctttcaagacatcaagactccatcttacgatgaatcaccttctaacccagcacaccataaaagctagtcccgccctggcaatataattgtaccacagacttctgagctctatgccctctgttctgcccccacggaccccgatatctgcaacttacatccgactcacttcctagatcagtcactgattcttattgagaggatgctggaacacatgacctagatacacaggctcctatgactgaacgctgtactcaccgaggctccaatttacaagcctatttctacaaacacgtgttagataccttctcgatgccaaacatttttgtaagggcacactttcgaaggaaaataaacccactgacttagccattttacatcacgccaatagacagcttatcttacctattctaacaagccctctgtgccaactccaaaacaatgctttctgatgccgaaagatgaacaaaactctcttgagtttacttggcagaggttcactccgaggggcgccttgtccn

SEQ ID NO: 679483 - DNA, 130 bp, Homo sapiens
tggtttaggacatgtcacacggcaccacggacactgcagtcagcctagtccaggacataggtgactcgtacagcaggcagcaacctattctatcaacaaataaatgatgcgggtggggataccagcgagg

SEQ ID NO: 679484 - DNA, 276 bp, Homo sapiens
atacatacatgtacctccggagcacccatctagtaccaagcggtgtgggagtgacaaagtcaggtgcatcaccatacttgcatatatgagctgcctccttagcagactgcagagctcctgagccacctaccaatgatgataaaggtcatagtcataggacttgggaagatcttcagggccgtacattaaaagaaagcttttgaagtctgacctccttataagccttcaaggtatggacatggccggctactctttctctgcttcacaaaacaacaa

SEQ ID NO: 679485 - DNA, 673 bp, Homo sapiens
gaggctaattattcattgaagcccagctagaggacactgcgtctatacgcagagagctgaatggtcaactggccgaagtcttgcacaccacctagacgcagaaacttgagacaatgcggctacagcgtctcctctccacaatagactaagctgttattgacctaggagacatggtgaaggcccgggccacacgacttttaacagacttgctgagccaatgttgcgtcctactcagaggagtgtcagagtatctattagaggcctactctataatgcactggcagttcatggatacttatggcgtaagctggcactcttttgtgtgatgcagttagatgcaccatcgaaagacatgcggatcggaggtaagtgatcacagacttcgtcaactgagaggatgacgcctgcctgcttcataatatttaggcaaatatctaacatttgacgtttcactccttggcttacatattcttattgtgttgtaagcaaaggggcgaactttgtgggcgccctataattcaacttccacgatggaacgattctctggcaaaggcttaaaggctcccgaacgaaccaactagagttgttacacaggaaatcttttttgggatggaacaccaccacaattccagctgatttggcttagttgggtgggttcttgaagaagcacagt

SEQ ID NO: 679486 - DNA, 169 bp, Homo sapiens
  misc_feature (138)..(138): n is a, c, g, or t
  misc_feature (166)..(166): n is a, c, g, or t
cacgcatctgaacagtcttgctgtagacagactatactgagacaacaagttgtcaccagcagaagatagataatatgacctttataacttgatgaattaacttaaccaagagggtatgtgtagtttacttatttaccnctaaaactttctggtgtctggggtaccnctc

SEQ ID NO: 679487 - DNA, 348 bp, Homo sapiens
ttctttaaccactttttaagttacgaaggccaaagaaaacacaataagaataatccaccaagaggtttattggccaccggccattctgggaaggccggcggataaaagtgagtttaaactggcagattctcctggataggctagaataaagaaagtttctctctaaggggagggctccagctaccagagggggataaatatagaatcaatcaaatcaaggtggggcaacagggaagtaaaaaaggctttggatcggtcccaaagattggtgattggcataaaaataaaattattaatcattggtttttaaaatctaaggtagagagccgggcaagggtaccgagctcg

SEQ ID NO: 679488 - DNA, 234 bp, Homo sapiens
tccggcgcacagcttctctatgggaggagtagaatacaggccgggcagtagcttacacctgtaatctcagcacttttggaggctgacgcaggcggatcacctgaggtcaggagttcgagaccagcctgagcaacataagagaaatcttgtctctactaaaaatacaaacttagccagacgtggtggcgcatgcctgcaatcccaagctactctgagacagctgtggctggccgg

SEQ ID NO: 679489 - DNA, 208 bp, Homo sapiens
ctctttatcaagtgtcgaaacccatctctcttactaataatctataagaacttgctgggcattgtggtgcacacctttggttccagctgctcaggaggctgaggtgggaagatcacctgatgtctgggaggtcgaggctgtatgtgagttgcagttggcggccacctgcatcgtccagtcgctgagctgacacgacgtgagtaccctg

SEQ ID NO: 679490 - DNA, 393 bp, Homo sapiens
aaatatcttacctaagatcctagtttctttcactttttttttgagacggagtctcgctgtcgccgaagctggagtgcagtggcgcaatctcgggccactgcaacctccgcctcccgggttcaagcggttctcctgcctcagcctcctgaatagccgggaccacaggcaagcgccaccatgcccagctaattttggtatttttagtagagatggggttcaccatgttggccaggttggtctcgatctcatgacctcatggtccgcccgcctcggcctcccaaagtgctgggattacatgcttgagccaccatacccggccaatataagtagctttttctttgttttggtacaggtctggtttgtttgagatggagtcttgctctgtcacccagg

SEQ ID NO: 679491 - DNA, 181 bp, Homo sapiens
caggggtgtggggagatgagggaagcccgacacgggcggagcgtcagaaagggggcgtcaccaggcttccaggcgaacaggtctggaagaccagctggcgactaacagtccccgtggccatcccggtgagggtgacgttagcattacccccaacctcattgtagttgccgaagctggatca

SEQ ID NO: 679492 - DNA, 116 bp, Homo sapiens
tgcaggcgattctaaggatccccttactacagcgaggagtaggatctcttacttacgtcccttagtttatgttatagggcttcctaaacacctgagagggtgtgcatacacagggt

SEQ ID NO: 679493 - DNA, 483 bp, Homo sapiens
caataagggacttcctgagacaaaatggaaaaaggagaattaaattaaaatgcccaactaatatttatctactacagacataatatttctcagttgtgaactaattactatgcttggaaaatgctagcatcctcataaatattttggttctattgggatacaaaatctgatttcgcaaactttgcaaaagcacattttggctgggcacaatggcttaagcctgtaatcccagcacttttggaagcaaaagcgggcggatcattaaggcaagagaaccaaaacattcttggttacaccaataaacccggcttttccttaaaattccaaaaaaattttcccccgtggtggggggcgggaacccctttattccccactttctttttgaaggctttggggccgaaaaaaaggcttgaaacccccggaaggggggggcttttctaatgggaccccaaaaatcccccctttttgccccaaaattttttg

SEQ ID NO: 679494 - DNA, 175 bp, Homo sapiens
tcttctatttggttagctagtcaataacctattttccaagcctactacgtaaagagcattatgtgtgttttgggagtgggggatttagtttaattccttccctatatttgttaaaaatgtattacatataaagcagagtgttgtgtgctgtgatggatccttcccctttcagggg

SEQ ID NO: 679495 - DNA, 1006 bp, Homo sapiens
  misc_feature (690)..(690): n is a, c, g, or t
ataggcaggacgaggcctggtgttaatcctttgaagcgccttcacctttctagtgcgaggtgtggtctgtatagttccgccctggcagtgggataaagaatagggtgaggcagcatgtttgtgcactctcgccctggatgcgtggaggctgctcctactgggtcgtagtaggataacggatgagacctgtttgcctgctgctggactctctcacggatgctggaggctggaggcagtgaggcagaacaggcgagggcgagggatttggactgcctcatgcagcgacctcgccttccgctgcgcctcctcccagaacccaagaagcctggaacctgtggcgtcagccctgaaaggaggagacggcaacccagccgcgcttttgcctgcactctccctggatgctggaggctggaggcagtgacgcagcaacagcgcgaggcgatttggagcggctcatatagcgacctcgccttccgctgcgcgtcctcccagagcccaagaagcccggaacctgtggcatccatctctgaaaggagaagacggaacccagccgaggcactactgggttggggtctccacgaccgagctggtctcatcaagtggcgtcaacaaggggctcaaacccgggttgaggggttgctggagcgacggagaacgtggaactacactgtaggacaccagagtactctntaagcaaatccctttgtctgcagatgtgggattcccgaatctgcgagaagtagcccaccatgacgaagctgctttgctttatcgcttttgcaaaaacagaacaaggggacatgcttgggaacaggcctaagcctgtcataaacagggcttaaagctgacatgacgggattctgcccgaatgttacgtggtctgtatggtatacgccaatggtaaattggtagttatggggcagggtaggaaacctggccccgggggaattggtcaccaaaagtgtggcggctaaacgttttgggggtacggcggggggttacccca

SEQ ID NO: 679496 - DNA, 831 bp, Homo sapiens
  misc_feature (673)..(673): n is a, c, g, or t
gacccctccctctccgagcttgagaatttttcttccgaaataatcagacttcaagtccatggcaggacctcgtacatgaatttgatgagaagctcaatgtctgcttacggaactacaacgccaagaccgagaacctagctcccgtgaagaaccagtgacagatccaagaggaggagagagaaccgcgtttacaggtacgaggagtaagaatgtcttgaatgtgccctcatccatgcattcgagtcgagagccacatgctaggtccgttgttctccttgtacatagtggctggttgctgtctatatggttgtatgggctattacatttcattttcgtgttggcagcggagcagatgccctggtacttgcgtgtcgatatgcgtctataggtatgtccctttactaagtcccctgtaggagaactttcttaaagttgaaaccttagaggaagtgacaggtttgcctatgatacaacacatggacagttctcgaggagcacagtgaaactatcagggtctgtctatcttaagctttctttatatcagaggaagatccagcgagatgattagaagataaaggccagaataaattaggttaaccatgcaatggatgaatctatgttataggactagtttgcttcaagaaagcagcagaattgtgaaaatcccgaattnttgacaggcccctcagggcctggacgagttatctacagatgtaaggatatgtccactaagaaaagcgtctaaagctgaactgagaggcacaggggctaccctggacacagtagaggtggaaactcaagttgatgtggccctttgagtatgcagattcc

SEQ ID NO: 679497 - DNA, 335 bp, Homo sapiens
ttgcttggcaaggccaagggatgggaagagaagagaaaaatcgctttgttttattttttgggatggagtctcgctatgtcgctcgggatggagtctcgctatgtcgctcaggctggagtgcagtagcaccgtactggctcactgcaacctccacctcctgagttcaagcgaatttcctgcttcagcctccgaagtagctgagattaccggcgcatgtcaccacacccagcaaatttttgtatttttattggagatggggtttcatcatgttggccaggctgttctcaaactcctgatgacaagtgatctgcctgtcttggccttgccatatgcaa

SEQ ID NO: 679498 - DNA, 119 bp, Homo sapiens
ctgtgcgttgattcatagaggatccccgagtgtcttcaagaagttatgtagttgtcacagatttttctttgcattgtagaacatactccttcaacaatgtcctgtagtgccaaccttcc

SEQ ID NO: 679499 - DNA, 265 bp, Homo sapiens
taaatttaaacagtctcactgtgttgcccaggatggagtgcaggggcaacagtctgtggctcagtggcaaactctgtgcctcgcaagcagcgtgggactacaggcattgctccacgggtgcccagttaaattttatttgggtgattccttaagtggcgacgacaacgggttcccagcaatggtaggcaaaggatggactcgaagatctgacctcaagtgaatcatccaccacaatgaaggaactaaaaagcgtgaagacaacaaa

SEQ ID NO: 679500 - DNA, 910 bp, Homo sapiens
  misc_feature (236)..(236): n is a, c, g, or t
  misc_feature (416)..(416): n is a, c, g, or t
  misc_feature (492)..(492): n is a, c, g, or t
  misc_feature (501)..(501): n is a, c, g, or t
  misc_feature (514)..(514): n is a, c, g, or t
  misc_feature (545)..(545): n is a, c, g, or t
  misc_feature (564)..(564): n is a, c, g, or t
  misc_feature (631)..(631): n is a, c, g, or t
  misc_feature (637)..(637): n is a, c, g, or t
  misc_feature (650)..(650): n is a, c, g, or t
ggcagcgcccggagagctcttgcgcgtcttgttcttgctggtgtcggtggttagtttctgcgacttgtgttgggactgctgataggaagatgtcttcaggaaatgctaaaattgggcaccctgcccccaacttcaaagccacagctgttatgccagatggtcagtttaaagatatcagcctgtctgactacaaaggaacaatatgttgtgttcttcttttaccctcttgacttcancctttgtgtgccccacgggagatcattgctttcagtgatagggcagaagaattttaagaaactcaactgccaaggtgattggtgcttctgtggattctcacttctgtcatctagcatgggtcaatacacctatagaatacaaggaggactgggacccatgaactattcctttggtatcangacccgaagcgcaccattgctcaggattatggggtcttaaaggctgatgaaggcatctcgttcaggggcctttttnatcattgantgataagggtatncttcggctagatcactgtaaattgacctccnctgttggccgctctgtggnatgagactttgagactagttcaggccttccagttcactgacaaacatggggacagtgtgccagctgntggaanctggcagtgtacntcagctggaggtgcatagatcgaggatgttctccaagcgagtgagggctggtgtttagatgcagtggggtggggcatgaaaagaaaccgtcgtattttgccttggtaacccgtttgtgtccacacaaaattaacttgggcactgcctgagtgcttttccatttgtccggcgcttggttgtgtgtttggaagggaatgggttcaaggggggttgccgagtgtgtgggtctaatgagaaaactgagacattctgtgtggtac

SEQ ID NO: 679501 - DNA, 494 bp, Homo sapiens
  misc_feature (67)..(67): n is a, c, g, or t
  misc_feature (132)..(132): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (155)..(156): n is a, c, g, or t
  misc_feature (166)..(166): n is a, c, g, or t
  misc_feature (168)..(168): n is a, c, g, or t
  misc_feature (175)..(176): n is a, c, g, or t
  misc_feature (190)..(190): n is a, c, g, or t
  misc_feature (207)..(207): n is a, c, g, or t
atcccgaatggaataaatctagcacccctgatggtgtgcccacactttgctgccgaaacgaagccanacaacagatttccatcagcaggatgtgggggctcaaggttctgctgctacctgtggtgagctttnctctgtaccctnanganatactnnacacccactngnagctatnnaagaagacccacangaagcaatataacaacnaagtaaataaaatctctcgacatttaatttaaaaaaaaaacctaaagtatatttccatccataaccttaaagcttctcttaatatccatacatataaactaactataaaccacctagaaaacataaccaataaagaaataattcagaaaataactaaactcaaagtacccctatctcattcccacagtaataacaccctttatatcccagaataaaaaaatagaaccccagactctatcgactatctaaaaaaaaaatatattactgctatcaaaaattcaaatcag

SEQ ID NO: 679502 - DNA, 365 bp, Homo sapiens
tcactctacaggatctcggactccacttggttgccaggcagattgctgaactcaggagttcaagaccagcctgggcaacgtggtgaaattccgtctctgctaaaatacaaaaaattagccgggtgtagtggtgcatgcctgtgatcccagctactcaagaggctgaggcagagaattgcttgaacccggaaagtggaggttgcagtgagccgagatcgtgctactgcgatccagcctgggcaacagagcgagattccatcttcaaaaaaagagaaagacagaacacataacacggttaccatggaggaatcctgcagtccaggggacattctcaaacatcacaatgattggtgtcaacaattgaa

SEQ ID NO: 679503 - DNA, 117 bp, Homo sapiens
ccgtaatggaatcatcttaacgtgaagatcaagcagaacacaacaagcccctactgatttctgggtttctgccacggcacaggttcatatccaggtgaatggcagatctgagacgat

SEQ ID NO: 679504 - DNA, 160 bp, Homo sapiens
gagtaagttctatggcagtggtcaaatgcccagtgatctattctggatcacacttcttgtcctcctgcattgataggtttacctgtgtagcagtaggacattgtggagatgaaagtgttgtcattttctgagtctaggacataaaggcattatggccccc

SEQ ID NO: 679505 - DNA, 261 bp, Homo sapiens
agatccccctattctacactgaaattccattgacatgtatatgctcgataactaccttctggttttactttacatagtattgactaacccttgacttatcaaaattatctcactcatgtcactagctaatagaaatcatggggggcctatttaaggcctcttggcgttaatggctagttccctataagggttctgtgccacacacacacccgccccccgctcccctcacacacgagtcctaacttcttcacttttattcaa

SEQ ID NO: 679506 - DNA, 669 bp, Homo sapiens
  misc_feature (28)..(28): n is a, c, g, or t
  misc_feature (73)..(73): n is a, c, g, or t
  misc_feature (75)..(75): n is a, c, g, or t
  misc_feature (87)..(87): n is a, c, g, or t
  misc_feature (111)..(111): n is a, c, g, or t
  misc_feature (118)..(118): n is a, c, g, or t
  misc_feature (185)..(185): n is a, c, g, or t
  misc_feature (188)..(188): n is a, c, g, or t
  misc_feature (241)..(241): n is a, c, g, or t
  misc_feature (251)..(251): n is a, c, g, or t
  misc_feature (272)..(272): n is a, c, g, or t
  misc_feature (335)..(335): n is a, c, g, or t
  misc_feature (400)..(400): n is a, c, g, or t
  misc_feature (431)..(431): n is a, c, g, or t
  misc_feature (448)..(448): n is a, c, g, or t
  misc_feature (459)..(460): n is a, c, g, or t
  misc_feature (470)..(470): n is a, c, g, or t
  misc_feature (486)..(486): n is a, c, g, or t
  misc_feature (541)..(541): n is a, c, g, or t
  misc_feature (555)..(555): n is a, c, g, or t
  misc_feature (609)..(609): n is a, c, g, or t
  misc_feature (667)..(667): n is a, c, g, or t
tgctccacaatcttttcttccacataangccccttccgctttcgtactgcgttcatgtacttccgggcttggntntcttgggtcggncttctccccaaagtgcaagtattnctcctcngtagttggcacccagaaggggtctctgggaatgatctcccattggctgtatatactagttgtgggcnggncaggccacttgtcctcttcctgatttcatcagcaaaaccaaagctttcagcancaggctgctntgccttgatgatgtacatgtntgtcccttctttcttttcttcttgtatgtacccgtccttctctctttgacaagttctgctttntctcgtccggggacatctccaggggctctggtggtcacatgtgtacatagctgccatcaggcgcnggggtttcacttgctgtgcttagcgtcttgnttctttttttgtggggntattagctgtnntgagaaaggnccatagcagtcagtgngtggagattctcctttctgtgatgtcctcttctcaaaggcctcagagcagccatnttgtagctcttggntttcatttccaccagaacaggtttcattttcctcctgtccctcttttgccagancacttgctccttgttcctcaaatttactttaggtcccatttttccagtacaaaacagnct

SEQ ID NO: 679507 - DNA, 89 bp, Homo sapiens
tgctgtgtgctgcccgcctgcctgctggctctcccccagccccacatcccctttggaagagaatgtaaaataaacctgggcccaaggga

SEQ ID NO: 679508 - DNA, 201 bp, Homo sapiens
ctcacgtgatcgacggaacttgtacagggaggcatgcagctgtactggtgaatacacgtctgaccaggctccatgtttacgatcttggagccgtcatcacggtgctcacgtgtctgacggagcttgtctatgaaggcatgcaccgcacgtggtgaatacacgtcgatctgcaagcatgcgtgcatcctcgggtcctggaca

SEQ ID NO: 679509 - DNA, 398 bp, Homo sapiens
  misc_feature (74)..(74): n is a, c, g, or t
  misc_feature (392)..(392): n is a, c, g, or t
  misc_feature (394)..(394): n is a, c, g, or t
catgaaaaccataaagatatgaatagccttttttcaaaatggggtatttggccccatatttgttgccatagcanggcacccataataagtgcctttacatgtattaactcatcctaattctcacatgcatccctataaaatcagtataaactgaagaactaaggcaggcagatcacttgaggccagcagttcaagaccagcctggccaacatgttgaaacctagtctctactaaaaatacaaaaaattagccaggcatgatgttgtgtacctgttatcccagctacttgagtggctgaggcatgagaattgcttgaacccgggaggtggaggtttcagtgagcctagatcatgccacctcactccagcctgggctacaagagcgaaactctntnataa

SEQ ID NO: 679510 - DNA, 1355 bp, Homo sapiens
gtggtgtccccacggcgggcatgcaagctggctgtgctgagcaggctggctgaactgctggagtggctgcggagggagcccgcggcggcggcagcagttacatgcgaaaatggcgggagaccgtggattgacaaccctggcgagctgatcaccaatgaccgcaggaaccatgaatgacgccttactggaaccaccgccaagtcaacgttccctcgagcatcgactgctgagacaaaccccgtcaacacagggtcgggggctcggaccggggcccagctttcaagccgagctttacgaaaaaactcaggtgtcaacggacaaaattctttcctatttttcaaaggactgcaacaggaaattcttagcttggtagtagcacagagaaagaatcacaaggatggaactttttaggaaacttgcgcttggacggaagaaggtggaaacttttaggaactcacggacgaggaaggcaaagtgattcaggtaagatataccacacgcgaagttacaccttgggagaaaaacggccggtattatatggcagttcacaggaagtttaccgttttctaggaaggggcagcaattgtagtggggacgaattagtttatggagttggaaccaaaatttgattgatttgggaaggagacacaatggaaaaacgacacaagaggggggcattggggagaggcacagagattgtagaattaagaagccgaagggatatccgcacttggagattgcaattcaccttacgttgggacaaagaaggacaaaacatggaaacagtcggggttatgggatcacgttattgcacagacgaatttttgatttaagattagtatcaagcagaatagggcaaaagtttggacaccgaagatttagaggtttacgtaaattttacgagagagggtaggattaagtttaacgatcacgcaagtttgcgttaacgatactagtttaagaggacaagcaagtttggtcgctattgggaagaacgattttctgggggcgacaaggcaaacaggtggggtggcgaaaaaaaaagcagtgatttgacacttataatttgtacactgtggaagtttgggaaattaatgtggccaagccaaagtataggacaaggagaaaggtgttgtggttacaaaggattagtgcaaaggacaaattttgtggtgagagaacgcagagaaaaaatcattgaggataaatttaagcatgattttgcacacctttttacaagggatatactttagacgtaaatgacgaaaagtgtcaaattaaattgtgtagatcagcaggatatagtattggtatagaatagagatgatagtagaggaggccacaagtgttaggac

SEQ ID NO: 679511 - DNA, 1066 bp, Homo sapiens
ggattgccagcatccccttcccttgcctctatcgcacggtataactggccaattggacggcgcttaccgtttcgtgggacctgttattctaaagcattatggtgaccttccagtttcgcataacttgggatgtcccgttcttatatattcgtattcgctccatttatgggtcttctccctgtcttcgtcgcgcaaatactttgttgttgacttaattgtataccaggtaattgtgcggacatcgtagacgaggtgtagttccttattggcctgttacaagccgtaaatcgcaaagtttgtttgcttttgtaacaacatgctttttgcttcaatgcatatgtgacaaggcccaaggcggttctgtgggtgttcatgaactagacctactttaacacattgaaccgacctcttttttccacagtcaagctggtcttctgtcacctttagaattcctcgttcgatttggtaaccgttccaatatgcccgctgggcatgtgaaatccttttccgtcttgtttctttggtaattttcggctactatgtcagtcacgcatgttgctgtcaaattcttatgtggctctggccccaggacggctgtcatgtctgccctgtgcctttactaagagtttggtacaatacgacgaatacggggactattctctgtgtgatattagtataattcttctgccactgaactgctgcatgaaaagtttatcctgatgacttgtctgttaccctgcctctcatgtataatagtgtttaccataacataccaataacttcagcatctacaattcagagcctttcgagaattctggctttcacgtgtagaagcagaaagtgtaagaggaaatcagtgccctagacatacttttctgtctaaacagaactgtctacagatacatttggtacaggttatttttcattgtgctttcgacatccatgtctctcgtgatacagatggcccataagtaacgaatcatgtggctgtaccttcctccacaagtaaatgggatggataattatcgtatattaagatgtgattctcttttttatcctaagtata

SEQ ID NO: 679512 - DNA, 427 bp, Homo sapiens
agggttaattttgtgtaacctggcacccaacattatatgtctaggaatctgtccctcaataggatgaatggtaaaaacatatgtagagagatattaatcgaagtattatttgtaagaacaaaagatggaaacaacttaaacacttgtcaatagaaaaatagtgaaattatgatttattcttactattcttccgttaaaaaagtgagctagagtgtgtgggggcagagtgtatgagagaaatctctgtaccttctgttcaattttgctgtgaacctaaaactgctaaaaaaaataagtctactaaaagagctagagctataaatgtactgaggcaggaaaatcacttgaacctgggaggcagaggttgcagtgagctgagatagtgccactgcactccagcctggtgaaagagcaagactccatctta

SEQ ID NO: 679513 - DNA, 1588 bp, Homo sapiens
  misc_feature (623)..(623): n is a, c, g, or t
aagttcaaagatcatggcaatccttcaaaaacatggtccctcagcaagcccttgctgacttcgacaactggtgacgaaaatgagcactaaactgcggacggaagcttgctggctcgcgcgcgactctggctggacagctaaacaggaggagcaccgcaacttcctgcctgagcctcagaactcactactctggccacactgcgctgccacacggctggcactaacctcgctcgacatcacctggctgcaactctagagacccccgaggacctacgcgctactccaggagtcttcagcaacactggacaacacacccccttggaagaaccgcacggacaccacttgcgcgtatctctattccaccacccacagtatgcgtgctctgcacacggccaccccgcacaccgactgcgctaccatcgctcctgcgtcctatcacacctggcgggacatcggcacactgcctgcacctgcgcgcaacgcacactctgccccacccacactttgccatatcctggagacatgagacacgggcacgaggcacaacgaacaccacgccaaactatgccgtagcgcacgcacacacctttgcacaccacatctactcatgttctcgaaacacntcgagtccaacgggagcttgcttgaccgccatgagtgaatttcaccctgacggctgctagctatcactctactacataatcgaattcacgttatatgcatacttacaagtacacgtttgaaacagttaccaacactctagagcacctactcgaagaggcgcttgggtaccaacttcagtattacccattacgacattccggcgacgtaagtacacagttccgcgtaacagcgcccagaaacttggatagacccctgacgaacaacggggagtatctagggccttcgcggatccacacaccatgagatccaacccggacgttccattaggcgttcctttggaacccaaccgccataataacacattgggcccatagaaacacagccaagttgggccaaaacggggacacacagcacaaccataggactcttacgacttggagacgcacaacgccttttacagcacatgtcctagatgacgaacgaacccttttgcaccgcggcatccccacgcggactcccaacacgcccaacttctcgtttgcccattcgctgggagtttaacacaaacgaactttgggggacatcatctcgtaccgttgccaacgcttcgcaatgaaagaacctcggaggaacctactgacacacaggctatgatagccaccaaccatactttggtatggcgcgctatctcgcgaaaccgaacagcttagcagaaacaagagttacgccaccattgcacaccaggctcatggcaaccaataccatcgaccacacgcgaagcaggacacgatcacacacaaaggtcggcgcacgcgctatcacaccactacaacatgggacacaaaaggaaagcatattaagagaccaatacaccagtagcagaccctttaggcaaaaccatagatacaccagcaaaagtagagacagacggacccacacaaggggacaaccgaacacgagacga

SEQ ID NO: 679514 - DNA, 146 bp, Homo sapiens
cagacacattacaggaactggctgatattccagtgactatacacgaccatctcaatatttttggatgatggctcgtttatccccgttcattctgatgaactttggaaaactcgagttatttttactgatcacctaatcaaattggc

SEQ ID NO: 679515 - DNA, 409 bp, Homo sapiens
atatcagctcggtaccttctttcgccaggcgggtatggtggctcatgcctgtatcccaacacttgggaagccaaggaggacgaatcacttcaggtggagagttcgaaaccagcccggccaacgtggtgaaacctggtctccactacaaataacaaaagttagccaggtgtgctggtgggtgcctgtaatcccagctacgcaggaggctgaggcaggagaatcacttgaacccaggaggtggaggttgcagtgagcagagatcacgccactgcattccagcctgagcaacaagagtgaaactccatctcaaaaatatataatagcagccaggcgcggtggctcacgcctgtaatcccagcactttgggaaaccaaggcaggtggatcacctgaggtcaggaattcgagac

SEQ ID NO: 679516 - DNA, 428 bp, Homo sapiens
cttcctgtatcagtcaaacgcctacattttgctgtctaacatgaattcatcgttatggcacagaaaggacattcaacacccgatgctctcatcacagagagatccggccatgtcccagctctgcccttgctgctctgaaattaagccaggggatgtactgatgccctgggaaaaaggaattcacaagaatgggtctcattcataggaccaaccctccctcacacacctacccactttggactgccatgtatagttggtaggtgtgttcactgccaaaggctcagggctgaagggacacgtgggagccgaaatcctgcctgggttgcactggtcaagcaacatgtccacccaagaagtgccttcctggaatccccagaaggcactagacagcttaggggctgtcctgcggctccccattccccacaggg

SEQ ID NO: 679517 - DNA, 371 bp, Homo sapiens
cgacctagaggatcccccgccaagtggatgaggctgggatatctacattgctttgtggggagttggagtcagtgtggatgaggctgggatatctacatgctttgtggggagtcggagccagtggtggatgaggctgggatatctacatgcttggtggggagtcggagccagggtggatgaggctgggatatctatcattcttcgtggggagttggagccaaggtggatgaggctgggatatctacatacttcgtagctacgtgaggagccaaggctggatgaggctgggatatctacattcttggtgcggagtcggagccaaggtggatgacgctgggatatctacattcttggtgcgtagtcggagtcaa

SEQ ID NO: 679518 - DNA, 186 bp, Homo sapiens
tcggtagctagctcaagttagcagtggagttaggaatggaagtcttatgagctgtttattcttacttgatagtttgtggctttgagtttggttgctttgagggttggagggaaacgccttgttctcaggggtctgtatagaaacaacatacagcctgcatgcggtggctcacgcatgtaatccctg

SEQ ID NO: 679519 - DNA, 240 bp, Homo sapiens
gggggcccccccccattattttttctggttccaaaagggggggggaagggggttccctttttggttccacttcatggggggctggggggggactttttccctccccttttaaattaggaccctggggtaaattttctttttccaatttttgccccgggggggggggggggttatttaagggggaggttccttaaattttgggggccaaaaaaatggggggcctgggggccctcccgggga

SEQ ID NO: 679520 - DNA, 538 bp, Homo sapiens
ttagaggatctccgggagccttaacctgtgcacgtgcccagtaggcatcgggcacatctgcatgctctgacagctgcccaagtggcaggcaggctgtcccctgaggtctgcctgtccagcccttcccttgcccagagaacccaggcacaggtagcttctgcaaagaaggagaggcacagggtgggggcggtcagtggtgtctggtggatatcactgggctttggacagcttggcattcttctctgccccttctaggtctcagcggctctaggtgtggcagaaggacacagtagggcgtggttatgctcagccagttgccccagtgcccttggtgaaaccccttggctgagcctttggtgggcactggtgcactggatcacggctgggttccacttttcagtacacatgaggcagcacttgccgcacctggtcccatatgctacagggtctgattggcccagcgattaagtggtcagcttgattcctgccattcctagcacgggctgccagtcagggaccagtgtggagtactggggag

SEQ ID NO: 679521 - DNA, 220 bp, Homo sapiens
cctgccccgtgaatgctcgaccgtcctgtgaaggagagaatgctgtgctgctagttggaaactctatgaggcctggggtcgaggtgacgctgtgagcctgtgatggggaggagctgccggtcatcttgccagagcagctcaggccacatgcatttcctggttcttccagggggtcacccgcagaggatgcttggcgaggggcacccttttagccttgggc

SEQ ID NO: 679522 - DNA, 870 bp, Homo sapiens
  misc_feature (613)..(613): n is a, c, g, or t
gggtggcgtgtgagaggttttctcgctctagggagattcttcaagcgtatcatctatgtcaacggacgacaggtgtgtcccttccttcatatgaggaacgactcagggatcaagaagtcattcgaaaagctaaagaggcactattcgtaccggtgtgaatagtccgggtttggcagcaattgttgcgtatggattatataaactgaagagcaggggaaatatgtaagaatgtccattcatctgatccagatgcgtgtggagccaaggttgtgtaggagcaatgacgtgtggtatgggctattccatgtatcgggaattctgggcaaaactaagccttagaagaagagatgctgtcttggtgcttgtggaggagcttgctgaaggtaagatgtcttattattaaagttacctattatggtggaaataaactaattgtatgggtttagatggtaacatggcatttgaatatggggttcctttcttgggaggttgattggttggtgaccgaattactagtgactagttactacactaggtcattcaggaagtcatgttagtttaaagttgtcacctagatgccttgatggtggtgaagtgtccaccttcttaattntgaagaggacttagttctaacgagataacaggcaatcctggaggttcccggttgtgcgcaatgccgatatttgagttgcgtacaaatcatttgcccagtaataacattggtggcgtggtaccgggggtgttaactttgtcccatgtgggtatcttggggtccacggagtatttgttgttccccacgacacacggtcgttttaaaacaaggcgcgaagcaaaagtgccgtcggtaaaagcaataaccaacgtgggtaa

SEQ ID NO: 679523 - DNA, 341 bp, Homo sapiens
  misc_feature (28)..(28): n is a, c, g, or t
  misc_feature (158)..(158): n is a, c, g, or t
aggaaaggagaccggctgagcctcaggntaattgtactgagtaaggactgcagctcccggtgaccgcgagagtcggtgaggtgggactggtgactctcagaagctcctcggtgcacttttgtctcggcagactgggagggagcaggcgctcgcggaanacgtcacttactgggtttgttcacctgtttccagcaagttttggtcttttgggcagaagcctgttgaccaactgtgggccaccacagtcttgcacagaaaggtggcacccggagtggtttgtggccctcactaccaaagccacgggaagcccaatttccagtaggattgccggttttgaattc

SEQ ID NO: 679524 - DNA, 226 bp, Homo sapiens
catgtgggcagtgtgcggcagtacaaacaaagactttcctgagaggtcacatgcattgcataaagctgcagccctttctgaagcaatgacatcttctcctgggggcaaaggggttttcttctgaatcagaaccactgcaacttttgcgtttcttccttgtaaactttgcctgactatttccactctggtggcgcactcagactgcttttctttccattcagcctct

SEQ ID NO: 679525 - DNA, 280 bp, Homo sapiens
  misc_feature (13)..(13): n is a, c, g, or t
  misc_feature (50)..(50): n is a, c, g, or t
  misc_feature (117)..(117): n is a, c, g, or t
  misc_feature (279)..(279): n is a, c, g, or t
cgccatacgcacntgcttcttttgcccatgcatccgcacggacttcgccngtcgagatcggcaaggaagaattcataaccaaaacgaccgccgccgccactggcaccgcgttcggtnttgccatcttcttcgacgagaacgctcacggaaagacgcaccagcgaacgggacatccgccgcttagcgttgccgtcggtgggccgcaaccaaaatttaatttcataggacaccattgagggttgggcagttcatttcctgttacggggtttgttccgtttng

SEQ ID NO: 679526 - DNA, 1234 bp, Homo sapiens
  misc_feature (83)..(83): n is a, c, g, or t
ttttatttcttatttttgcaaacaaaagctgccacatgtttattgaagacattactgggctcttaagcccagctggatctatnaatatcatttcccatgattattaatccactattattcaggaaacagttcctggagaatgcattattatctaagcacgaggctctctcttgttgactcaacccgtggcacgttcaaataagctctcgtttagccacagtctgcagttaatggctcgccaaccctaataactatctgagggcgccttgccccttttattctatgtccccaagaggtccaagagttatcccactttactgcgggagacataaatatctcgagtggtatatcggacactattgcagacacatataaatcgcgtgttattatttcacagatgcacctgtggggacacagttttgtgaacaaaaatcaacgtgtctcacgaggacacagggcaagatagtggacacccgaactccgtgacacgtggctctcgttctcaatgtttctctcggtgacaagccaaatgttgcccaagaaatttccgtggtaagctaaggaaattgtgaacagggtctacacacaacacgttacagccgcccgtgttaaaccccagagtctacagtatatatacgcttttatactagggggcatctgagaggcatatggatctcgtcctgtgtgacgtaaccaagataaaactcttgtgaactgtggtatataatcattttcacccactttcccatcaaatttttaatacacgccgatcctataggtaccaacaccatattagctgtgtctccacaaaatttcccctttaggataatctgtgtgcggccacattgttgcctattattaaatctcccccaaattaatataacaaactggttgtcctccttatacaatctacaaaacccaaataacatcttccgtgcgattaacacagttgcccacacacttttttcgtcgtttgagaacggttatacacacagatatttcgcccccatagtagagtctcatttagaaacaccttttacctttcacccaattaacccctccacggcgattaaacaaatacagtggctggggatcaatcaccactctacataccatatacagcctaaacttccttcggccaaatcgcaacgcaaactctggctcgcgacactcgttctgttggccagaacgcccccctattttcccacgaaattctacagatatatctcccaag

SEQ ID NO: 679527 - DNA, 265 bp, Homo sapiens
gagtatatgaagctagatatatcgggttcatgaatatagcgatgcacgtgcaatacagagaaacttgaatagctgatatctctcgaaacatatagtacatggagagaggtaggaaaccttagcttagattgctgcttttactttggcaagactatggaagtgatttaacctacggttaggaatatcaaaaaccaaaatcaatagcaatagttgaatataaaatggatgcttctcagaatggtctgtattgttaatgtaagagata

SEQ ID NO: 679528 - DNA, 145 bp, Homo sapiens
attcgtgtcgcgctcttccatgtgaatagtggcgtcagggttctcctcagcactcgctgtcgcctgcctcttccatgtgacatggtggctgtcctggggttcctctccatgcactctgcatgtctgccttgcgctcttccattgt

SEQ ID NO: 679529 - DNA, 429 bp, Homo sapiens
ttacgtaggcatagaaaacacttcatattttattcaggatatggaatgtcatccttagaatggttttgagcaagggggtgcgttgatttggtttttcttttattttccttttcagagacagagtctcgctctatcgctcaggctggagtgcactggaggaatcacagctcactatctccttgaactactaggctcaagagatcctctcacctcagcctcccgagtagctgggactacaggtgcccaccgccatacctggctaagttttgtatttttagtagggacagagtttcaccacgttgcccaggctggtctggaacgcctgacctcaagtgatccacccgcctcggcctcccaaagtactgggattacaggcgtgagccaccacgcccggccagtcaaccatttttaattgttgtgttgcagtgt

SEQ ID NO: 679530 - DNA, 328 bp, Homo sapiens
cagattttttttatgaaaacgaagagagatgtttaaagtttatttttcagcaggtgaggtgctcacgcctataatcccagcactttgggaggccaaggcgggtgaatcacctgaggtcaggagttcgaaaccagccttcccaacatggtgaaaccccgtctctactaaaaatacaaaaattagccaggcatggtagcgcacacctgtaattccagctactcgggaggctgaggcaggggaatcgcttgaacctgggaggtggaggctacagtgagctgagatcgtgccattgcgctccagcctaggtgacagagcaagactccatctc

SEQ ID NO: 679531 - DNA, 114 bp, Homo sapiens
gattatgctcatatctgggaatgacctgaattctatcccagctctgatgtacccacatgggaacattaggggcaggcagaaatgcagctcattcccattatgcacttgttcaca

SEQ ID NO: 679532 - DNA, 440 bp, Homo sapiens
  misc_feature (172)..(172): n is a, c, g, or t
  misc_feature (237)..(237): n is a, c, g, or t
  misc_feature (275)..(275): n is a, c, g, or t
  misc_feature (307)..(307): n is a, c, g, or t
  misc_feature (309)..(309): n is a, c, g, or t
  misc_feature (343)..(343): n is a, c, g, or t
  misc_feature (383)..(383): n is a, c, g, or t
  misc_feature (385)..(385): n is a, c, g, or t
  misc_feature (400)..(400): n is a, c, g, or t
  misc_feature (405)..(405): n is a, c, g, or t
  misc_feature (409)..(409): n is a, c, g, or t
  misc_feature (415)..(415): n is a, c, g, or t
  misc_feature (426)..(426): n is a, c, g, or t
  misc_feature (433)..(433): n is a, c, g, or t
ggagcaagtgcgggtcctttgcctttggtggaaagtccccgggttccagggaggggccccgtgtcctgcctgtctgaagccaatgctgtctggttgcgccatttttgtgcttttatgtttaattttatgagggccacgggtctgtgttcgactcagccctcagggagatttntggccttttggcacagaggattcatttgcccacacggaggggacccggtcacagcctcaagtcantcccaagccccctccttgtttgtgcatccgggggcagntttggagggggtttgttggggaactggcgccntngccgggactccagaaccgcagaagcttccccagntcacccttggaggagggcgggctttttatagcaccagggntnaggtgggaacccccntcccncccnccgccncaataaagttngcccccncctccca

SEQ ID NO: 679533 - DNA, 128 bp, Homo sapiens
tacagctcgccctgttaatgaatactatatgtacctgcatatgatgcacagctagcaccccgaaagccagacgagctgactaccaacagctaagagagcacacccgtctatgtagcaaaatagtggga

SEQ ID NO: 679534 - DNA, 379 bp, Homo sapiens
  misc_feature (131)..(131): n is a, c, g, or t
  misc_feature (174)..(174): n is a, c, g, or t
agtaatccggcgtgtgtcaatttgatctagaagtgttagaaaatatggagcacagatcagcatatatgcatataggattagatttatgtatatataagatacattctcttagagttgaacatttaaaaatntcaacatgtcctaaaatatctgctttgtaatagacagtatatnctcagccaggtatgggtggctcatgacaaaaaaaaaagtgaccagtatacaggcatatgaaggactttaatgccagcccactcttccttttgggagtcaggctcttgctcccaagtccagccagtcccaggcccaggctagagtgtgtggcacgaccatagctaactgcagcctatactctctggactcaagcatttctcctgca

SEQ ID NO: 679535 - DNA, 1408 bp, Homo sapiens
  misc_feature (439)..(439): n is a, c, g, or t
  misc_feature (740)..(740): n is a, c, g, or t
  misc_feature (760)..(760): n is a, c, g, or t
  misc_feature (1114)..(1114): n is a, c, g, or t
  misc_feature (1297)..(1297): n is a, c, g, or t
ccccaggccaggattgtggaagagtcagcagatgagatgtttcttgcaacgcacttcgctgttggaagtattgagacccccggagggtcccacccctcacgagagttgtatcaaaacattgttctcgggggtgtccacacccccatccgctttgggaggggtaatacaaagagtgattggggaaaaaatccttgtgggaaattttgtggaggaccgcccgtcttctgcccaaagagttacccgttctcccacgaagtatttcttgttgggcaccaccaaagaccccatggggcgtgtcccttcctggggttttcccagcgccccccccacgatgtaagtgggaatttttactgagcgcataaatttgtgcgcgtgtgtgcaacttttttccttggggccttaaagggccttccccctgtgtttggttgagacccacagncccgttagtaccttgggggtaattaaaaaggggcgccccctcggttccaaagagccacttgggggcttgcccgccgcgttgtgagatgccgcccacgcgtgtgttgtcgccgtttcttgggggacaccacggtaaccccctcccgtgggcccccccctggaagtgtgcccccgcaatgggggggcccactaaggtgtttgactgttaaagctccccacgttttaaaagagatgcgccccgttaaatgttcgtgttttgggttttaagtgtacacacgctgtatattgttgacacacaatanaattggctggggtatatttngggcgcgccacccctctctcggttaattgaggaataaaatgtgttctaaaatcccaatggttctcctcgccctcttgtgatttctcttgttctgagagggcctctgtgttctcgtttctcctctcacatttctaaagtgagaaaaggtggtaattttctaagtggcctcggggtggcaatattcactcccacgcgataaatagtttctgcgccacagactgccactctcctctcttgttaactaagagtccctctgagccacagtgcacacactgtttgtgggagactcggtgggcccacagttcgtaatacgccacttccctcggaaaggaatttctgggaccacaataattnccacgggaattcacattgaactttcttggctccccctttttcccacatttcctctctggggagaaagaggggagaattgagccacatggcttataagtgcaatccctatcaaaggggcacgctctcgtctcccacatggccacattggagatcactgagacacactcgagagtcacgaaggcntggggcacgaatcaacttcacagcaagcccccacatgaatggttttcacgtcctgctttctctgtgggtacgtgcccctctgtttaaaaataaactgaatatggatgttta

SEQ ID NO: 679536 - DNA, 470 bp, Homo sapiens
  misc_feature (32)..(32): n is a, c, g, or t
  misc_feature (338)..(338): n is a, c, g, or t
cacgaggtgtatcataatgtctttcatagatngtaagacagggaagtgtttactgaaattgactatccaaaaaatgttgactaactggttttatttgactttgggagtaaattattcctagcaatctctgggttttgggttccaaagaaccctggagacgagtgatggttgtatgctcagtattataggttatttaaagtaaccgaaccaaaacttgcatatgcacagcacataacagtggttggcacgtagtgggttgtgtgtgcgtctgtagtctcagcttcctgagtagatgggactataggtgcacacccggctaatttttgtatttttagtanaggcaggaattcgagaccagcctggccaacatggtgaaatgctgtctctgctaaaagtacaaaaattagttgggcatgttggcaggctgagtaatctcagctacttgggaggctgaggcaggagaatcactt

SEQ ID NO: 679537 - DNA, 718 bp, Homo sapiens
  misc_feature (468)..(468): n is a, c, g, or t
  misc_feature (492)..(492): n is a, c, g, or t
ctaacctggccgtatgtgacaatttcagagaactgtgattttgactcaagggttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcaganattgaaaagaaggggaaggggaanaaaagaaggggaagaagatcaaagaaggaaagaagaaggggaagaaaagaagggagaacatccaaacccaccatgtccccaggctcaacggcgtgctgatggcagtggaagagcgtgaagtcttacaggactcactggatagatgttattcgactccgtcaatgtactttgaactacctgactcattccagcactacagaagtgtgtatactcatttgaggaacag

SEQ ID NO: 679538 - DNA, 785 bp, Homo sapiens
ggcagtgtggagaagaccaagtctgtggtcagatggcatgcattaacacagtcttgggcgagtcgtgatgatgcagctcgtgagcagtggtcgtagaaaatgcactcaccaaatcagagctgttggtagaacagctacctccctctcactgaggaagaactagaacatagaatcaaaaaaagttgaaggatttgatctggttcagaagaccacacgttattatgttacgatcgtggtgatccctgatctaccaagcttcactcccgtgccataccagtcaggctgctcagcgagggcttaaaggaagctaagcaaaaaagccaacagaccatttctcagctccattctactgttcatcctgattgaatttgccaggaagaatgtgtatacgttgccaatctagaaaattcaggatgctcaaggataaagctctacctctcatgggtagaagtggaagaaggagcattggatatgatgatacggtgatgagtcccactgtgctgacgcacagttgacgttcacggtatctcttgccagttgcccgcagaggctgactcagggagctccagaacatgtgccataccctccgtgtccaacagtccaaggtgtaccacagaacatccaagatcaagccaacgcacatggcgcgtgtgactgcgcagtgcgaccatctactctagtgttccgcaatgtcgtgcctcctttaagagagagtgtctgacaaggctcctcagttctagcaaggggcaggtgctgaatatgaaggaatctttacatgacgtgat

SEQ ID NO: 679539 - DNA, 191 bp, Homo sapiens
gtgtcccagttgagctgtcgcaacatttaaggcgataggttgacgaagcgctactttgtacatttaaagcttgcatggtccagtctaccaactggcccagggagtcttgtttcgtgtttttcaacttgcatatagcttaacccttttcttattaacacttggaattccttctaaagctgtcactatcagat

SEQ ID NO: 679540 - DNA, 459 bp, Homo sapiens
  misc_feature (34)..(34): n is a, c, g, or t
  misc_feature (93)..(94): n is a, c, g, or t
  misc_feature (120)..(120): n is a, c, g, or t
  misc_feature (132)..(132): n is a, c, g, or t
  misc_feature (135)..(135): n is a, c, g, or t
  misc_feature (138)..(138): n is a, c, g, or t
  misc_feature (157)..(157): n is a, c, g, or t
  misc_feature (188)..(188): n is a, c, g, or t
  misc_feature (193)..(193): n is a, c, g, or t
  misc_feature (215)..(215): n is a, c, g, or t
  misc_feature (223)..(223): n is a, c, g, or t
  misc_feature (232)..(232): n is a, c, g, or t
  misc_feature (246)..(246): n is a, c, g, or t
  misc_feature (259)..(259): n is a, c, g, or t
  misc_feature (282)..(282): n is a, c, g, or t
  misc_feature (286)..(286): n is a, c, g, or t
  misc_feature (300)..(301): n is a, c, g, or t
  misc_feature (319)..(319): n is a, c, g, or t
  misc_feature (351)..(351): n is a, c, g, or t
  misc_feature (356)..(357): n is a, c, g, or t
  misc_feature (361)..(361): n is a, c, g, or t
  misc_feature (374)..(374): n is a, c, g, or t
  misc_feature (390)..(390): n is a, c, g, or t
  misc_feature (399)..(399): n is a, c, g, or t
  misc_feature (428)..(428): n is a, c, g, or t
gcgataaggagatggagcgcacaggggagagggnaggcagggagaggagggggggaaaagggggcgggagcagcgacgaaacagcgcagcaanngggggggcagagcgcgagaggaagcnacaaagaattgnacnganaacaaaccacaggggaaanggggggtaggaagagtcagccttagaaaagngacanccacacggttgcacagcaagantgcgctcnccaaaacgnagccatcaaaagcngcaaacaaacccnatattacatccatttgacagaanggcngccaaacatatatnnggcgggaaaggattaaanggggagtgtgtcaaagccagcggggtgaaaangcggnngggnaaaaaaggatgantatgatttagaagtcnctatatatngacaggaaaaaagtgacactactgcactnttgcggggataacggaatcgtgacaggggct

SEQ ID NO: 679541 - DNA, 337 bp, Homo sapiens
ttttttttatggtagaaaggattgactttattaacctcacttacgatactgaatacaaagtaaaattaggtggtgacccctaattttcagtctatttcaaagcatggtcccccagatttaagaatttaggcattcatatgtccaaaaagggaagcgaatccaaccacccaatcccaaaagacccccgtggattaaggaataagaaagttgagcctaaggcccttatgataatcccttttagtaccttcttctacgttttcattaattccttcagtaactggatttttaaccaaaccctataatccatcataattcttccaattatgagttgaaaaga

SEQ ID NO: 679542 - DNA, 525 bp, Homo sapiens
  misc_feature (55)..(55): n is a, c, g, or t
  misc_feature (60)..(60): n is a, c, g, or t
  misc_feature (91)..(91): n is a, c, g, or t
gatctcttgagtatccccatctatcctgcgatagcgagtgtacgatgttctctgnctgcngatgacatgatcttacatatagaaaacgctnaagactccaaaaaactattagaactaatgaacaaattcagttaagtagtagcataaggaaatcaatgtataaaaatcagcagtgtttctatgtactaagaacaaactatccaaaaaagaaataaataaaacaatctcacaataactaccaaaaaaaaaaggcttgggaataaatttattcaaagaggtgaaagacccatacactaataagtataaaatattgaagaggatgggtgcggtggctcatgacagtaattccagcactttgggagactgatgtgggcagatcacctgaggtcagtagttcgagaccagcctagctaacatagagaaaccccatctctactaaatatacacaaattaggtggtcgtggtggcaggcacctgtaataccagctactcggaaggctgcagcaggagaatcgcctgaacttg

SEQ ID NO: 679543 - DNA, 1073 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 679544 - DNA, 2086 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 679545 - DNA, 910 bp, Homo sapiens
agtatctgcaccataccataacttgctctgagccatatagtctcccctgtccacttctgcacaatatcatggcctaattccctctgtccaattaggtcttcaaacgacgctcctttttaagggccaaaacctgctctacaaagtacttggacgctttctcccacagggggaaatctcttcacccccttacaccccgtttttcttcaaagcccctgtttttccctaaaaaggaaacacgccatacggcgaacttcttctacaaagtggtagtctcttccacaaattaagccaaacttcaccactgggtgaacacccccaacaaccaacaggggaaagatcttccccctcaagaacggggtacttccccccccttttttacacagccggtacatttaaaggtaaaatctggacgtcttttaaagcaatcctgccaaatccacacccggaaaacgttctgttgtaaacacgcgtgctccgcctccaagaaggctcttcttcaaacgcgccatactttgctataatacagttcccctcaattggggcccccacaaacatgatcttcttctgtatcttgacccgcccgccaccaggtttgctctccatatattggcccttcctccccccgagggagttgttatatacaccatggtctctttgttagaaaaatttatcaaattttgtatcaaccctttcccctaaagccgtcaatcaagctagaaatcccatttctaagttattatgcaaacaacataattccttctacttggcagcatcaaagactagcaaaatgccgccatttctcgcaaaccaccaccacgcgcacgctcctatccccgcccccaattacagttcttttttttataaacaaggttttccccaaccctttccgcgggttttccccaaaaaaaaa

SEQ ID NO: 679546 - DNA, 2186 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggtgatgcccggggcattggggataggatgaagctcctggagccttggtttgccccactgtgggctgggcagcatctgaggctcctgctgggctcccctaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 679547 - DNA, 323 bp, Homo sapiens
  misc_feature (42)..(42): n is a, c, g, or t
  misc_feature (49)..(49): n is a, c, g, or t
  misc_feature (117)..(117): n is a, c, g, or t
  misc_feature (137)..(137): n is a, c, g, or t
  misc_feature (172)..(172): n is a, c, g, or t
  misc_feature (207)..(207): n is a, c, g, or t
  misc_feature (254)..(254): n is a, c, g, or t
  misc_feature (266)..(266): n is a, c, g, or t
  misc_feature (294)..(294): n is a, c, g, or t
  misc_feature (301)..(301): n is a, c, g, or t
aattttaaaaaagtaaaaataagctgggcgtggtggcacatngccagtnggtagtcccagctaactacgaggttgctccagctcaggcgttcaaggctacagagagccatgattaanccaaggcactccagcctggntgacagagtgagactgtctcaaaataaaataaaantaacatattggtgaagatgcggggaaaaaaaaganctcttagacactgctggtgggaatgtaaactagagcacccatgtggngaacaacatggngtttcttcaaaatttacaaatagaactntcatatngtcccagcaataccttactggg

SEQ ID NO: 679548 - DNA, 116 bp, Homo sapiens
tgagctaaaatacaaatggcgggatggtggtgcgtgctgtggtccggctacttgggagactgaggcgggagaatggcgtgacccctgggaggctggagcttagcagtgagcctgag

SEQ ID NO: 679549 - DNA, 127 bp, Homo sapiens
ggcacgagcctggacgcagaagcaagtcaagagcctccagagcttgttgaaggacacccagattcagctggacgatgcagtccgtgccaacgacgacctgaaggagaacatcgccatcgtggagcgc

SEQ ID NO: 679550 - DNA, 991 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 679551 - DNA, 2168 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 679552 - DNA, 257 bp, Homo sapiens
tggaaagggagtctggctcggtcacccaggtgggatggcaggggggctatctgggctcacggaaacctcggcctccaggcttcaagcgaatctcgggcctcagcctcccgagcagcgggaataacaggcgccgggcatcacgcggggctaatttgggtatcttaagtagagagggggttccacaagggtctcgagctcttgacctcaggtgatccgcccacttgggccacccaggatgtgggacgggggtaccgagc

SEQ ID NO: 679553 - DNA, 992 bp, Homo sapiens
gagcaccgccccgctcgccccggcggcagagaggagactatgtgaacgtcagtgtgctgctgagcgagcccgagggagtgcggtgtgtctgtatcggggccttagccgccagcccggtgctgagctgccgcctgcctgggcccggagggtcaccacgcagtacggtggcaatacctggacggtgcacactgagtgtgacccagaggggaactggaacgcatgtgagaacattcgattctgccgccaatacctggtgttccatgacggggactcagtggtgtttgcaggacctgcaggcacagtgtggagaccctggtgggaactgctgagcagagagtctccttcaggcaccatgaaaagctgtgctgcgcaatgctggaggcacgggccctggggaagagaaggcagtatcctggagggtctgggagaagaacccggacgctcaagagcttcaacctgtcagcgctggagaaatcatgggccttgtttcattgattgattgacttgctttggctgccatgtcctggtcgcactcggatgacacacttgtttggatgctcgcacgacaagaagctgccccaaggacagaggtcccttcttcaggaccaaagccttggcggtcagtgccaggagatgatgagatagcatggttgaaacgcaagacacgccatcaagggggatcaggatgtggtatggaaggactgtggaagaaaaggatgtgttgcgcaaaagtcatcctggagatttgagttatgatgttgagagtgcaaacattgttctagggggggcattggcaatttgcaccaggaaggcagtattggcactgaagatctgcttgaaagtgtggagtgagaagatccggtgggggaagaattatatacgtatgcatatagcaaaacaggacaggataagagctagtttatgcagaagaaaagtactgaagtagattgtcgtaggactttatggcagaagtaaggtggcatcacactagg

SEQ ID NO: 679554 - DNA, 2163 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcaaaaaaaaaaaaccccgggcctttgggcggaaaaagtaaaggccggtatttctcccctttaaaggaacccgccccagg

SEQ ID NO: 679555 - DNA, 318 bp, Homo sapiens
  misc_feature (218)..(218): n is a, c, g, or t
gagacagggtctcactctgtcacacaaactggagtgcagtgcataatcatggctcactgcagtctcaacctcctggtctcaagcaatcctcctgcctcagcctcccaagtagctgggactacaggcgtgcaccaccatacccagccaattttttgcagagatgaggtcacaccatgttgcccaggctggtcttgaactatttgcctcaggcaatcctntttgcatcagcctcccaaagtgctggtattataggcgtgagtcaccacaactgggtaaaaaactactttatggtgataaaagttaaagcggtttacctag

SEQ ID NO: 679556 - DNA, 2268 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggtgatgcccggggcattggggataggatgaagctcctggagccttggtttgccccactgtgggctgggcagcatctgaggctcctgctgggctcccctaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 679557 - DNA, 2088 bp, Homo sapiens
  misc_feature (2052)..(2052): n is a, c, g, or t
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgtccttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctctgtgccgtccacctctctgtgctgtccacctctctgtactngtccatgtcctctgtgctgccacctctaggtggggc

SEQ ID NO: 679558 - DNA, 375 bp, Homo sapiens
atctgccgtcctttggtgattaaatgcacaccagcaaatctatgtcttgacctgattcactggcataatgcatgagcagaggctagacgtatcatctggattgttgtgaaacgtttaaaagcagtggccgctccctgcttttattcatttaccccatcctggattaagtataaagcactgtgaatgaaggtaggtgaaaggctagatgcaggggtgtgggtagacgtattttatcttattttatcattattttagaggggggaggtagctcaatattatgggctcctttccccctttttttggtgatctaattgcattggttaaaagcagctaaccaggtctttagaatatgctctagccaagtctaactttatt

SEQ ID NO: 679559 - DNA, 1068 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcaaaaaaaaaaaaccccgggcctttgggcggaaaaagtaaaggccggtatttctcccctttaaaggaacccgccccagg

SEQ ID NO: 679560 - DNA, 905 bp, Homo sapiens
  misc_feature (36)..(36): n is a, c, g, or t
  misc_feature (70)..(70): n is a, c, g, or t
  misc_feature (121)..(121): n is a, c, g, or t
  misc_feature (127)..(127): n is a, c, g, or t
  misc_feature (183)..(183): n is a, c, g, or t
  misc_feature (193)..(193): n is a, c, g, or t
  misc_feature (196)..(196): n is a, c, g, or t
  misc_feature (222)..(222): n is a, c, g, or t
  misc_feature (228)..(228): n is a, c, g, or t
  misc_feature (247)..(247): n is a, c, g, or t
  misc_feature (262)..(262): n is a, c, g, or t
  misc_feature (266)..(267): n is a, c, g, or t
  misc_feature (278)..(278): n is a, c, g, or t
  misc_feature (317)..(317): n is a, c, g, or t
  misc_feature (343)..(343): n is a, c, g, or t
  misc_feature (356)..(356): n is a, c, g, or t
  misc_feature (413)..(414): n is a, c, g, or t
  misc_feature (472)..(472): n is a, c, g, or t
  misc_feature (685)..(685): n is a, c, g, or t
  misc_feature (816)..(816): n is a, c, g, or t
  misc_feature (899)..(899): n is a, c, g, or t
ttcatgctatcatatttttttttgtttattcttatntattgtgtctatattgtgtttgttttcaatttgnttattttatatatattttttattagctgcagtagctgcatttctatttttnattacnattttttaaagtctttttgcttggtcatctaaagacgtttttcaaatttcaaaagntcagcttttnttnttctccttgtttcccctaaggatttnttaaantgtctcattcatttccttntttctaaatgttccngttnntaacgaaacantgcaaaaatggcaaacattttcttggaccatttttttcnctgttacaacaaaaaatgttcaaggnaaatagatctttnttttgttttattttttgtctgtttgtatttttattaagtccgttcagttttattttnnttacatagctgtaaccatcttaaggaaaatgacattaagtttgcaacaaatacttgcnggtgaaaacacattactagcatttcaaaaatttacaaaaatgtaacaaaatatcctaaacagctatctttatatttgtaaaggaagtatgaacaactggcttaaccagtttccactgcacatcaaacaggtggcaaagtgatagagatcatctttgatttttaagagaataataaaaactaatttatatcccacacattacaattctaggggnttaggaacaggctaacacatgatgtcatctactttaacagccttttcatttactcgtattgtcttgatactttacaatgattttttttttcctataagataatcgtattgttgctgtaaaagccgtaattnttttattttttttaattcccttaaagaaatcgtgtgaaccatttcccattagatttcataaacacacgtgaaaattcagacanaatagg

SEQ ID NO: 679561 - DNA, 1160 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 679562 - DNA, 788 bp, Homo sapiens
  misc_feature (692)..(692): n is a, c, g, or t
  misc_feature (713)..(713): n is a, c, g, or t
  misc_feature (737)..(737): n is a, c, g, or t
cgcgaatcggcaacgtgaagaaggccgtgcacgacctcggtatcgactacccggtcgcgatcgacaacggctattcgatctggcgcgcgttcggcaacgaatactggccggcgcactacttcgtcgacgcgcagggacgcatccgccatcaccacttcggcgaaggcgaatacgcgcagtcggaacgcgcgatccagtctctgctcgccgaagccggccatccggaagcattgaacgtgccgctcgggctggccggtgcgcccgcgaagggcgcgctcgcggcggcggacgccgcggacgtgcgctcgcccgaaacctatgtcggttatgcgcgcgcggaggacttcacgtcgccgggcggcgtcgtgcgcgatgcggcgcaccgctacgacgcgccggcgcgccccgatctcaacgactggggcctcgccggcacgtggcaggtcggcgccgagcgcgcgacgctcgccgcaccggccggccggatcgtctaccgcttccatgcgcgcgactgcacctcgtgctcggccccggcgagaacggccagccggtgcgctttcgcgtgacgctcgacggcgcgggcccggcgccgcgcacggtgccgacatcgatgcgcagggctacggcacgtcaccgggcaggcctgtaccagctcgtcaggcagccgggcgatcggcgacgcacgttcggancgagtctcgatcggggtcgangcgtacgcatcacttcggtgacgngggcccgtcatcgggcccgctcaccgcatcgaggagaagagaacgatcccc

SEQ ID NO: 679563 - DNA, 1076 bp, Homo sapiens
  misc_feature (626)..(626): n is a, c, g, or t
attcacttcaaatacggaaagcgacgataaacgacgagaaacggcacaaaatagcgacgacacgacgtcaaagcgacgataaacggacgtctaaaatacgtaaaacatatatccactaacattccaccgagaaagccaccgacatatatatattgtagtacaggaggaagaccgtaaaagtaaattgagtgcatacgtcacgcggcttcgtagctctaagtacgctcagcgaagtccgtgcgagggcccttcgaattaaaagacggaggttcctaaaacatcacgtagcacggcgattcagtcgtaaataccgaagtaggaagggttgaaacggcgaattcctaccatttaggtgatcaccgaaaataaatctactaacactaatactaaaaaatatcctgggcgagagagccgcggtacgttaaaacggtatagtagtaacgaaaggctcgagaaaattaaagttagagcggttaatatggtggatgacgctggcggtgacaggtcgcggaacgcaagctactcctccacgtgagagcggacatccccgcgcctcctaactaccacaaagagcgaaaaggaaaacggaggaacaaacagaaacgtagccccgaatgtaaaagtgnggagtaacaaacgacgcagccgatatagcccgagaaagaacaaggaccagcgataaaccgaacggcgcaggcggtatagcaaacggacaagcgagggcgtggcaaaggtagccgcgcgcagcagggggaagccagcgaaagatagtagtttactcactaagagtccgatccaaacagcaggatactaaccgatagaagccatagccgtacggaggataaaacaaaataagcatagacaccaaataccggaagagataagctacaagtaatcagcgaggtaggggaaaaaaagaccaaggttccataaacataccataacggaaaaaggagaataacagacatagcataaccccagtaaaggacaacgcatacaatcgagcattagcaaaggaaataacccacataatgaccactgacagtgtacttgctagtaacatacgtagggacact

SEQ ID NO: 679564 - DNA, 394 bp, Homo sapiens
gactagctgactcttcctttcagcctcatccaacccccagccacccttctcctgccccagccttccatctcatctctctgcttccatctctggctttatccactccagccagatattgctgctgccagatccatttgctttttatcacatcactttcttgcccccaaatctatcgcactttcattttgcccttttcattgtttacagaaaaatttgggttttacttgatagcagttatgtgtactagctgttgataatatcatcacacttgagtgccgagcattttctgggcaaggtttgatttcagtgttttcgtggtatcatttgctagactttatatttcttattctgtttcattctcttacagctggtcttggaagaacagggacattgc

SEQ ID NO: 679565 - DNA, 734 bp, Homo sapiens
tagtctaatcttatattcttttagaaattagaatgtgtggaagcgaggtatactttccacatgactctttttttaaagatggcttgagatactcaccagacattaatttcattttagttgtaatgaccagtgatgggcatcattgctttaataattaggcatcattcttaggactgcttgttgagagtagacggcagcttaatgaccaggacaccaccctcccaaccttccattaaaattcagcttgccagaatagcaaaatatgaaaccaataataactaaaaaaatgcagttttctagtaaatagagacttgaagtggatatatattcatcactaatttttacattagtgtttaggataaacataatgtaagagcaggtaccatggttgctaggtaaccagtggtgattgtcatgcccgatattcaactcttaaagggtatgcttaatgggtataatcttcaatttaatttgagattaatttaaaaatgtatgcttgaaatattttatgttaataaacttttaaatattgcaacatggtattaacactaaatgtgtgacaggcactgaattccagaacaggtttcttaaaactgtattaacttgtggttagagctaaattattctacccacaaaaataacttttgaatcaaattaacaaattaattagtgttatccttaaagacttggtgagaacctgcaatatttctgggtgaaggattgcagacatagca

SEQ ID NO: 679566 - DNA, 371 bp, Homo sapiens
gaagagatgcatcaagcatcattagttatatagggaaacagaatggtctaaaaccataatgagatgccgcttcaccccctctaggatggacacaaaatggaaatgtaacacgcgtttgctgaggatgtcaggaaattgaagccttcatacattgctgaattggaagtgtcaagtggctgcagccgcgtgtataatgagtaagtccgtggtgctccaaatgaggttacagtatggacaatacatatgtcccaacttctttcgctctctagatatttatgcgtagaaaattgaagacatgttcaaacaaaatgtgtacataaatgttcacaggaacgttattcataacagccgaaaagtggaaacaatccata

SEQ ID NO: 679567 - DNA, 936 bp, Homo sapiens
gacgagttcgacggtcccgcggctctgtctcttgctgcaacagtgtgcggacggagacagatccgggaaaatctcttccagctctccgaagacgagcacttcgcggatttccttctccgtattgtcaaaccacatctcgtgggatccactatgcttcggtacaacttctcggcttatctggtgacctgtccaagaccgccgatttttgatgaggtctagcatcattcttggcacgaaaccatactgaatggaagcttcaccagaaatgtcagtcatgaagtgaatgccaccgatcgatgagggtgccttacgatcaatgagggctggtcgagtatgtacctggctggaccgtcctatcacctatgctctcttcatgggaactttctagtattacggaacacggcagcatatgcagtatgccctctggtaaaggacgctgaggcgcaagtgggctattccggcctaaacatggtccgaaggaagagatgcagcctgtaggggccagacttagcgctcttcctgtaagaaatgtttgtagggtgagttgggcgtcacgtctgtcgatcgtctgtaaccgtgacaatcaaagaagatccagctcggaaaggagtgaagtggggggtgacacttggcacagtaccgctgatggacaagggcgtaggacattggcgcctctgtgtagaaaagaccgtatgtataaccagcgatccttatctagaaactgccttcactgaccacatggggtaaactagtcacgctgggggagatgcgccaatgctgtagtcgcacttcgtggaagactcgactttcctgagaattggggaaagtggaactaagcaagaacgatggcgtgcgccgactgagacctagctacaaatggggtgggtggcccgataggctggtctgggcgaatactcttcctaaagggtaactcta

SEQ ID NO: 679568 - DNA, 138 bp, Homo sapiens
tattcctattttcagtagagacggggtttctccacgttggccacgctggtctcgaactcctgacctcaaatgatccgccttcctgggcctcccaaagtgctggaaacgacaggcctgagccgccgggatttcagcctt

SEQ ID NO: 679569 - DNA, 238 bp, Homo sapiens
aacaactcttgtgcctcagccaccctcagtagctaggaccacaggcctgcaccaccacacccggctaatttttgtatttttagtagagacagggtttcaccacattggccaggctgttctcaaacttctggcctcgagtgatccacccgcctcaatctcccaaacaaagtgctgggattacaagcatgagccaccacgcccggcccctgcttggatttttaacgaacctcataacgaa

SEQ ID NO: 679570 - DNA, 101 bp, Homo sapiens
catgctatagataatatattccgcactcaaggagtaaccaggtcgtccaagcaagaaacaaatgggaaaatgtcttaaaaaatcctgggtggactttatga

SEQ ID NO: 679571 - DNA, 910 bp, Homo sapiens
  misc_feature (348)..(348): n is a, c, g, or t
  misc_feature (372)..(372): n is a, c, g, or t
  misc_feature (380)..(380): n is a, c, g, or t
  misc_feature (393)..(395): n is a, c, g, or t
  misc_feature (401)..(401): n is a, c, g, or t
  misc_feature (429)..(430): n is a, c, g, or t
  misc_feature (442)..(442): n is a, c, g, or t
agcgggtttccttccagcagctccgcggggtaggaggggaatgggcttgctctctctccggcgattactaacttttgcatcgcccctgtttttgtctttctctccatgtccccttcccgccctctgcagaccatggtgaagtccgggcagcagcatcgcagccgtccccggtgacggccggctccctctcctggaagcggtgcgcaggctgctggggctacgattgcggaccgctttctgctctatgccatggacagctattaggcgactagctcggttgtcctccagatgtgactcccgtgctgccaggctgcagcgtggcgcgatcgactctgtgcacgtcctgtnacaccaaaagtggcatgatccttntgcagaanatgactacattcnnnttattnggaaatagcggtgcttgcagcgctatgnnggacagtcgatncctgcgagtgaactcgtcatgagggcgcaaggcaatgtgtatcatctgtaagtgttttacattgctctacctgccggaatcgcctggtcccgggagatcggtctcactacattcaatggcagtttattttgtgaacatgattagacctacagtctctcatcaatggccatttgaattcacttcagagcaatccactactgccagaccagaaggtctgctagaaggtcagagtaatgcagaatgcgtgccttcatctcagatttgtcatcacaggtggatccatgtgtcttcagtagacaaggtcccctgtgtagctagcaacagtgccagctccatgccattgcaccttctttagtcttgatggcccttccgcattattggggtcattacaattgactgatatgaccttaaggactccatgaacctggctatggggagactgttgagaaattgaaaaagattcaccaa

SEQ ID NO: 679572 - DNA, 845 bp, Homo sapiens
ggcctcctgccggcctcatcttctcccaggcaaacccgcctggagccctatggccaactgcgattacagcccggtgtccggggacaaaccctgttgccggctctctaggagagcccaattctgtcttggcgtcagtatcctggtcctgatcctcgtcgtggtgctcgcggctggtacgtccctaggtggcgtcctagcagtgatagactgtgtccgggactagccaccaatgcgctttcccgagaccgtcctggaagcgatagcgtcaagtatcactgaaaattcatcactgagattgatgaccattggtagacgttgcccccatgctcgtaatagtgcgatgcgtttcgaagagggttgcggttgcattatgctaacagatcagtcgcattgtccacattgtacgtcgattcgaacgacctatcgaagcgcacgtgaatttgaagcgtcagtggaagcatcaggagcgcagtacccatatgcgagactacttgaattccttctttccgcgatgcatgacataatacacgcatcttggtcccgatcatggttctacgtcgaggtccgaacgagagacattagttcaccgcctgtgcaggaccacttgctgctaagggccttaaccttgcctcgatcgaacctcatcataggatgctgcgttggaacttcgagaccaacttccagaacatacatactgattcatatcttggcaccgaaacctgtggaagacaacggatctgactaggccaatccaaccggctgttctcagatatatctgggagaatagcgcgtctttcccggcgaggatttgcgagagatcttgccttcgtgatgtgttctccatg

SEQ ID NO: 679573 - DNA, 332 bp, Homo sapiens
tgtctgatagctgagaggtaccagcaatagcccacaaaaaggagagtcgatatgcccgttacgttatcgaatggtcagcaattgtttcttcaccgtcgatgccgacggccaggagaaacaacgggaacctacccgtttcactgtcgacacagacagagagaaatccatgtcgtttgtgaagttgaacggtgactgcacctacatcaccgaagctgaagccgacacattgaccgtcgctggcgccaaggatggccgtaagcatttgaaggccaccgacggtgattcggtgatttgattgatctggatcatcactgcctgaaaagcgctgcacc

SEQ ID NO: 679574 - DNA, 573 bp, Homo sapiens
cctcagggttttccggagctgaagaatgacacattcctgcgagcacctggggagaggaaacagactacactcccgtttggtgcatgcgccaggcaggccgttacttaccagagtttagggaaccgggctgcccaggacttttcagcactgtcgctctcctgagcctgtggactgcctcaccactggcgctcctctggatgctgcacatttctcgacatcctgttgtcccaggcactggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattgggctttgctggtgcccatggaccctgatgacatacatggttgagggtggtggctcaagaccatggctcaggccaaggctgggtctatcagagactcaggcgagtcacaagtggttcgaatcgcaagagaggctcggccatatctggtagagcaatggggtgg

SEQ ID NO: 679575 - DNA, 145 bp, Homo sapiens
caccatatatttaatccaacaatgaggcatgattgataaatatactcttagaggagctgaacaatttcacttgcaggtgggccttgataagaccgagacaatgacactgccattaaggcatgatggtctactgatgacttagttt

SEQ ID NO: 679576 - DNA, 1335 bp, Homo sapiens
tgagcggcgctgggcgctctcggccaatgagcggcgtccacatgccgctggcggcggcgaaacgtgggaggcagctggcctgataaatgctattagagcagcctcctgctggagcctgtccccgacgccacctccttttccttctgccgcagtttcctccgcctgcatgtcgggcgtgcggcgctgagggacccgggctgagcgcgcctgcgacacctgcaccgacctggcttcgccttccctcgtgctgctgttccggcccttcagtgggtcttgcctgtgtgtgccccactccttcctgtgccctgtggcgggtggccttcttgatctgcctcaatgacgagcggtggacggggggcctccggggggcccgcagggcaacttgcaccacatcaccgggcaggggccgggcatgaagggggcggaggggaagggccacaatcccgtttcatggggcgaacggggcgaacgtggaagcggatgaggataccaggaaggccgcacgaaaagccacgggcaccaagtgacgagactgcactcggggggacccggcagccagaaagggggagccggaggatcattgggatacaatgggaggcggcggaaaggggagagagaccaggcccggagaggcgcatgccacattacacacgtccggcccaccgggggctaggaaaggcgacgggaacagcgccgggtgcaccggcacaacaggaaacgcgaaacggcacacgggggacgaaagaaaggacccacgactacccggccggccccacttgtggggaggacatacaccacggtaggtgatatgtgacaaacagaacaaggcaccgacgacgagggccacgtggaacaggtgtcgccgaaaggtgtacgcggagaaaagcagccagaaacggaccagcggcaccctggcagacgagtgaggacaccgactggggcaaagtggaccagaacatggggacagctgtgccccgggggggcacacccccctcgacgaaaagaaggcacaacgtggtgtagaagacaaacaccgcggccgtcgccacgaccaacaccaacaagggaacacgtgggtggaggacaaccggcagagtgctatgccatggggaggcccaaacatttttcaggggcaactgctaacaaacaccgaaagagcaaggaaccccggggatggcctagtgaaggcccactgtggaggaaaacccacaggggttccacaagcgaaaaacggcctgataaagctgggacggcacaacacatgggggtgggagcatccaccaagccgtaacgttattcacccgcgggtttggccaccaaaaaagcagacaacac

SEQ ID NO: 679577 - DNA, 172 bp, Homo sapiens
  misc_feature (76)..(76): n is a, c, g, or t
cccgcatcccccttccaacaaaaaaccccctctacctaaaaataacagccctccgctgcagtttcctaggactgantacaagcctagacctcacctacctaaccaacaaacttaaaataaaatcccccctatgcacattttatatttccaacatactccgattctaccctac

SEQ ID NO: 679578 - DNA, 143 bp, Homo sapiens
gcggccgcctactacttctactgctcgaattcaagcttctaacgatgtacggggacatgaaaacattctcctccgcataagcctgcgtcagattaaaaaaataaactgacaattaacagcccaatatctacaatcaaccaaca

SEQ ID NO: 679579 - DNA, 852 bp, Homo sapiens
taatttatagagcatttcggggggggggggggaaacacacctaaacactttatctccaagttacaaaagtttgaggtgcagagggaaggccagatttttttttaaatgaaattatatagatgagatctcagtatttaaactggtgtcctcaattttggtggaaggctggggttgggaaataacccgcctctagtggctggtgggtatcgcaaggcagcggtggcttaatcaatatttcctggtgctcaccagaggcaaaaggttaccaatatccttgacaccattctctctccatttacttctgggtgggttaccctgactctggactcttagaaggtggccccgagagggggctaacctttattaaacagatcggcatattatgagatctggcgggcgagccacaagggggagttccacattaactctacaagaccaaaccatttggtatctgggcatcatcttactaacacgacggacatggggggttttctggcatcaactgggtatgacgggttaagaatggccgtatacaagagggaatagaaaactggtactgttttaaaataatctgtaacttttcaactttgatattataatataggggggaataccaattaatgtgtgcgtgggaaacactcccgtcacaggtattactaccctggtgtttatataaccccgttaactcgtgccggtgcccggcggcaccggaagccttttgggacggtaggtcccaagggtatgcgggcgtgcccgggttaagtggcaccggagtgacaagggatcccggcggcacgtggcacttcttggccacagcggtggacccgggcacagggtcgccgcagacgcacg

SEQ ID NO: 679580 - DNA, 245 bp, Homo sapiens
tgcgctgcatgaacgcttcactgtggttgaactccagcagatggtggctcggcccgatgtcgtggagatgcatgatgtgacagcgcaggaccctaagctcttggatcagctcaaggccactcggaactctgtgcctgtgccaggccactggtgtgatcagacgcaaatactgcagtgcactgggggcattgcagccagccccccttctgcagcttgccgagacttcatccaaacgcacaggccat

SEQ ID NO: 679581 - DNA, 1137 bp, Homo sapiens
  misc_feature (330)..(330): n is a, c, g, or t
  misc_feature (354)..(354): n is a, c, g, or t
  misc_feature (450)..(450): n is a, c, g, or t
  misc_feature (456)..(456): n is a, c, g, or t
  misc_feature (461)..(461): n is a, c, g, or t
  misc_feature (467)..(467): n is a, c, g, or t
  misc_feature (477)..(477): n is a, c, g, or t
  misc_feature (497)..(497): n is a, c, g, or t
  misc_feature (629)..(629): n is a, c, g, or t
  misc_feature (971)..(971): n is a, c, g, or t
gggtattagtgatggtaaactttgtgtcgctctttatgaaatgatccatataactgtgggtgcatcagtgcttttcaaaggggctgcttactatagggttaactatgtatattcatgttaagagttaacttgtggttggctgtttcctggattttataacatacatgtgcagaaatgtattcaaatgaaaggaagcatacctttatcaagatgctattaccattgaacatcaagtataatatttcatttggattctctttttggttaatgcctaaaaatgcctattgggattttttttttaaattaagagaagctctcttctgtgtagancagttgtcccaaaatagcttaggnttggttccctgttgcttgacagatttaactattctttccagcagtggaggtgctgtcagagtccagtgttctagaagaggcagtgtctaaagccanatttcntttcnaattcnggtagctatnaccaggaatttggaaacgtntggttaaagtagtctaatattttcatgtaaagagcataacatttgcgctatgtattaaattttggtaaccctaacagttgaatcaatatttcaatcagtgccaagggctcctgtagtctatccacgttgtancaatacatatttgtcagattattgtcaaacacttgtgtatgcttatttaaaagatctattagggtgcacatagttgtggatgtcctaagagtatgcaaataaattttggtacaaaaaaaaaaaaaaaaaacaaaacattttttgtgggcaccagggccgtaaaaaaagttccaaacaccacttgtttgtgggcggggccccaagtagagaaaggacatatgggcaacacggggtcccaaggggaacctcgtggcacaagaagatgtggtggcttcccccccaaaaaaaaaaagcgccggggagacggcgtttttgaccaaccaggagggtcggggcaactcngggtacacacggccacggacataaccaccccccgcgaggatgggaaaaacagagagaagagagaaatgagagaaagagaagagagaaaagaaggaagagagaaaagaaacaaaagagagaagacagacgagaaaagaataaaggagaaaagtaatgaaggaagaaa

SEQ ID NO: 679582 - DNA, 852 bp, Homo sapiens
ggcaccgtggttcgcgagatgtatctctggccctccggcccattcccccggttcccccgatttggtctcaaccagggtaaccacccaaaataacttttgctggggtgatagatgaaaggattgctcccccctttctggtaacaacactagtgggtggggcccgcccacattttcttaagcagtctgcggggaaaccaccctaatgtgcatggaaagttgcttttcatcgcacaagccacacacattgggtgccacgagcgggatctgacttgtagtagcctccccctgtgggaccctccatctggtcgtctgcaagtgttattcaccaccagccggtcctccgccggggggtgctagctacaaaccacgccgggcccaaacaaaagatcctgttcggcatattgctccccgcgaggttgtctgataggatcgatccccgaaggaggtcaaagacgggcgctgcacctatagttcattttcgcccgcatattgtggtgcgcacccaccccagttaaaaagaacaccggtcggcgacagacatgcgtttccatcacgcctcttgtgtacctccattggcggcctcgatctacagccataatcgtgtaagcaagggcattaattgagtcaaccactgggctgtcgccatgccgctcccccagaggcgaagcagaaaatttggtctcggaacccccacttgtggttggtttttgtggcgctatgccctcgttgatagtatagtgagtgtgcttcataaaccacgcttcttttatatgggcgtcctcgctctgtggcacgccactaagtctgcttgtcggaaaacttgtggtgcccccccacaattatcaacccacc

SEQ ID NO: 679583 - DNA, 644 bp, Homo sapiens
aacaatgcaaatatagaatgtttggctgggcacagtggctcactaatcccagcactttgggaggccagggcaggtgacctcaagcaatctactcatctcggcctcccaaagtgctgggattacaggcgtgagccaccgcgcctggcctaatttttgtatttttagtagagacggggtttcaccatgttggccaggctggtctccaacttctggcttcaagtgatccgcctgctttggcctcccaaagtgctgggattacaggtgtgagccaccgcacccagcccatttgtagtttcttaaagccccagatcttctgactatttgaaatgagagaacataatctgtccctcttactcttgtcttctagaagagcggtgttccataaatccttaggattctgaggttatgccccagagactgtcttacagaataaaggggagaccaagccgttaaaatttccccactacttttgtaccattgcagtttggcttttagatgtttactatattggagttctgcttaaagtttgaaaacactgctctagatagacccttccactctggatgcctcttccatcctatttgggccctggatattagtgtctggcccaagaggtctaaatttgtggaatgaagatggtgaac

SEQ ID NO: 679584 - DNA, 442 bp, Homo sapiens
  misc_feature (6)..(6): n is a, c, g, or t
  misc_feature (63)..(63): n is a, c, g, or t
  misc_feature (74)..(74): n is a, c, g, or t
  misc_feature (88)..(88): n is a, c, g, or t
  misc_feature (140)..(140): n is a, c, g, or t
  misc_feature (150)..(150): n is a, c, g, or t
  misc_feature (159)..(159): n is a, c, g, or t
  misc_feature (174)..(174): n is a, c, g, or t
  misc_feature (178)..(178): n is a, c, g, or t
  misc_feature (191)..(191): n is a, c, g, or t
  misc_feature (217)..(217): n is a, c, g, or t
  misc_feature (223)..(223): n is a, c, g, or t
  misc_feature (230)..(230): n is a, c, g, or t
  misc_feature (240)..(240): n is a, c, g, or t
  misc_feature (275)..(275): n is a, c, g, or t
  misc_feature (277)..(277): n is a, c, g, or t
  misc_feature (291)..(291): n is a, c, g, or t
  misc_feature (313)..(313): n is a, c, g, or t
  misc_feature (320)..(320): n is a, c, g, or t
  misc_feature (335)..(335): n is a, c, g, or t
  misc_feature (344)..(344): n is a, c, g, or t
  misc_feature (365)..(365): n is a, c, g, or t
  misc_feature (372)..(372): n is a, c, g, or t
  misc_feature (376)..(376): n is a, c, g, or t
  misc_feature (385)..(385): n is a, c, g, or t
  misc_feature (390)..(391): n is a, c, g, or t
  misc_feature (393)..(393): n is a, c, g, or t
  misc_feature (403)..(403): n is a, c, g, or t
  misc_feature (415)..(415): n is a, c, g, or t
  misc_feature (421)..(422): n is a, c, g, or t
  misc_feature (426)..(426): n is a, c, g, or t
  misc_feature (436)..(436): n is a, c, g, or t
ggttgnggttctgggaatgtgttctaacagtgtaaccatctaaaaataagaaatcccaaaaanacaccaactgnagaaaatttaaaanagaatttaaatggagacttttttatttccttcattgcaatataatgttagtntttttttatnatttggtgntttagcagctttgtngtcntgtagcacaaagnttctctttactgccacaggctaaggntgctgnacagggnaggcaccaangggagacactggcgatgggagtgctattgggaaantnctgtgttcaagcanaggatggggttatttacatccnccagagngtctcaaaggtgtanatgggcaantcttccattgttagattaggnttatgangggnggggggggnggggnngnggggctgtgngcgtgtgggggnggtggnnctgnggtgggcttngggggg

SEQ ID NO: 679585 - DNA, 1120 bp, Homo sapiens
  misc_feature (10)..(10): n is a, c, g, or t
  misc_feature (20)..(20): n is a, c, g, or t
  misc_feature (23)..(23): n is a, c, g, or t
  misc_feature (474)..(474): n is a, c, g, or t
  misc_feature (1007)..(1007): n is a, c, g, or t
actaccagtntagccgcacnttnactatactactaacagaccgcaacctaaacacaactttctttgatcccgctggaggaggggacccaattctctaccagcatctgttctgattctttgggcacccagaagtttatattcttatcctcccaggatttggaattatttcacatgtagttacttactactccggaaaaaaagaacctttcggctatataggaatagtatgagcaataatgtctattggctttctaggctttattgtatgagcccaccacatattcacagtaggattagatgtagacacacgagcttactttacatcagccactataattatcgcaattcctaccggtgtcaaagtatttagctgacttgcaaccctacacggaggtaatattaaatgatctccagctatactatgagccttaggctttattttcttatttacaggttgggtggtctaaccggaantgttttatccaactcatcccttgacatcgtgcttcacggatacatactatgtagtagcccattctccactatgttctatcaatgggagcagtgtttgctatcatagcaggatttgttcactgattcccattattttcaggcttcaccctagatgacacatgagcaaaagcccacttcgccatcatattcgtaggagtaaacataacattcttccctcaacatttcctgggcctttcaggaataccacgacgctactcagactacccagatgcttacaccacatgaaacactgtctcttctataggatcatttatttcactaacagctgttctcatcatgatctttataatttgagaggcctttgcttcaaaacgagaagtaatatcagtatcgtatgcttcaacaaatttagaatgacttcatggctgccctccaccatatcacacattcgaggaaccaacctatgtaaaagtaaaataagaaaggaaggaatcgaaccccctaaaattggtttcaagccaatctcatatccnatatgtcttctccataacaaaaaaaaaagggggggggtaaaattcctcgaggggcaagttacggtaccgttttggaaaggtcctaggggggataaaaaggggggtaaagggag

SEQ ID NO: 679586 - DNA, 213 bp, Homo sapiens
caacatgatactacaggaaccccttcacctccaaaaggcagtggaggctgaccaaatcactcatgttgtagacgaggtcagggtccacagcttacggaagagggtgggaggagtaggaaaatgtccatcttggtatactggtttgtcacctataattcattttcccacagagaattcttacattatttatttatttatttatttatttttgag

SEQ ID NO: 679587 - DNA, 455 bp, Homo sapiens
  misc_feature (199)..(199): n is a, c, g, or t
aaggtccacacaaggagagaaaacaagagtgtagatacgggtgtgagagtgggccaggcgtgtgttgaaaggcatgcagcaagtcaggcttctagacatgtctgccggagagcttcaggtcttctcatcatgagaaatggcaagcccatgtggttacaggcagccacgtacaccacaccatctttgcggaaggttccanggaagagacagacaactgaatgacctcaagccattccttgggcagagccccaggccgaggagagctgggcgagtccatgatgtctgatcagattggggctggggttcaggtcttaaacatcaggaagcccccaaatgcagtgcccgacaggcttctctttgttattgatccctgggttaactcaaaccatactcgctcacccttctgcagctcagccatggcaaagaccgttgctgtgcttccactcccctgccca

SEQ ID NO: 679588 - DNA, 151 bp, Homo sapiens
attcccttatgcatttcttgcagggaagtctaaattgtaataaactccctcaagcttgctggttttatctaagaatgtgcttgattcgtcccgtatttttcgatggggtaattttggccagatacatgaatttttgggaaaagaatttttc

SEQ ID NO: 679589 - DNA, 324 bp, Homo sapiens
gatcagtgaagacatttaagtatttccttaacaagaagtcttgccagaaacagtatgaacatctgagtggggccaggtgcggtggctcacacctgtaatcccagcactttgggaggccgaggtgggcagatcacctgaggtcaggagtttgaaaccagcctggccaacatggtgaaaccccatctgtactaaaaatacagaaattagccaggcatgttggcaggtgcctgtaatcccagctactcagagggctgaggcaggagaatcgcttgaacctggtaggtagaggctgtagtgagccaagatcgagccatggcactccgg

SEQ ID NO: 679590 - DNA, 637 bp, Homo sapiens
ggtcactcggcgccgggccccggttccggcgctgccgggtctcggttcgggttcgttgccccggtgccgggaccgggccggtctctccggccgccccagccgggcgcagcagccggaggtgtcgggaccctctggacccaccctagcgggccccgccggcggtcggcctccggtccgggctcccagtcgcgccgtcctcgccgccccatggagtcccagtgcgactactcgatgtacttcccggccgtgccgctgccgccgcgcgcggagctggcaggggatccgggccggtaccgggcgctgccccggcgcaaccatctgtacttgggggagactgtccgttttctgctggtgttgcgctgccggggcggtgcggggtccggcaccgggggcggcccgggcttgggctccagaggagcctgggcagaactggcaaccgccctggccgccctggcctcggtcagcgccggaggcgggatgccggggggcggcggcgccggcgaccaggattcggagcccccaggggaggggatcctgggggtgggggtttgttccgaggctgcagcccccttctcagccacggcccgggccctgctacctcaaggggagcgaccacggtgaggagctttgggggact

SEQ ID NO: 679591 - DNA, 951 bp, Homo sapiens
tctgattataataaaaggactaaagcagaaagaaattatcttcctctcttgctcccggccatatgttttttcatataaaataatgggtatcaattttgcgtcgccgaattagttgtttttcgcacacccccctaaaagtttttgcccctccctgccgcgcctttaaacaggcctttacccaaacgtggttcttatatctccctaacatttatgagtgttaatttgaaaaaagaggaaacctttataaataaccccttcttcccttagccttatgtgcctgattaattcccctctaccaaaagaccgttacactttttttccagaagggaccaccccgccctaaaacaaggaggttaaacccccagctttttttaataaaaggagcccgttttgttccctcccctcttgagaatctccccaacctttttaagaaactttaaggcgttgtaaccaaaggtctccccagaaccacggtgcttccccgccccgccagtgattcttttcgccacaatcttttataaatccacctcttttaaaaatataaaaaagttgtggacactttgaatattaaaaagaaacaccactcgcgagaatattttcttcgcaacacacggcgaagttgggacacaaaaaaatgtataaaaaatattgtagttgtgtttttaccgccgagtattacaacagtagtatagtaataatgattataatctcatcttctcccgcctcgcgtcccatttatcacgctattatgtattagatgtttaatttattaaagaaagttaatataaattctcttttggcgacccccaattatggtaaacctatggatatttttttttaacctatattatatggtagtttgtgctccccatgatataagtgagtttattttttaaatgggttgaacccaaaaaaaaattgtggaccccttttaaaaaagggaaaaaaaaa

SEQ ID NO: 679592 - DNA, 155 bp, Homo sapiens
tctcatgatctatagatcttcatgatcctcatgatactcatgatcctcatgatcctcatgatcctcatgatcctcatgattctcatgatcctcatgatcctcatgaatcctcatgatcctcatgatacctcatgattcctcatgatcctcatgga

SEQ ID NO: 679593 - DNA, 829 bp, Homo sapiens
aacccaagaaacaatttgggttagccatctaatatagcaaataaaatagattttttaaagaaatccaaaattgtcttaaaggaatggaccccttgaagaaaaaaaaaaaaaggtttggtccctcagttagaattggctcactagctcactagcaagaattttatattttctggaaagcaattatatatatttgggaaagtccacggtactgggaatggaaagtccaaatttaggcaacttcggagcctagaactttaatttacttttccctaaattgtcccaacacttacatacaaattttcttggaaggacataacctgggacttggcagacactggcttttgaacaaaaaccagcctagtgaatggactgagtacagcccttaaaggctgcccagttcattctattagatgactaaggaaaactagaaaaagaatacgttcaccctttgtcaggtcaatgtgaacagacagacagtcattactgtacgaggtactgaaggtgacgctgtttcagcatcttagttggaccatgaaatgtctatagaattatgtgtagtcgtccccgacgattcatttctccattacttattaccgcctattacatgtcgggtaatattatagttgtcttggcattcttactttttgacccggagagactattttggattattacagctaaaaggcttcaccagaatagcgggggcttggattcaaaagttcggcaggtttaagaaaacctgctcaggggatcacgctgtgcccacgtctggggtggtcccaatcccttaccaggggatttaatcctcataagccggtgtttgggaata

SEQ ID NO: 679594 - DNA, 750 bp, Homo sapiens
agcgctccaactggctcctcgctccgggctccgccgtcgagccgggagagatgcctccgccagcggccagtgcaccatgccatgacgacgccacgcgaccccgtgcctctcgtgctggcaccgcgctaactcagtgggctgcatagtgcacccatgatgcctgaactccaaagatgtgtgatgtgcaatgctcatgcaatgaatgaatgaatgtgtgctacaatgtgaacgactgagaaagccaaggagaaagacaagaaggccgagtggcgctggcgacgtgaagaggaggggaccccgaatgtgagagtgagccccatgtgctggcctgcatgatgccctgcctgatggccaatggatgtggcaatgtgagaatgccctgaccatgtgactgcctgatgtggcaatggcctgaggatgaacgtgacgtggctgagaaggacgctgtgctgtgctagccaatgtgatgtgatgtgccccctgaatgtgccggagccctgagaagactgtgagggctgcgtgcagaggccaaggctgaagcccccgaaggcgcccgagcaggagcaggtgcggcccccgggccccgctttgcggtggctggtgaatggcccccaaaagctgcttgaggtccgacgtcggtcccctgtgtccgagtagcgtcgggcccatacctgccgggtgtagggagcccaagcaatgactgacggtgaacccaataaagacttgggcgccctgaggcttcttgcggct

SEQ ID NO: 679595 - DNA, 499 bp, Homo sapiens
  misc_feature (486)..(486): n is a, c, g, or t
tcttgtttcctgcacttcttgttgttgttgttttgtttattttgagacagtcttgctctgtggcccaggctggaatgcagtggtataatccggctcactgcagccttaacctccaatgatcaagcaatcctcccacctcagcctcccaagtagctgggtctacaggcatgcaccgccatcatgcctggctgcctggtttgttttgagggtttttgtttgtttgtttgtttctgtttttagagacagggtctcaccatgttgcccaggctggcctcaaactcctgggctgatgttatcctcctgccttagcctcccaaattaatctgttctatatttccattattttgtcatttcaagaatgttatgcaaatagaatcatacagtcagtaaccatttgggattggcttttttcacttagaataattctctggacattcaccgagggtgctgcatgtatctataagtcattccttttcattgctgagntgtattccatgga

SEQ ID NO: 679596 - DNA, 427 bp, Homo sapiens
cggttggggctcattcaggccaaagcaaggagcggggggagggcggcatctagttgggctctatcatgagggggggggccgtggctgctgatggacgcatcgagccaggagatatgtggggtcttcattatttttccctttcgggacctctcatctttccttcctctttctccattcgtgttgcctccaccgtagggggggaggtgatcatttattggtagagtggcagcacactagcctctgacttcagtccttggcacaccacaggcaggctaatcttcctgcaggatgggtctcatcaccctttgccggctacagaactctgctgggtgtccttgtcctgtcagggctgatctcgggacgggtacctaaaactctagaatcggacagggtgaccctgctcatcgagcctcacttcccttgcaac

SEQ ID NO: 679597 - DNA, 656 bp, Homo sapiens
cggtcccggggtcctaggcggcggtgcagtccgtcgtagacagaattagagtagaagttgtcggggtccgctcttaggacgcagccgcctcatgggggtccaggggctctggaagctgctggagtgctccggtgctggcaggtcagccccgaagcgctggaagggaacgatcctggctgttgatattagcatttggttaaaccaagcacttaaaggagtccgggatctgccatgggaactcaatagaaaatcctcatcttctcactatgtttcatcggctctgcaaactctctattaaaagcgaattcgtcctattaaagtgtgcgatggggcatgctccactattgaagacaacagacttcggtgaagagaaggcagcagacacggaccttagcgtccagtgactccaggaaaacgagaagagaagcattctgaaaacatttaagacaaagacaagccatcaaacagtgccttcagaaagccaaaggagatgaagcactaaccaagtcttacccaagttcgaacgagaaacacgaacctctaaagtaaggccatccttaacaagaaggaaagaacacaccacaggtcagaagaggaagatgaaaaaagaatgggcacgacagaactgaatcaaaaacaaggcattacagggagga

SEQ ID NO: 679598 - DNA, 151 bp, Homo sapiens
cgacatctagaggaaaaccgaccatgacccaagcatgcatcccccccccctgctcgaagtgtataaaccactgcggggcatgccttcctggacaagttccgccgacacgtgagcaccgagctgacctccaaatatcgttaagctgcagcct

SEQ ID NO: 679599 - DNA, 200 bp, Homo sapiens
  misc_feature (169)..(169): n is a, c, g, or t
tacaccttgcaaatatcaagtgaaaattttaggccagtctacagtcatctgtgttcttctttccaaataggttacaaataaaacctattctttgaacatatctttcactgtttcatatctcattgtgagcaaaaaccacagttgcttaggatctctttgttttttatgnttacaacttcctcaggtataccagtttactg

SEQ ID NO: 679600 - DNA, 134 bp, Homo sapiens
ccccccctttcccccttttttgtcccccaacttgaaatgaatgaaggcttttggtttccctgggagtgggtggagccacccagggcttacctgtacattgacttgagaccagttgaataaaagtgcacccctta

SEQ ID NO: 679601 - DNA, 213 bp, Homo sapiens
gcacgagggaggctgaggcaggagaatcacttgaacctgggaggcagaggttgcagtagctgagatcgtgccacagcactccagcctgggcgacagagtagactcagtctcaaaaaaaaaccttgaaatgtaggagggtctattttatccctataacttaatccaggtaatattgggggcattggatacctctttgttttttcacagattcct

SEQ ID NO: 679602 - DNA, 483 bp, Homo sapiens
  misc_feature (23)..(23): n is a, c, g, or t
  misc_feature (282)..(282): n is a, c, g, or t
  misc_feature (437)..(437): n is a, c, g, or t
  misc_feature (471)..(471): n is a, c, g, or t
aaagagcaagcacccctgtcccnaaagcccccttcatcacctgggttaattccccgtgggtacctgtgtgtaccagtggggatgcctgtggggtttgggttccccagacccactgcagtaaagtgaatcctagcaagaaagtgagtcaccacacacattttggtttcccctagtatgtgtaaaaagttattagactaggccgtgtgcaagtggctcatgcctgtaatccccagcagtttgggaggccaaggcaggaggatcgcttgagccaaggagttcaanactagtctgggcaacataggaagaccccccccatctcaaaaaaaaaaataaagccaaaagtggtggcatgcacctggggtcccagctactcgggaggcagaggtgggaggatcacttgaacccatgaggtcgaggctgcagtttgccatgaattngccactgcactccagcctgggtgaaggaagtganactctgtctcaa

SEQ ID NO: 679603 - DNA, 113 bp, Homo sapiens
ggatcccggcgcagcgtgctcatatgcatcaaaaaaaaaaaatcaaaacagctccacgctcccaatgttcaattaaaatttcctgtgaaagggagcaaccttattcgtgacgg

SEQ ID NO: 679604 - DNA, 325 bp, Homo sapiens
tacagtcatggtgggtcagtgcggtatcaggaataatgtgggaggccggattgaagtccgggccaggaacaatggtaattgtgggacttaaagagtgagtacagctgaaggagccggggagcagaaagtatatgtgtcaggtatgaggaagaaaatagatttgggaagttatgagaaatgtagagagtgagttgagcatagttggtgatttttagggcctctaacggtattaaagcagcggcagccgctgcatgcagacatgagggctaggctaaaacagtaaggtcaagttgtttggacagaaaggctacagggtgtggtcctg

SEQ ID NO: 679605 - DNA, 414 bp, Homo sapiens
aaaccaccccagattggctgcttgttgcgcctggagccaaacctgcaagctcagatgtatagactcaccttgcgtaccagcaaagacaccgtctctcagagactatgtgaattgctgtcggaacagttctagtccgcagaccagaagatcaggctctttgtttgtgcgtctctcttgtctctctcgtttgtctttgtaccacactgcagataaacaccccttgtctgaaaactgccattcacggcacctccaggcctatgcccacagccagcccctgggtgtggagggaatgcaggactcagtttgagaagggctgcagcaggcctgccccgtcaaagaagggtgcctgagcctgggaaatcagggcagtcctgtggttcaacctacaaattaaagggaaattagaagtttgaa

SEQ ID NO: 679606 - DNA, 380 bp, Homo sapiens
cagaagacatcatctgaaaggcctccagtatagcgctcgctaccacagctctgtacgtgcttgctgaggttgtgacccataagccaccaagggttttctccgcaggtatcagcttatggcgggtgctgaggcctcaggctgtattcagctccgagatgttctggatgcgcgctaggtgggaatccaggttttctttgcacctttccaggtcctgcaagtatgggtgagacatggcactgtaggcagatattcttttggctgggttaaatgtcaaacacttcagaagtaggtctttgcctagttcatcgatatctgttacaaacttctcaattggttgggcagattttgaatgaaaagcctgcctgggaagggcaacatct

SEQ ID NO: 679607 - DNA, 309 bp, Homo sapiens
  misc_feature (118)..(118): n is a, c, g, or t
cgacgatattctaacaaaagacatggaactatactatattcgggcatgactggagacagcacagtctagctcttattcgagcgagctgggcaacaagcaactttagtagacaatcacnagttatcggccacagccatgcattgtataatcttcttcatagtaataccatcataatcggaggcttggaactgaccagttcccctaataatcggtgccccgatatggcgtttccccgcataaacaacataagcttctgactcttacccccctctctcctactcctgctcgcatctgctatagtggaggccg

SEQ ID NO: 679608 - DNA, 371 bp, Homo sapiens
aaatcaaaggatcatttgaggctactatgagcaactatatgccaataaaaggaaaattcaagaagaaatggatcacttgctagatacatatgacctaccagattgaaccaggaagaaatccaaaacctgaacagaccagtaacaaataatgagaacaaagccataataaaatgtctcccagccaacaaaccaacaaaaaaaaggcttgggtcccaatgactttactgctgagttttaccagacatttaatgaagaactaataccaatcctactcaaactcttctgaaaaatagaggaataaagaatatttctgcaactcattctatgaggccattaattttctgatattgaaaccagacaaggatacagca

SEQ ID NO: 679609 - DNA, 136 bp, Homo sapiens
agtgtttctcctgataaacagcctgagtcccgacgacacggctgtttattattgcgcgagggggccttttacgactgatctctacgggcgctactttgacacttggggccagggaatcctggtcaccgtctcctca

SEQ ID NO: 679610 - DNA, 926 bp, Homo sapiens
  misc_feature (291)..(291): n is a, c, g, or t
taaacatcaataacgaatgatatgacatattaatattaaatacaataaacataaaaatgccgtctcttatcactatctaaataacccactatcgcaaattgttgaaatcggctctcattggccgctcttacaacttgcggcgcattttccccttcctttgtccccctctcgctgtaccctctctgtcgcccttggcccaatgttgtggtttccgcacctctgttctctggccaacacccaagcactctttcgggtatacccaactagagtgtgctaaatcctctaggttgnccattctgaccaccgaaaatgcttataaacagagcttctcaaaaacccagtgggaacccctatatatttcgacaacccccttatagtttcaacagtttaccccccctctctactaaaattctgcaaccaactgcatccaaagtagacctctttctaccccattctccctagacgccccaacacattgtggaagcagggctattctctctcaaaaaacaaatgggttatgcctagcccctacgctatcaattcacggtcttcttatctcattatgagacaacacaacccctcttggcccgaggatccggtacacctaccccggcatacccgacttaacctcttcggaaaagtcctaagaggtagggattactagaaaggactcaacgcgcgggcgatacagaggcaagacaacccactgtgccccaccgggaaaacacctaatgacactatgagtgcgggtgggaagacacaacattagcccctatctactccctcacagagggcatgaaagtaggggggagaaaatatcccggaacccaggggagaggtaggccgcgccacctgggagtcacggcacgattgaataccttgatccgcttttcaggacaaaggtcgaaacccttttccacaaaaca

SEQ ID NO: 679611 - DNA, 108 bp, Homo sapiens
gtgatatatatccttcacacggtgttgatataatccctcacacgggtgtggatataatccgtcacacggttgtgatataatccctcacactggttgtgatataatccc

SEQ ID NO: 679612 - DNA, 459 bp, Homo sapiens
atagggtactgcattgtagtctccatatctgtattacttttctgtaatatttaagagttgcttaaaagcatacaaaatgtactgttactaaaacagctaattatttctctctccccctttgacaggaaggggcttcagttgttcctccatgctacaaaccataattaacaatgtaaccgtacttagtaacataaagtattgcgatatgttagtaacaatcttgcagccttcctttccaaagttcattttattttgatcagctcagtatagtgcagtaattatattaggtatcttcactatatgataggtaccatgtgtcacagatgatttaatctatttaagtgttgggctgctaggagcacttgtacatttatgataatgcagaattaggagagcggttccccagaggttagttttataatcaggtgctcaggttggaataaagtggtattgagaaca

SEQ ID NO: 679613 - DNA, 399 bp, Homo sapiens
tcaccttaagggaggatttaattggcccccaactgattgtcacttaaatgaaaattaaaaaatgaataaaaagacttacttctcagctgcaaatatttatggagaatgggggccaccccacaggatatgaaagagagaaagcagctccctaaacttcaaaccctatttgggtccctagacacacaagagctattttagagtatttaatttcattaaatgtaatattagttattgctgcaaatagctaaatttattattacattggatttgatggtcaagagtatttcccatttttttaacagactgtccagtgtttgtcaagctttctggcataattatgtactcaaaaggtatcccgctaacaattggtataaacacaaaatgcttttcccatacagc

SEQ ID NO: 679614 - DNA, 149 bp, Homo sapiens
taaattcgcggccgcgtcgacgtcccaatgtgtccctatgggtcccaatgtgtccccccatgtgtcccaatgtgtccctatgtgtcccaatgtgtccctatgtgttcctatgtgtccctatgcttccctgtgtccccgtcgggtcgacg

SEQ ID NO: 679615 - DNA, 137 bp, Homo sapiens
tgagctggtccagttatagagttctgatgttcccgatggaggcttccgctcctttcgccgggctggtcactggaacacgaagtgctcttctacctgctcgccgcattggtcgtgcctttctttggaacagccggcct

SEQ ID NO: 679616 - DNA, 125 bp, Homo sapiens
cccatttagaataaaatgatacagccgaagtggccaagatgtttccataacttattctccttgctgactaaatcgcaaccctgaagtctgtgcctccgtagggcaaggacaggacgacaggtaca

SEQ ID NO: 679617 - DNA, 304 bp, Homo sapiens
gcgtcgaccttgcaatataaggtttacagccaggatacaaaacattacagtcctcaccgttatcatctttgaaccctttgagaacattctttatgtgtccattatttttaacagatatggaaccactgttcttattcatggcttcctctttatttcactgataatggatacctcatttctgtatgttctcattcaacaatagtcaaatacttatggccttaggaaactatagtgctgctgagacaaaagtggtccaccctagatgctcatcacttctgctttcaaatcattgacccgtcgacgc

SEQ ID NO: 679618 - DNA, 711 bp, Homo sapiens
gcaaggactaaccgctataacttctgcataagtgaatcgactagaaataacttggcaaggagagccaaagctaagagcccgcgaaaaccagacgagctacctaagaacagctaaaagagcacagccggctatgtagcaacaatagtgggaagatttcatagtgtagaggcgacaaaggctaccgagtcctggtgatagctggttgtccaagatagaatctgagtgtcaacttttgaattggcccacagcaacccctctaaatcgcccttggtgaaattgaactgtagagtccaaaggaggaacaggctgctttggagcactgaggcaaaaaaatgcttggtaccagcagcagtatcaatacatgtagagcatccataggtagggcctcagaatagcgatggcgaccgaattacagaaagcgtacaagctcagcagccactacctaaaaaagtcgctgaacatatatacttgaactctctcacacccaaatatggaccggatgctatcagcctatagaagaagcaaatgtatagtataagtaagatgaaaacatgctcctccgcataagcctgggtcagatgaaaagcacgtgaactgacaatttaccagccccaaagtatctacaatcaatcaatcaagtcattatgaccctcactgtcaacccaacacaggcaatgctcataagggccggtgcggacaccgaacgaccga

SEQ ID NO: 679619 - DNA, 216 bp, Homo sapiens
ctgtctgctgatctagaggatccctcctacgagcgctaacagagtgagactcggtctcacaaaaaaaaaaaaaaaaaaaacaaaaatttctcaaacatctttccccgggattattttctattttttcaagatttctctgtggggaaaaaaatggggttcccgtgggttttcccaacccaatgggcccctggcacccccttttccccggggcccctt

SEQ ID NO: 679620 - DNA, 298 bp, Homo sapiens
tctagaggatctcattggagaatgtgccatcgcaagaagaagatgtagttcacttgtgtgactgtaaacttgattagagaaaaaaaacaaaaaactgtttattgtggcacagagacatacttatcattacactgtgaacatgactcagacgcatacagggaagaatagcagcgactctagatgttcttaacagttgatactatttctaacacaatcattacacttttgccacatactcagcaaaatttccagcaagtgtacaacaagcaggccctatgttattagcacattgcttcca

SEQ ID NO: 679621 - DNA, 313 bp, Homo sapiens
  misc_feature (59)..(59): n is a, c, g, or t
  misc_feature (76)..(76): n is a, c, g, or t
  misc_feature (116)..(116): n is a, c, g, or t
  misc_feature (285)..(285): n is a, c, g, or t
cgcgccggacgggcggccaggcttgcgcgcggttcccctcccggtggcggattcctggnaagatgaagtgggtgtnggcgctcttgctgttggcggcctgggcagcggcgcggaanactgccgaggtgagcagcttccgagtcaaggagaacttcgacaaggctcgcttctctgggacctggtacgccatggccaagaaggaccccgaggcctctttctgcaggacaacatcgtcgcggagttctccgtggacgagaccggccagatgagcgccacagccaaggncgagtccgtcttttgaataacttgggac

SEQ ID NO: 679622 - DNA, 220 bp, Homo sapiens
cctcagcttcccggggcgctgggattgcaggtgtgagccactgcgcctggccctgctttcttatttttaactttatatttttcaaaagctggcatgcagggccgggtgcacttgtcacgcctgtgaccccagtgctttgggagaccagggcaggtggatcacttgaggccgggagttcaagaccagcctggcagcatggcgaaaccccatctctatttaa

SEQ ID NO: 679623 - DNA, 687 bp, Homo sapiens
ggagagaactagtctcgagtttttattttttttccccttgggttccacctttgcctctacccgcccggttgggttaaacaaagccaagggaaaaaaaggaaaaaaaaaagaaaacaaaaccagccgttctaagcccggtgatggctcccagtgtcaaaattttcagcaaagggtgtgaaaagatcttcgtgcgtgaccctcttccatcttctgtgcgtgaggcagtgtgcctccctgttaatccggtgggcacagcccaccttctcctgtggtgctccccgcgcgtgtgcacaaagtctctctctatatcacagccggggagacgcccactgtgttccctcaggcgctccagttcctcctgggggggccccaggttccgggaccaataagcaacagattatatggagtgctcgggtgtgggaaatggagggcccagaacttcgtgtcttcggccattgaatttgggtgacttgcccagggaacctcctcaggatgggggtgtggcccatactccaggaatataccacgtgcaagagtttatggggccctcgaataagtcaacgagggtggagtgggtttgtggcacacgttaggacatttcccctaagggtctgacacgaaggtgtctccagagatagggctgtgaacctccggaagtccttttcattggggggaacacaaaaccaa

SEQ ID NO: 679624 - DNA, 358 bp, Homo sapiens
ccggaaatgtagatactgtgtgtgtgtagagagcttctcagactatccaccttattgggtcgctttgcagttcgtgatatgagacagacagttgcggtgggtgtctatccaagcagtggacaagaaggctgcaggagctggcatggtcaccaagtctgtccagaaagctcagaaggctaacataatattatccctgattacctgccagcccactcttaatcagtggtgaaatgaacggtctcagtaactgtgagtttcatattggccatctacgtttaacgtagtaaaagactggttaatgacttacaatgcatcgtaaaaccttcagaaggagaggagaatgtcttgtggaccactt

SEQ ID NO: 679625 - DNA, 209 bp, Homo sapiens
tagacaagccaggagaaaagcagtgtggaagatgtcagtgttaacccaacgggatggagggcaccgtccctagggctggactgctctgtctagagcatctggagatcatttacctatcctcgaggcatctttcaatagacctcttttatacttgcacttcatattgaactgcagttacatgctaccattgacaaataaacaccatattt

SEQ ID NO: 679626 - DNA, 593 bp, Homo sapiens
tgtaacaaatggggtcttgctatgttgcctgggcgggtattgaactccgggcctcaagcaaatcaatcctctgtgcatcagcttcccagagggctgggataacaggccgggccacccacacccaaacagaggttcaaagacgcttgggagaaaccagcctcgtcctccagtctcttggtggtggtttggagactgagtctggctctgttgcccaggctggagtgcagtggcatgatctcgggtcactgcaacctctgcctctcgggttcaaacaattctggtgcctcagcctcctgagtagctgggattcacgggtgcttgccaccttgcctggctaattcggtggttttagtacacgatggggtcttcatcactttgggccaggctggtctcaaactcctgacctcaagtgatccaccttgcctacggctcccaaaatgctaggattcacaggcgtgagccattgcacctggcctgtcctacagtcttatttcacaacaggttgtgccaagctaggagcttaatcttgtaaaatacttgaggcagggataggttcgtccgtcaaggcttgggcttcatggcgagcagaagtc

SEQ ID NO: 679627 - DNA, 833 bp, Homo sapiens
atcaaaagggacaagcatcaagcacgcagcaatgcagcttaaaaaaaaaaaaaaaaaaaaaaaaaaaaaaatttgtgggcggcccgggcccctcgaaaagcgttttcaaaaccacccggtggggcgccgggggcccaggaagggaaagggagaaacggggccaaagccggggcccaagggaaacccggggccaaggacaaggggggggagtttctcacaaatataaaaaagcgccgcgcggggccacagcggagggttcttgtgaacaaatactccgaagaggggagttccggagggacccatataggggaatatctatataaaacagagggagtctccagcagggaagaccgcgaattctcaaattataccgccccgggcctggggaggaataaaaaaaaaaagagagaaaaacgagaagaaagaaaacaaaagaaaacagaaacagaagaaaaaaacaaaacagaaaaacaaaaaacaaaggaacaaaagaaaccgaacaaaagaaaagaaagacaaaaaacaagacgcacaaaaaaagaggaaggagggagagaaacggagagggagaaaagagagaaaaaacaaagggaaggacagaagagagagagggaaaggaagaaagaagagaggagaagaaaagaagaagaaaagacaaggaggagaaaagaagagagaggacaagaagagacaagaaagaacaagaagcgagaaagaaaaaaaaagggaagaaagaaagaagaaagaaagaaaaaggaaaagagaagaaaaaagagaaaaagaaaaacgccacagaaaaaaagaaagaaggaagaaaaagaaaagaagaagag

SEQ ID NO: 679628 - DNA, 424 bp, Homo sapiens
gaccatctacctttcctgatgctcagttccctcatctgttaaacgggaacaacagagtcaacctgtatgtggcgtgttctgagacggtggttctcatgtgtggtagctggggcagcaccagaagcagtggcggcctcagaatcacctgggaacttgtcagcacacatgcaaattctcgggcttccacctcagcactcctgcaatccaggacatctgggcaatgcataggcaaactcattttccatgcagccctgtaggtgcattctgcatgcttgttcccagtttgcgcagtcactgactcatggattaaggtgcagtgcagtgcacatgtgacagcaaccaagtgctcactgctcttggtttccttcattacaacaagcagggcagggcagttgcactggggtcactctcagcattgctctct

SEQ ID NO: 679629 - DNA, 617 bp, Homo sapiens
cgtgcagctttgtgtgttgcctgtgccgtaggctggcgcagccggtacagccggtgcggcggcagaacgtttgcccaacagattcgccagtgccttcatcgaacatctccgatgccagagcatgtgctgcagggacacgagacgccaacaggaatgagggcattttggcgctcattccttgctggtcacgcgcaggatgccggagaggaaggcagcactccatgcgacagaggatggattgggctgtggctgagcggggaacgcggattggatgcgctgatccaaatcatatcgacgcaccaacttgcagaacgggcactccgcattgctcaatgggagatcaccgatcacgctgatgtgatggctgccgcatactgggcaactggccagcgccaactgtggctgctcgatcacccagataccttcaatgtggccggccagatcaaaggcgcggtcgaagttgagccggtaatttgcgccgcatatcgagatatagcgacggtagccaccgatcagtgagtgcgctggctcgaactgcaggaaacggtggcggcgatagcttgccgcaaacaggacgcatcgatccggtccaaaagattgctctgtagtccactcgg

SEQ ID NO: 679630 - DNA, 1187 bp, Homo sapiens
  misc_feature (38)..(38): n is a, c, g, or t
  misc_feature (1184)..(1184): n is a, c, g, or t
agtccggcagacgtcatgatcggttgccgatttcctgnccactgacccctgatcgcacgagacttcgaccagtgatcccagtctacgtgtgcggtgatacaggacaagaacacgaagcgcgatcatggagacacgtgtgcataatggagcttgccccaattgtgtcaaggtgagagcgcgcagacccgcgtgttcgacatccgacgactctatacgagcgctacagttatgaccacgttcctctagaatgccgctctgttgctgtgttcgctattgactcaatgcataggttacccttgatgcgatcctgcgaaggaactgggtcaatgcgtttcgaacgctggcagttgtagatgagctcgtcaggagcaaaggcagtcgctcaaggcgaggaccccgtgggatggcgacttacagactctgagttcaggtttcactgttcactggcggttgcacttgatggacataggttcatgacgcttactgtggatccgaaacgcaaatactgctgcaaaacgttcacgttggttcacctggaacaccaaagtactggggacttatggcacaagctgtgcagcaacctgatggactggggcgcctctagaggtaatacaacgcgaagggttggccagtgcgtaaaacggggcctacacaaaggtagcagatgtgctggaattccattacacacaacggggcacaacatgctggactttacctaacttcgatccctcgtgggcttccctttcctgggattccccgtgcattaccgggacccaaccccagagatcaaccgaggcaacgccgtcctctcgggcaaggtggtgaccggattggggcccagagaagcccacaaacgataccagggagacgcggttgaaactcccgcaacaaaaagcaagcggaaagcggaaccgagaacaacggtgttgcaacgcggggcgcgcctgtgaacgcgacggacagacgaaaagtagcgtcccaagaaagggccaccactgtgctcaccaacaacgcacgctgttcctctcacacaaaccaaggagagaagcggggaggcaaagacagaacctctcgctacacaatgaaggacaacgcaaaacgtctaagtgagaccgatgaacaacatgatcggtggtgatgtcgattgatatggatgctggagagtgaggatcggggggagagantgt

SEQ ID NO: 679631 - DNA, 247 bp, Homo sapiens
cgcaagtgatgatgagataatccatattctgtgcttcataccaaaggaacagatgtcccacattttcacacagtttatggcagtttcagacgttatgaaccgtcataaagataaatgggtactgtcaaaccaagaggatcatcgttcactgtagattgcctttttaaccttctgccgcctttctgggctctttactacctgtttttttttgtttgggtcctctctctttttgtcttgttttcccttg

SEQ ID NO: 679632 - DNA, 384 bp, Homo sapiens
aggccgatcttaaaatggccgattttgcccgttgaaggcatcctgggaaaaaaaacaagcatcccagcgggcatctccccccgacttttcctggagtccccccccggtccctgacaactccagtcagttttaggaactaaagggccggatcatcagacttaccctgtcctgcccccccttccctgctaacatcaaggggtgggcagttaccttttgagcttggaacaaacagactggaattttcctctgccccctcttggggataaaatcttgtttataaaatttcaaaaggaagtaaatcccctagggaaaacccttaattttaaatttggttcatgtggggcaaagtttttagcttttaaaaggataaaataaatttttcca

SEQ ID NO: 679633 - DNA, 822 bp, Homo sapiens
  misc_feature (113)..(113): n is a, c, g, or t
ccttcgtcctctcggccgcccgcgtgatttttttcaggtttccctccccgctctccgctcagccttgtcacagtaactatttgcgtcgaagtgtcccctcctccttccacggngtttctcttaaccacacgtcgttcattgaccaacgtcttccctgcccctcataataatgtagttgtcaatacacaaatcaggttcctttatatagacagagagaatgtaacgcaggcgccctttcttttacagaatacaataaaacggtcgcacctttttaatctccgggtaacacacatttccacctctttcctcgcaccacataattcgcccccctgtttttaccgcctggtccccccctataataatgcgcgtgtcgcactaagcttctgcaccagaatacctagaagggcgagaagatcgctcacagcttgaagtatatacatgtcctccttcgaggagaatttcctatacaacgcctcgactaccaccattgtatgatagacccccagatatagtgcgcgagacaatctgcgtgttcgtgaacaccacaaagagactgttgtcacccctatttgtaccgcctcgtattgctactaccagtcatgtcctcccacggagttcccacaagaaaataatatcttcctttcacgacgtcgtatgcaaccctatttttctcggcgaatcacccaaattctttcacccccgtctactaccgcccccgccaacaccctatttattaacgagtttataaatagctctctcaacaagatgcttttcccttccaacatcccttcggtaccgtaaatacaaaccccacacaaaaca

SEQ ID NO: 679634 - DNA, 901 bp, Homo sapiens
cacttcctcccattctgctgggcaagctaggcagcgacccccagaagaaaaccgtgtgcatttacgggcacctggacgtgcagcctgcggccctggaggacgggtgggacagcgagcccttcaccttggtggagcgggaaggcaagctgtatgggagaggctccacggacgataaggggccagtggccgggtggatgaatgccctggaagcctatcagaagactggtcaggagatcccagtcaacctgcggttctgcctggaaggcatggaggagtctggctccgaaggcctggatgagctcattttgcccagaaagacaagttcttcaaagatgtggactatgtgtgcatttcagacaattactggctggggaagaataagccgtgtatcacgtacggcctcagaggcatctgttacttcttcatcgaggtggaatgcagtgacaaagacctccattctggggtatatggaggctcagtgcacgaggccatgacggatctcatttcactgatgggctgcctggtagacaagaaggggaagatcctcatcccgggcatcaaccgatgccgtgcgcctgtgacggatgaggagcatgcgctctacgaccacatgacttcgatatggaagagttcgccaaggacgtggcgggctgagaacccttctgacagctgcaagaaaagacattcctgatgcacagattggggataccgtcctctacctgcatggagatccgaaggcgcttcttcggtcaggggcgcagactgtgatccccagaaaggggtcggcagttctcatcaggtcgtgccagacatgatacggagtggtacgaaacagtcagtactgcaacattgcgtagtgaggcccaaagtccgggttcggcccgggcagccgggttgctac

SEQ ID NO: 679635 - DNA, 1254 bp, Homo sapiens
tggaggtggagtcttgctctgtcccccaaacgggattgcaggggcccagtctcagcctcacttgcatctccttgcattctctcccaggtttcaagttgatttcctcctgtgccatcagccctcccaagtgagctgagacttacagggcacgcaccacacacactgtggcttaattttccatatttttggcgtagagatgaagattccactcctgtgtgttgacacccaggcgtggtctctctcgaaacctcgctgtgaacctctcaaagagtgaatttccacctgtgccttcgagccctacccaaaaggtgccgtgggacatttattgcaggcgtgtgaaggcccacccgtgtgccccaaaatctctcccctgtgtgtgtcccccccacttacctgtgggtgtcctatggcttctgtgggagcctcctttgtgggaccaaacaagttatcttacaaaacagacgtcttttaagttgacaaacaagagctcttcgtcgacaaaccattcagtggcgcgccacgaaaaacacaccgcatcccccgttggagaagagtcaaattgtccacaggggccgcccctcacccacgctgaagcccaaccgtagcgcccccgacctcctcacatacaaagcatcctttcaacactcatagcagacacaaccaccacacgatattgcccaaaccaccaatatcacagccggcggctattaaaaacagtcgcagatacaacagcacaatcacacgacactcgccgctataccagcgcgcctactaagcggcggcgcccacacccacaccgccaacaaaacccgcccgccacacagcctgcccgcacaaccaacacaagcggcctacccagccgagcaagcatgcagacaaacgcccgccgccagagcacaccaccaccacccaccaacccccacaccgctgccctaccccgagcacgcgacgcggcccacccccaccacacgatccccccccgcccatcccaccacccgctcaccgaacgacacgcgccacgcaggcacaacaacaacgcacatctccagacgcgacaacaccacactaccgagtagcaacaccccccacgcggcgcacaagcgaagcggccatctcctcgcaccgaaaccgcgggccatcacacacaaccggcgcgcgcgagccaaagggcccccagccggtcccagccccaccaccccaccacccaccgccgggcgtcgacccaccttacgtgacccatcatagccaacaccg

SEQ ID NO: 679636 - DNA, 141 bp, Homo sapiens
tggtgtgtataattctgaatattgggggaggttatatgggttaaatagtttttttaatttatttagggggaattgattggttgtctttggatatactacagcgatggctattgaggagtacctgaggcatgggggtcaggg

SEQ ID NO: 679637 - DNA, 189 bp, Homo sapiens
ctagaggatccccctagggatccttataaaatactctattacttttcactttgcgcaatgtaatcttgcatgtatcgcccacggctgtgatctcaaaactcctgagctcaagcaatccttcagacctcaggctgtccctgaagacacctggcgagttataagacatcagccactcacaccgtagaccaa

SEQ ID NO: 679638 - DNA, 275 bp, Homo sapiens
gcttagcagccagttgaaagtacaaaattatttcatcccaagcaagtttctctccaagaaaaaaaattaggcaaaattcagtactctaattttagatattgctgaacaaaaattaaaacgtaacaaacataatttctaagactatgttgacttgactttaagcactcccactgataccagttcacgtaagtaaattacataatgactactttgtcactatattaaaagcctgttctctaaatgacccaattagaccatcccatatataatagaca

SEQ ID NO: 679639 - DNA, 205 bp, Homo sapiens
gcccactccaccttactagcagaacaaccttagcccaaaccatttacccaagtaaaggtttaggcgataccaagttgcaagcctggccgccagtagatgtaggtagccgccaagggaaaagatgcaaaatgttataacccatggcaataattatagccaaggacctgaacccctataaccgtctacataagtgacatgcactaga

SEQ ID NO: 679640 - DNA, 107 bp, Homo sapiens
catataattcagatcttactctcctgtagtgcagcgtttcctagcgtctgacacacacagcgtcagtgatgcgccacttcaggtatgagcctttggctgcaccctca

SEQ ID NO: 679641 - DNA, 953 bp, Homo sapiens
  misc_feature (589)..(589): n is a, c, g, or t
ctgcggatattgcttggtccatgcgcattcaggagaggctttagcgtgcttctgacagtctggtgttgctgtatcgtggccgctgtgggttccgtgtcgatcgtagcttgctcagagaacatctccgataagcattcgcactctcgggatgtaataccgagtattgagttcggaaagttccatgcagtttggtacacgagaaattgcggggagaagaacttgctcatggtcgatacgtttcctcgtgacagttcacagcaatgccattctaggcttgccgatgtttagttacatggaagtcttagacacgtgtctcgattagtcgaagttaccatcttgtgggatgagtacaaatggggaggctggcaagaataacgtaactgctgtaggttgactcctgaccttggggtacgaaagatgctcgagtgcagccacgatatgtcaatgcacgacgttagcgtagcgccacgacgcgtgggtcgcccacgtacggtggcctagccccgcctacctttgctgtcctcgtgtcacctttcttgcccctgtggacgagtactacccttggtatgaagacgccgtcatccatgtnctcctggtgacaagacattgcggttccaaaaattgctctttctaagacattactccgaagtagaatgatcctgaagttatagttttcattgcatgaggtgttttgagaggatgggtaaaaggggacattaaaggtatgttgagagctgaaagtgttagggggatagtatgtatggcatagttgtttacctttaatcgttatgtgacttcgaaatgactaagtaatttatgcaagaagaaaaaactttttttctttcaactgggattagtaggctttcttagaaataaaggctccatgtcttgtttggggcccattatcgaattgcgccagggaacatataggggtggggaagggaaggttggac

SEQ ID NO: 679642 - DNA, 292 bp, Homo sapiens
acagttagattatattgagcgtgctgagttgtgaaggagagctaaatcctcccacagaaagagactctttcatattctctgccatgacagcaacattgtgctgaacttgaatgcagcctcctgctggtgacctgggctttctaggagcaaagctagaaggtgtggacaccactcccaggcagctggggcaggaggatggcactggggaggaggatggcgctcgggaggaggatggagatggtgaggcggatggcaatggtgagacatggagatggggaggaggatggcaatg

SEQ ID NO: 679643 - DNA, 215 bp, Homo sapiens
ggcgacgcgaatcactagtgattacagagccacaagcagagatcctgcatgatggatgccaccacatatgccagctgtcaaaggcatcatatatcagtatatggaagagataaatcatagaatacccgcctcagacccaacttctagcaaaacaaggcagatcatctccaccatccggaggctgaaactatccaactatcagctgatatcccgaa

SEQ ID NO: 679644 - DNA, 342 bp, Homo sapiens
atcgccgggattacaggcatgagccactgcgcctggccagaaaacagaatcttaatacatagatagtgccacctggactctggactcccctcaacccatccaactctacactgcctctcatgggcacacattttgcctgctacaatgttcttcctaaaataagatgtgccttcagtcattcttgatttctctcaataaccttatttcagatctgtccacgaattgattgaaaatgcaactctctctatggatgctacctttggaaaataataaggggagtacttttattacctactatctaaaccttttatattaaatttatctttcagccaccgtgaaaaa

SEQ ID NO: 679645 - DNA, 326 bp, Homo sapiens
  misc_feature (156)..(156): n is a, c, g, or t
  misc_feature (233)..(233): n is a, c, g, or t
  misc_feature (236)..(236): n is a, c, g, or t
  misc_feature (253)..(253): n is a, c, g, or t
  misc_feature (305)..(305): n is a, c, g, or t
gtctttagggactggggtgggctcaggaagctgtattatttcaaaggacgcagtgtttccacagctcagcccagagctgctggagttcacacggcccaccagaacttgcttctttcaaaatcacccccccagagggggccaggagggggggggggncccaaaataattaaatatatatattcccctttttaaggggcaccgcccaccaccccccccaaactttttaaaatttngtnaaatcccccccgtgtgnaaacacctgtaattacatctttaaaacagcgcccaaccacccaacacaaacnctgggaaatctgtgcctttaa

SEQ ID NO: 679646 - DNA, 1280 bp, Homo sapiens
gatacgaggtagaccaggcagggaagtcgattagacaagcgataccgggtgggttaccgtggtggctctgtgcggggggcggggtcttcgttccgagggggccgaggacggtggccgagcggttctctagaggaggaaggggatcgatgcgctatgcgtgggtgaaccagtgattcgagatcctaggcagatggtgggctagcaggagggcatcctagagcattgactatagtcagcctggagtcacgagtgtgctggtgtacagtgaaccggtatgctcgtgcgcgtggtcctagcaagcagaccagttagtgagcagtgactgggttgatagggggcctcgaggcgaggtagctcgggaggcaacgcggtggccctgtagagtcatgccgattgatccttcctggcggatctacttgatcgccgagggaggggacttacatactggtgaacgagcgagcgtggagggcaagccggcattgcctcatggaggacttgtgcccgctgctaagatgctatgggggacagagtggccatgtgggcggcgtgagcccgtgttctccgtggcgggtgaccttagggccgtgtctaggtgagtccttgcttcatcccagtgagcgtatgtgagcccatggcggggcgcgcgttgcgggtgctgtgtgagggtgcagggtcatgtgcgctccgcgggagcgccggggtcccaccgctctgggagctctgctggcgtgtactctgtaccctttgtgtacttcttcctggaatggcgcttcggggcagttgaggtagcggggggtcgaggggaccttgagtgtatacgtgggagcaaagggctgctgggtgcgcctggccgcttaacgggggcggaccagaactaggccgaaaacggatggtgggagggctggtggacagattcggaatcgaggaacaggggccagtggggaccccgagataagagaacacaggggagccaaaaagaacgaaactaaaaaagaaagagcatggtcagatgtataaaaaaaaaaataaaaaagagaaaaaaggggggaggggtaagaaaacaatgagaagtaagggacggaacaatatggagatagcacagaatgttggagaaaaggcagagatggatgataagttttaaagtaaaaagagggggaagcaataaaggagtagataaaaaatatgggtgatgataagagccggtgttggatgaataccaggagaagaagggagaggaataaaaaggatatgaaggacgggcaggtaaaacgtatgaaaca

SEQ ID NO: 679647 - DNA, 1246 bp, Homo sapiens
  misc_feature (259)..(259): n is a, c, g, or t
ggttctgtgcccaggcgacaaattacattgttgtggtcttgctctccccacccttgtagtaatactccgtctcgtggcggttctgctttcgatcgtggaagtgacgagtttttcttatcacggcgcgtcctggcgacgggggttctttgcgccgccagttgtgttgtgttgccgccattttctcggcggggcgcttcttctgtgttggggggccggggatagtctatgttccgccggggtgcaattagggttttgtacncgccccattgttgttgtccgtttcgttgctttgtgcgggatacgccccctgcattgcgttgtttttcgtctttgcagtgtgtccctctctttttctatccacgggccgttatttaaagggcgctgttgtgtggtctatatgcccctcatcgagtaccgcgtggttatcagccacactctgaatggccgtctggttccgcttgtatagacgtgttctcacagccccctgtttgttaattgcccccacgtcatacaaggtttgataagaaatttcccctgggtgcctcccacatgtggtgtcgccaatcataccaacaccgtgcttttttcataagagagtgccggttccacactggatggttgtttgcgttctatacaaggaggaattatactcgtgttacacttgacataccgtgcgtagagatgcagtgtgtgcgcacatttgcgggtgtgggagacacgacactgctatcttttctaagagcacaccttttaaactttcgtgcattataacgatggttaacatgctctctaagccttttctagatggggaaacgaaccccattgtgttctccccctgggatttacaataggggggcgtggacattgtgcgagtagcggccttatttagggaccccacaactgggggcccagtttgtttctgggggcgccctcccctctgtcctcgacgacggggaggcgcctcggtgtgcttataacctgggcacggtgcgtgtctcctcctgagccccacgtggctgcggtgaggggaaccacccctctccctggctgcaccacgtggcccttagctcccgtcaccccgtgccaacccacgggtcccacagctgggctgggtccttttttgccccccaggcccttccccatggggtgtgttggagtgagcacctcctctgtaggcacctttcaccctgtttgtttggtactgattttttttgataaaaagataataaacccggtactttttata

SEQ ID NO: 679648 - DNA, 217 bp, Homo sapiens
aaaaaaaaaaaaaaaaattttcccgttccccccgggccgggggggggggggggggggggtattttttccctttccccccggggcccatgggttaaaaaaaagtattggggttgttttttttttttccctgtttcttttttttccctttttttctttgttttgggggggaatttgccccccccccccccccgcttttttttttgatttttaaaaccca

SEQ ID NO: 679649 - DNA, 109 bp, Homo sapiens
  misc_feature (58)..(58): n is a, c, g, or t
  misc_feature (103)..(103): n is a, c, g, or t
  misc_feature (105)..(105): n is a, c, g, or t
ggtagccctcatcaaactggacgtccaccacttctaaatgccctggaagtacaagganagggtagaccagactggtttggggaggtggcccagcatttgggtnanagaa

SEQ ID NO: 679650 - DNA, 225 bp, Homo sapiens
tgatggcgctgatgacacccactcccacggtacgcggctcggtcatgctcgcttcgataccgcctatcccccggttggtttgcatataggtaggggtgccgttcgtcgaacacgtttttcacgtaggtgtacacctgcacctggtcgctgaagcggtagctcatgcgcgcgtcggccacggtgtagccgtcgatggcatagcttttggtgtcatcagcgccatca

SEQ ID NO: 679651 - DNA, 353 bp, Homo sapiens
  misc_feature (75)..(75): n is a, c, g, or t
  misc_feature (288)..(288): n is a, c, g, or t
gaagatgatgaactaaatgttgaagacaagtttgagatctgtaaaatgtgattttttacttctgcttataatacncatgattggggaggattgtggaaatttaattatgatgaaaaacctctatcttttttgtaatgttggcatacttggggaatttagtggaaaatacattccccagcaggccttttgttggttgcactaactgcaaggttgctgggaagtagagtctgtttggtcgatgagctttgactgccattttggaaccttacctctcctccttagcccagnatgctatctcaggtcctattcttgttctccagctctcagtccaaataaagttatttctcctggtt

SEQ ID NO: 679652 - DNA, 204 bp, Homo sapiens
  misc_feature (12)..(12): n is a, c, g, or t
caagcagttaancagactcaccaagccacagacttgtcttccacaatgcacgttcttaccttagccacgaagtgcccaagccacacgttactaaagggttgaactcaaagatatgtaccggggtataaaacaacttcccagggggacacagttaacttcaatacaagggtcaacaatgagcaaccaagttctcacaactccagt

SEQ ID NO: 679653 - DNA, 116 bp, Homo sapiens
cggatctgtagattatgtgcattattattttttttatatttgcaaaggaaacatatctaatccttcctatagaaagaacagtattgctgtaatttcttttcttttcctcctcattt

SEQ ID NO: 679654 - DNA, 334 bp, Homo sapiens
  misc_feature (101)..(101): n is a, c, g, or t
  misc_feature (197)..(198): n is a, c, g, or t
  misc_feature (231)..(231): n is a, c, g, or t
aaaaaaaaaaaaagcccccccctattaagtgttttagacccaacccaagggggttgttccccccccaaaatacttttccttttccttagagaggcaaaaanaaaacctcgtctttttttgtagagtctggaccatttaaagccaatttgtattgcactggcccagatggcaaataagtgaaaatggtttaatacccnnatggatttttatttcctttttttgattcagctntataccccgggctgaaaaccctcaatttatgttcatgacagtggggatttttttaaatgtctacattctttctaataaactgttggaagacttaaaaaaaaaa

SEQ ID NO: 679655 - DNA, 1403 bp, Homo sapiens
  misc_feature (553)..(553): n is a, c, g, or t
tataaaaaaatctctctctcccccacaacccctctctctctctctcttttatctctctctctccccacaaaggggggcttcctcctctctctcacacacccctctctcctctcccacacaatatatccccgggtgggggggctgtggagaagaagtgttttctctttctgtcgtggggcgggtcttctcctcgggtcgtcctctctctctctcttctctctctctgtgtgtggagagagagagagagagagctcttcttctctctgtgtgtgagcgcgctctctgtgtgagagacctgtgtgtgcgcggcgcgcaccctctcttctctctcctctgtgtgcgtctctctcatcacacgcggcggacgactcgtgtgcgcgcgcgcacgcgcgtcgcgcgcgctctctcttactcgcgcggcgcggtgtggcgcgctgcttttctctctctctctctatttctctctctctctctctccccactgtgtgtgtcgtctctctctcacagagagagaacactcgcgcgagcagcgcgccgcgagagagagctctcntctttctcatctcgcgcgcgcgcagcacgcggcgctctcatagtagagagagagcgctatcaaaccaaaacaacaacacacgcggcgggggggggcgcgcgcgcacaacatctctctgtgtggttctctctatatatatctctctctcttctctctctatatatatatatatatgtgtgtgtctctctctgctgtgtgtgtgggcggggaagataaatcttctctctcccacgagaaatctctctcacaaacaaacaaaagagagcgggggggggggggcgcccctctcagagagagatctcctctcccgcgcgcgagaggggggcgcccccccaaatgtttctatgcgcgcggtggtctaccacccgcgagttcttttctgtggtctacaaccacaagacgagggggggccccccccaaaatgagtgggcgcagccccgcgcattatatataatacacccgcctcaagggcccagagcggtggggcgccccgccgccgttattttcaaccaccaacgcagcgccgcgacgcgctcacgctggggggggggacacaacacacccggtgtcggtcttccctgcgtggggacgagcacccacctcttgtcggggaggagagacaggagaggaccccccccccaccatcacccccgggcgggagggggggggggcgccgacacacacacacatgctgggcgggcgaccccaccaacctccctcccccgaccggcgagacacatacaaacgcgccgccgcctcccagcgggggcagaacacacacatcccaccatctggccgcggggcggcaccaacagcggtgggcaaacacccccacggggccataatcacg

SEQ ID NO: 679656 - DNA, 292 bp, Homo sapiens
  misc_feature (45)..(45): n is a, c, g, or t
  misc_feature (48)..(49): n is a, c, g, or t
gttcagcagatgatgcaagaaccagaggatgcagagaaccctagntannactcagagcagagtgtggtatatcctccaaatgaccataccagctctccaacaagagtttttaaccaggctgaactggctggaataacagaaatagaattcagaatatggataggaacaaagattatcaagattcaggaggatagcaaaacccaatccaggaaaaataaaaatcacaataaagcaatacaggagctgaagtacaaaatatctggtataaaaaagaacctaatggatctgacag

SEQ ID NO: 679657 - DNA, 136 bp, Homo sapiens
gtaccccatcagtggctgtgattacatctccaatacataaattagctagagcgccttgttccaggagtgacccgggaaatggcgagaggctgttcgaagtccttgcgcccacgagcgcaaccctgtgtgccccggg

SEQ ID NO: 679658 - DNA, 170 bp, Homo sapiens
gggatacaaggctggatgactcacatcgagcgggaagacgacaggccgggatccaaggggaacaagaaggaggtggtggaggctgggaccattgtaagagacaccacccatgatggttgggggcattgtggctacggggaaacccctcggggcggcggacttcaagactg

SEQ ID NO: 679659 - DNA, 107 bp, Homo sapiens
ctagtgtcggggctgcatgtgtgtctgtgtgacgagcgtcacttgagctaaatgtgtcaccgatacttcatatccttcgcacgccgatacttcctatccgtcgcacg

SEQ ID NO: 679660 - DNA, 257 bp, Homo sapiens
tcaaagtgcaatcacagtcagccgttcacacccttagttcaggtggccattagggccaggggtggcaatcagtaagctgactcctgcctaactctctttctccagccattctctataggctccagcgtagttgcgagcccctagtgtatccaagtactcgcgggccagactgcggtggccgtggcaggcccccgcttgcctcatctcgacagaaagaagaacgagcatgctcatgcttccaggctttggctctctca

SEQ ID NO: 679661 - DNA, 205 bp, Homo sapiens
gaaaagcctggctagtgtggaagcatagtgaaccccctgattaggttatggtttaatgttccaccaactattttttaaaaaaaacaagttttagaaatttggtttcaagtggacatgtgtgaaaacaatattgtatactcccatagtgagccatgattttttaaaaaaaaaaaataaatgttttgggggtgttttgttttttcca

SEQ ID NO: 679662 - DNA, 385 bp, Homo sapiens
cgcggtggcgggcacctgcaatcacagctacttgcgaggctgaggataaaaattgctcgaacctgggaggcggaggttgcagtgggccgagatcacaccaatccacgagaatccgtctcaaaaagaaagaaagaaagaaaaagaggtcacaatgcctactcttttaagtttttacaatgttgttcacaggcaagacatactcatgcaaccttcatccaagctcctggaacactgcttacgccttcatccatgcactggctagactctaccttataacatagttgtagctgtttgccctgctacctgtgagttccttccttcctacacatgcatgaaaaccagaaaccctccaatctaaaagaggaaacccaccaaccaaccaggt

SEQ ID NO: 679663 - DNA, 165 bp, Homo sapiens
ggggattttttttttgtttattccttaaagcccagacccctttccattaaaatttatttcaaatcccaagttgattacaattgagtgggacatcccatgttgtaaaaggaaaaaagggttcaaaaaggtttttttttcccccaaaaaagccctttatagtgttta

SEQ ID NO: 679664 - DNA, 644 bp, Homo sapiens
  misc_feature (94)..(94): n is a, c, g, or t
  misc_feature (129)..(129): n is a, c, g, or t
  misc_feature (156)..(156): n is a, c, g, or t
  misc_feature (299)..(299): n is a, c, g, or t
  misc_feature (318)..(318): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (385)..(385): n is a, c, g, or t
  misc_feature (388)..(388): n is a, c, g, or t
  misc_feature (402)..(402): n is a, c, g, or t
gaaggcttctccgcccattctgacccagggcctatgacggatatgcaagaacatacagacacatttacactataggccacggatagaggatatngggtctcagccctaggggaatgggaagcagctcangggaccctgggtgggagcataggaggngtctggacatgtggttactagtacaggttttgccctgattaaaaaatctcccaaagccccaaattcctgttagccaggtggaggcttttgatacgtgtatgagactatgcaaaagtccaagggctgagatttttcgtgtatanctgtgtgaacggtgtatgnccctaggatatgttaaatatatagctggccccttagttgcatgaccacntanaanatgtgtctatcngcntttgcctacgtganaacacaaatatgggagggtgagacactgtacactctgaatttggagtgtctagagtgcgcaacgagtgcgccacagagtgtgtgagactatctatcgtgggtctccacacctaatgtgctgtgtgagacccggggagataatgtgtgaacacgcctcgatgtgcggcgcctccagtataagagagccccctctgcgctagattttttgtggcgccaatgccccgggagttttttttttatcc

SEQ ID NO: 679665 - DNA, 1822 bp, Homo sapiens
gccacgctcccggagccactctccctcccacgccagacatcccccttccagccaccaaacccacgaccggcgccccctccaccgtacaactaggggcgctggcatacctagcccggcatcgcgctggggctcgggagaggggcagtgcagtgaagacgaggcgcactgcagcgggatctcatgacagatcacgcagcgggaggaacaaacatgcacggcgcacaaccgaaccacatgcggcacgcggctccacacagaacacagaaccagacatgacaagcacacgcgccggcatccactggagaccataacaccagaaacaacccaccaataccccactaaccacgacccccactcaagataaccccctcaagaaggctgcggccatcgtcataacagcgccagccgtatacaacgaaccccaagccactacacatggatagaacaccaacagagactggacacaccccaacagcatcgaggccaaaacacatcccatgacaagcccttgggcgagcccgaccacccagaccaccaggcacgcagacaaaacaccagaggaaagggaagccgaaaacactagacgcatgccgaccggggcagaggcacgacactggccgccgagccacgaatacaggaagaaccaacaacgaccagcaagacagcagaacacgaccacacagggaaaaccaccccgctacgaccgacacacgcggcccccaccctacgcaaaagagcagaaccaacagagcccgcataaataaccgcggggcaggcccagtcgcaccaactcccccctggctgaaacccagccactgagcgggagcggggacgcgaaatggactcaataaccaggagacacacacaagacggaccgcacacaaggggaaacaacttcacaagggtgtcgtacatgcgacccatggcacaggacacatgcaagccatacgacgagcaaatgaagaccatgagggcacctacacaagccaaatacaccacacaacaaaacactgaatcagtcgaagaagacccgcggacgaacccatcggagaagagagtgggacacaccaccaacaggcgtcctcaaggagccacaacacgcgaggagacaaacatactagggcagagcagcacattcaggacagaacaacgcacgacaggagccacatgagacaataacaacaccgagcgatgagaaatagaagcaaaggagaccagcataagacgacaacaacaagcaccaacaacaagcgcataaaaagaagaacaacaccagggggaacagacaaaaaacccccactacaaaggagaacagcgatcagcaccaggcggtcagaagggcacacgaaccaaatctacgaactcgggaacaaacaacgcctcggcatgaaacaaaagagcaacaagaggagcagaagacagcaaaccatgaagatgaccaagatgcaatcacacgcaggcgacgaagttgagaaaggcaagaacgaatacagagcatgatcaccgacatcatgtctggcagcgcgcctaacagagacaaaaggtgcaatataagccaggcaccagcagagtgtcgccacagaagaacacacatcaaccagaggacgagcgcaagcaaccgccacaagcacgcacaagcagaagcagaagaaaaaaccagcaaaaacgacagatagaagagagaacagaaagcgaacacacaggaaccagactcccacaagtacagagagacagacgactccatcgtgcacgtgcaacccgtagtgaactaaacggtggcacagtagaccagagacggcaagcacatacaccgaaccacagc

SEQ ID NO: 679666 - DNA, 201 bp, Homo sapiens
gtggtcttacatatctagctccctgctatgctgtacgctctcgtgaggatgaagaacaaggcctcccatcacttcaatatcctccagggcctggaatgtccctgacacaaggtcgcaccacaacccatgtagaatctggactgcaaagaggaagctcttgcagccgaaaagcctatggcaacacgagctaacagcaggcac

SEQ ID NO: 679667 - DNA, 625 bp, Homo sapiens
  misc_feature (94)..(94): n is a, c, g, or t
  misc_feature (129)..(129): n is a, c, g, or t
  misc_feature (156)..(156): n is a, c, g, or t
  misc_feature (299)..(299): n is a, c, g, or t
  misc_feature (318)..(318): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (385)..(385): n is a, c, g, or t
  misc_feature (388)..(388): n is a, c, g, or t
  misc_feature (402)..(402): n is a, c, g, or t
gaaggcttctccgcccattctgacccagggcctatgacggatatgcaagaacatacagacacatttacactataggccacggatagaggatatngggtctcagccctaggggaatgggaagcagctcangggaccctgggtgggagcataggaggngtctggacatgtggttactagtacaggttttgccctgattaaaaaatctcccaaagccccaaattcctgttagccaggtggaggcttttgatacgtgtatgagactatgcaaaagtccaagggctgagatttttcgtgtatanctgtgtgaacggtgtatgnccctaggatatgttaaatatatagctggccccttagttgcatgaccacntanaanatgtgtctatcngcntttgcctacgtganaacacaaatatgggagggtgagacacttggacagaagacagcagcgagtgtgcatggtcctctctgactatatgctaacaccctcagaatgactctgaattctaggaggtctgactgtgcccaagtgggtccaagtggctgtgacatctacgtatggctccatagctcctaatgctgcctgggtagccagtgatgagagtctagggttccagggcgtggtcca

SEQ ID NO: 679668 - DNA, 418 bp, Homo sapiens
  misc_feature (215)..(215): n is a, c, g, or t
  misc_feature (220)..(220): n is a, c, g, or t
  misc_feature (253)..(253): n is a, c, g, or t
  misc_feature (259)..(259): n is a, c, g, or t
  misc_feature (266)..(266): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (286)..(286): n is a, c, g, or t
  misc_feature (288)..(288): n is a, c, g, or t
  misc_feature (319)..(319): n is a, c, g, or t
  misc_feature (365)..(365): n is a, c, g, or t
  misc_feature (375)..(375): n is a, c, g, or t
  misc_feature (411)..(411): n is a, c, g, or t
  misc_feature (414)..(414): n is a, c, g, or t
gtgagtgagatcattggccgaaacctgagtggcttccctgcccctcctggagaagagcctcctgcctgaaccacgtgaactgttattacctggcaaccccagccccagcctcagccctgccccctttccctcctttttggagtggtggctacaaaagcttggggccaaccctgggtcctttttccccaggttttgtttgtttcactgttttcccnccccncccccagtaggtgggccctcaggcctggtgctnccttgnagggctnggggaaanantgtntggagnanggaggagggttaaaacttaggctaggtgccnaaatggactggagtgaaggggtgtttaaagtgtgggctggctgttntgctggaaanctggggacaggtttatggtaataaactgctcaatgnccngtta

SEQ ID NO: 679669 - DNA, 405 bp, Homo sapiens
taaataaaaaaagttttaataaaaaagggaaggtgtcccttattgtttacatggtcccttacctgaatataacataaataattatcctttttaataaatttttattggattagatcaaagagccgttttttggaaagtattataaatacctttctgtagaattttccaactccttgtaaaaccatggattttattttccgaatatgattatttgaatggtattgtcatgattattggtccccttttcagatgaaccctggcttccagtcccatgatatattccctatgcccttttattgacttttccctgtaaaaccatgccccctaatttagtaaggatttgggttttgtgatgtggtcagttgcctgctgggggacatgttaaattaactcctcccttaggga

SEQ ID NO: 679670 - DNA, 180 bp, Homo sapiens
ggccaatgtccttagtggacagctcacatgatgccaaaatgctatgggtccagcagtgtagcgatcaagtcatggccagaaaaacttcgctctatctacaatgtcacgataaaccgtccgaaatagtggaagacaaagcctactaaatagccgacaatggacgatcccaagtaataacag

SEQ ID NO: 679671 - DNA, 626 bp, Homo sapiens
cgctgtgggcgtggtggcatgcatctgtaagtccaagctactcaagcggtcctcccacgtgagcctcccaagactacaggtgcacaccatcatacacgggacagggtctcgctatgttgctcagactggaaagttcagatttttaaatcaggtcttgggactccagattctgtttttccacagagtcaccatctatcctgacaatgctccatttcatgctgtttttcctcaccttcaatactgctcccccatccccccacctctaggtgtgaaggttaccaggagagacctgagctcgctggctctgactccaaggtggcctcagtggaaagtttcaaaaggcaaccggtttggtttcactggcagggcagcggcaggcgtttgggttctggaggcccaggaatgtagaagcctccagctaacagactccacgcgcctatcctcccaaacgctctcggagataagctcccagctccctccccttttccaccttcatgcacttcctgctgtattctgtccattccagcactggccctttctgtgggtgggtgggcagaggatacaatttcctgcatgactacttgctcatgattcatacttctaaatgaaagtacaactgatataat

SEQ ID NO: 679672 - DNA, 191 bp, Homo sapiens
  misc_feature (139)..(139): n is a, c, g, or t
ctgaaaacacacgagaagaaatcaaaataaaaagccaagattcttatgaaagaagaaaaacctcctctagtacaagagacccagacgatggaacctccctgccctcctaccagattcaacactcacaatctaaacggcncatcgctcctctacgctcccatcacatttaggcaaaccgacagaacactccc

SEQ ID NO: 679673 - DNA, 349 bp, Homo sapiens
gtgtgtacatatatgtgtgtgttcgctgcttcttacctccttctgattttctgattcccaagtcatatttcaggaaccacacaaatcactattgtcactgcttaagtgtttttcataccaggtcattgttaatatcaagtgactgtagtccagtcagctttctcaatgttctgtattagtaatagtaaagctttgtctcctggtggtgtatagcctcctgatggaaaggggcagatcctgtggttcagaaaatacttacgttaggctgctgtccctcaggatagccagattcaacaaataaaaatgcaggatgcaatatatgggacatctttttatttaaaaattactt

SEQ ID NO: 679674 - DNA, 421 bp, Homo sapiens
gggtacggtaattcccaaggtaagctcttgatctagatcttggggcctatagaaatatttttaagggacatcaaagggtcttgggaaatctgcctagtgagggtaagcaagatgaaagagggaaagttgttatggttaatagtttgttaggaactcccttccaagaggcaagcttttgtcatctctatggaatttgagggcagttggacaatttgcaaggatattctcacctgttcattaaggtccctttcctccagtaagagaatggctagggtctgtgggataatcttaagcacctactgttgcttttttgttgttttgcttatgcaagtgatcatttattttttaggagtgatttggaggaagagtatgaggcaagcttgtttttctccagtgtaattgatggtcaccatgcatggtt

SEQ ID NO: 679675 - DNA, 95 bp, Homo sapiens
cgccgtgctgaccgagagcgtgactcaaggagaagtcggcagatgcatcagaatctgaggccacggactctgactacgaggacgcgctgcccaag

SEQ ID NO: 679676 - DNA, 167 bp, Homo sapiens
  misc_feature (131)..(131): n is a, c, g, or t
gtgtgttagaggatcgcttaggtggttgtgggtagggaggtacactggtctccacagcatcaggttacgcacatggcacacagggtacagcacggtttctgactgagaggaatacagtaggtttttgaaangccttgtttgctgccctgaagaaagtgaccacacgt

SEQ ID NO: 679677 - DNA, 454 bp, Homo sapiens
agtaccatctctccacactctctccacactggctctgcacgagggtttaaaaagtccagtttctcgtatgatttcgctgctccatttagccaaggttggcctggccactgcttggccacaagtgggtcaatgcgcttggataggtcatgtttgtgtcttggcaactaagggtacgagttgcctttagcttaaattgtctttaaggaagaagaagaagaagaaaaaacaaaacaaaataaaaaaacaaaaaaacacaaacgtccaaagggaatactggttggtcctctctttcttcggttataattaggatcatctacggccatcttcgcccttcgtgggaggcctcctcaaggtcgagtgagctgtgtgtagacggtttgtacccagatctgagagctgtggatctgcgggatgaaagggaacccagaggtagtcgagcgaaatagcgagagaa

SEQ ID NO: 679678 - DNA, 165 bp, Homo sapiens
ttgctagctgcgtgaaagttgtttcagaaacatgggcttctaactggctccaaaatattgactcagctgccattgtaatcggggaccgtcagaagagacgagaaatatgttgccacagcatgtcttctttactcaaacatacatcaggcacctacaaaatgccat

SEQ ID NO: 679679 - DNA, 129 bp, Homo sapiens
  misc_feature (64)..(64): n is a, c, g, or t
tcaagcttctaacgatgtacggggacatgtctgaacacaccaatagctaatgacccaaactggngattagataccccactatgcttaagccctaaacctcaacagttaaatcaacaaaaccaaaaaaaa

SEQ ID NO: 679680 - DNA, 411 bp, Homo sapiens
tcagccacatgtatacacgcaccaattttatacatctcagaggcagaggggctgaatcttctccctgctccttggagaacgtgctctattaccgcccaggaggggccggcagtgacaccttggtgaggtattttgcaaattaatccatttgctgacgttccaccgagtggaaggattgcaaggcgtctacatcgctactctgatttatggttctgatcaacttaggagaacacttatgatcggtcactcaccttcgacatagggggatacctgggtgtttcttctggctcccgccttcacgtgatatggtggagcatatcgattgtgagctttcccagggttgttcccttcatctggctcagcgcctcagtcagcttctcaccctccagctccggagaatggccatcctgt

SEQ ID NO: 679681 - DNA, 493 bp, Homo sapiens
cttcccccggtctgtaagaattcggctttagggtcgctctttcagagtctgcatgacagacttggcatcaggtaccccctgtgaggaacactgaaatggatcacgacggaacccccgaaaacgaaggcgaagagactgcgcagtcagtaagtcattggtgcccgctcgggatttccaagttcaggggaattctcaagctagggtttcatcatgggacaacagctatccacacaacagaaacagtatataaaagtattgaaacaactgcttaaagctagcagagcctcggtttcgcaggctcaattaagggacccagtgcaaactgttgtttcccataacccatggtccccagaagaaggcacgctggacctagagctttgggaaaaagtggggagaaatcttcgatatcatgcacaagggcaatgggtcccagttctttaaccgtatgggccttagttaaggctacttttgccttgctctacacagggccttt

SEQ ID NO: 679682 - DNA, 168 bp, Homo sapiens
agaatatccccggcggttgccgatcggagtcgacgtcagagttccgacagaagggtgggccgcatgtctctcttctagtggcatcaagacctctgtgtgccgtctccagaactttctcacctcgactgtgcgcttcacccggggagacctccatgactcactactcct

SEQ ID NO: 679683 - DNA, 930 bp, Homo sapiens
  misc_feature (67)..(67): n is a, c, g, or t
  misc_feature (70)..(72): n is a, c, g, or t
  misc_feature (74)..(74): n is a, c, g, or t
  misc_feature (77)..(77): n is a, c, g, or t
  misc_feature (82)..(82): n is a, c, g, or t
  misc_feature (84)..(84): n is a, c, g, or t
  misc_feature (88)..(89): n is a, c, g, or t
  misc_feature (93)..(93): n is a, c, g, or t
  misc_feature (97)..(100): n is a, c, g, or t
  misc_feature (106)..(106): n is a, c, g, or t
  misc_feature (112)..(113): n is a, c, g, or t
  misc_feature (115)..(117): n is a, c, g, or t
  misc_feature (119)..(119): n is a, c, g, or t
  misc_feature (125)..(125): n is a, c, g, or t
  misc_feature (127)..(127): n is a, c, g, or t
  misc_feature (133)..(133): n is a, c, g, or t
  misc_feature (160)..(160): n is a, c, g, or t
  misc_feature (164)..(164): n is a, c, g, or t
  misc_feature (171)..(171): n is a, c, g, or t
  misc_feature (181)..(182): n is a, c, g, or t
  misc_feature (184)..(184): n is a, c, g, or t
  misc_feature (198)..(198): n is a, c, g, or t
  misc_feature (200)..(200): n is a, c, g, or t
  misc_feature (206)..(206): n is a, c, g, or t
  misc_feature (240)..(240): n is a, c, g, or t
  misc_feature (253)..(254): n is a, c, g, or t
  misc_feature (268)..(268): n is a, c, g, or t
  misc_feature (275)..(275): n is a, c, g, or t
  misc_feature (288)..(288): n is a, c, g, or t
  misc_feature (291)..(291): n is a, c, g, or t
  misc_feature (323)..(323): n is a, c, g, or t
  misc_feature (359)..(359): n is a, c, g, or t
  misc_feature (370)..(370): n is a, c, g, or t
  misc_feature (383)..(383): n is a, c, g, or t
  misc_feature (390)..(390): n is a, c, g, or t
  misc_feature (419)..(419): n is a, c, g, or t
  misc_feature (477)..(477): n is a, c, g, or t
  misc_feature (538)..(538): n is a, c, g, or t
  misc_feature (549)..(549): n is a, c, g, or t
  misc_feature (551)..(551): n is a, c, g, or t
  misc_feature (693)..(693): n is a, c, g, or t
  misc_feature (793)..(793): n is a, c, g, or t
  misc_feature (917)..(917): n is a, c, g, or t
ctatttaatgtttgaaagaaattaaagaaataaaaaaaattaaataaagatgcaaaaaaaaaaatcnttnnntnccncatcntntccnntttncagnnnnttgtanataaanntnnntntggggngngggacnccatcagttgtgcacatcagtgatggngagnggggggntcaccattgnnangggagagatcattnangggaangggtcacagagaccgtcctagcagcaagggtttntaacctcaaaagnncattactggggctnttttatnaagattgctaatnatntagagggctttacctaccaactagcaattaancatgaaatcaatgaatgcaatcactgtttccaagtngaatgtgaccnatgacctcatgcntaggggnaacatctataccttttgctgattggggcnctgacatatgcgggtgtggttaggaacagaaatcaaccccacctccccttggctagtnactgtgaaaagcgtgcgttagggaattgaatggggggttaagggttcatcttgctaatgtnaaaagtgacantnacaagattcttagcctcatccgccagaggaggggcctctgcgtccaggtctccaggagcaagctccgcctccttcaccagaaaacgggttataacctcctccccgcaaaggctttctgtccgatttccgtttcaggacagangaagtggaaggcccaggactgttttcctcctggggcttctttgcatttcctttgtaactttttccttcttgcatgctgtcccacatttcaatcttctgtntccttttttcttcttcaagttgtttcagtttttccttatgcttttcaacttgcgcatttagttcttcttgcattttcagtcgagcagctgctaaagcttcttgtcgtttaacaacaacatcagnctcacagcagcgg

SEQ ID NO: 679684 - DNA, 244 bp, Homo sapiens
gatacgaatactcatttctcgacagcagcatggggacgatctgatgtgttggtgtgggtgtgaaagcgtaggagatgtgtggcattcctgctggtagtagctatccacggcatacagcacccacacagatgactgaagcagttgccgtagaaattcctccgagagcccctgtgctgccatgtggtctccgttcccagatgctcagatgtcctgggtgatcctcatagatgtctgaccttgcatg

SEQ ID NO: 679685 - DNA, 502 bp, Homo sapiens
tagcaagtgtcaccagccgggttcagtgctcgtccactgggccagactccgagctgggcccactcgctggcccaacgaatgtcatggcctcttggccgtccaggccctgatcctcattcagccgggggccactcgtggccacaaactgggcgaattcacccagtggtacatttggtgcctactccacttgtggcgggcgtgtttgtgtgcctgctggagtaccctccggaggagaagacgcgaagaagcggctccaccatggacgccgctgcgcggacagaagcacatgacacgccgtggtgaagctgttcgggccctttaccaggaattactatagttcgggcacgtcctgcatctcactcgctctcggtgcccgccggcttcctgctgcccaccatccttgggaccgcctgcctggccattgcgagcggcatcgagcctactggcgtctgtgcgtggacagagcagatgacgcccatcgagcccaagccacacagaggag

SEQ ID NO: 679686 - DNA, 183 bp, Homo sapiens
acgtgtagtgtaactggggaatcagcttcttgatctgaaatatgggaacaatgaagccaacttcaagaagttagcaatttaattaaaagtttaagaaaaattatcggccaggcatggtggctcacgccgtgtaatcccagacactttggggaggccgaggcggcgtggatcaccatgaggtca

SEQ ID NO: 679687 - DNA, 121 bp, Homo sapiens
tgatctccgtgccccatgacctttttagcatacaatgttgtgttaagaaaaatgaatggtcttcatagaagagaattataccagagcctaaggaaaaactatgattatgatctgaatttga

SEQ ID NO: 679688 - DNA, 158 bp, Homo sapiens
atcgagctcggtacctcgcgaacgtgtatcctgggcacaagctcgtgaagcaagagcgatgacatgtgcatgatatgtttcaccgaaggcgcgtctcggaagcaccagccgattcagcgggatggtagtcacatattccacttgacagtgctgtcggc

SEQ ID NO: 679689 - DNA, 748 bp, Homo sapiens
  misc_feature (27)..(28): n is a, c, g, or t
  misc_feature (199)..(199): n is a, c, g, or t
  misc_feature (233)..(233): n is a, c, g, or t
  misc_feature (274)..(274): n is a, c, g, or t
  misc_feature (429)..(429): n is a, c, g, or t
agtggtgggactcgcgtcgcgccgcgnngacgtgaagctctcgaggctcctcccgctgcgggtcggcgctcgccctcgctctcctcgccctccgccccggccccggccccggccccgcgcccgccatggagaagactgagctgatccagaaggccaatgctggccgagcaggccgagcgctacgacgacatggccaccntgcatgaacggcagtgaccgagcagggcgccgangctgtccaacgaggagcgcaacctgctctccggtggcctanacgagaacgtgtggtcgggggccgcagggtccgcctggagggtcatctctagcattcgaggcagaagaccgacaactccgagcagaagttgcagctgattaccggactatcgggagaacagtggagtcctgaggctgagcatccatctgcaccancggtgtctggcaattggtctggataaccatagttcaattagtccaactgcaagctaatccaagagagtagtggtctggctatctgaagaatgaagggtgattacttgccggtacctatgctcaaagttgcggtgtggtgatgatcgagaactgaaacggtagaatactcccccaaggagcttgaccaagcagggcatttcgatggtaaggcaacaagaggagatgctgacccaacatacccaaatccgtcctgggggcttgccctttcacttccctcgtatcgtactatgagcattcttaattaagccagtagttggcc

SEQ ID NO: 679690 - DNA, 172 bp, Homo sapiens
tgggccgagcctggttaaagctttaaaaggtaccttttcaaggggaaaatgtggggggccctgttttggccgatttaaaagggtttccttccctggggaaaaaaaaaaatcctgttttgtttataaattggcaaaggccattaatttaaaaaagggtccctggttcttttta

SEQ ID NO: 679691 - DNA, 154 bp, Homo sapiens
atcccatgtcatggcctcttgtggatagggctatcagtctatatgaatcctgtattccatgtcgtcccttccagaaccccgggggtacagctacaaatatagtccttctttcgctgatgggggctagtgagagaaagacaatgaagtggcaccc

SEQ ID NO: 679692 - DNA, 525 bp, Homo sapiens
acgctgcaccgctgtcacagttaagaacgggaagaatgggtggcaatggtggttcctggaatagctcacccagcacagctgccctgagctcgggccttggtttctagtccctgggcatacttatatttaataaatttttatataaatacactgagaaatagaaaatataaaatctgaggggttggggaagaaactgtgaggacatcagcaggacagccagagctaggagaggtccattcaggcccaacttgaccatcctccttgaccccttatggattctgggcttctccttccttggttttctacctcttcggtgacttctttcttctcctctagggtctttctctttttcatcctctgtttggactctcttggctttattgaagttggaagagttcttgcgtgccccctctccctcctcttcagaaatcggaaaactcttcctcacaggcaattcgtttgtcagaggagcagatcgagatgcgcttgtcagggtcgtcttcgtcctcatcgccactctcctca

SEQ ID NO: 679693 - DNA, 136 bp, Homo sapiens
tggatggagaactatgagagtgctcaattccagttccatctcctctttgctggatgacagggtttcagggatctggagaaaagtccatcacccactccagtaatgcggatctcccaggtggtgacccattttaaca

SEQ ID NO: 679694 - DNA, 332 bp, Homo sapiens
tgttttttcatttaatccttacgactctctgagataggtattagtcttattatagccatttcatatatgagaaaactgaggcacactaaataattttcccaaagccacagagcctcagtggtaagcccaggatttgaacccagggagttctggccccagagtccagcaagtgcttgttgcacatgcaaccaattcactagtacatttcccctgaagacgcaaagatgactctggcagtgttcaggctccagacagtggtctcagaccaacctagcagagctcatcaaagcacactgtgatgaggaggtgtcttatcatctcctgccttcctc

SEQ ID NO: 679695 - DNA, 1545 bp, Homo sapiens
  misc_feature (882)..(882): n is a, c, g, or t
ttctctttcgatgtctctcctcgctcagcctgttgtgtgtgtcgtgctgttgccactcttctctgtcattggctcggtggttgttctgactggcatgtacgccggcgggttgattgataagaccaagttgtttgtggggagacgacgccagtattgtgtattcacgttgtggtgggacacgaggagcacaccattgtggagcaacgtgccagcaagcaacaattgttggctggcgcgctcccaaatgagttggggtgtgtgttatgaccccctgcaagagtgatcctccggcatgttcttccaacacacgctgggatatttggggttggtctctcttaagggggagaagcaccaaacgaggagagaggattttgaagaccaccagtgttctgggggtggtacaaccaacgtgccccgcccttctcattgggaattctttttcttgggggaagaaaaaggacctttttgcccagtatccccactgggaccacagattttgaagagggagaaaaaaaggtcatagaaagcaaccacgaggggttctttttataccttggcgcataggagggagaaatgttggagaatagacgttgcgctcccagggacacaaatcccccgttttgtccgcttatggggcttcggcccatagccaagaaatgtatagcctgggcacccgtcgtttcccccccgataaaaaccccggcggttttggtgaatagggagcgtgaacacatgcgtgttgtcgtcccgcgtcgtgtggcagcccagcaaaaataggtctttaggagatagtgcaccccgcagagaggagatatatcaccacagcctcgtgctgttgaacctcttgtgttgttatatgcccccttccacgcctattgaganttccacggcggttttctaaatttgggcacacgtttctggggccccaataaatttgagatgagaagagaaaatggctcccccccataaaagccttcgccctctcgcacgagaacccccacacgagttttcttttttgtgagattcactgtaggagaaagggaaatgtgagaatatataggacccgcggtcccactcttgtacacgcgtgtctccccctgaggagtttttctgcccacaaaaagagtttgttatagagatgagactctagtttttctcgccaccacactctctcctcgtgagattaataataatatatgaggctgtgccaactgctcttcaccacgaggttttattgagatataggctgctatactgtgttggaggagaaagagtatgacccgcaactggagaaaaatatttgtagaaggtgaacacacatgtgggcgctatatgtctgctatatgttgaaggccacgtagctgctgtcatggcccaaggggtttgatatccctgggagattaaaccctgtcccaaggaatgtaatcccttctataggtttgaacccctgtgtgtttttacccaaagtggcccattggcccctgtttgcgttttttaccatcaagtggacaccagcataagttaagaaaatttctccacccggga

SEQ ID NO: 679696 - DNA, 189 bp, Homo sapiens
ggtgagatttcatttgctagtgccatgctccaacaactggcttggtagaatttcgctgggccagcagagacctgacaactatcaacctattccccaacttgggccaggaaccactactcagagagggggctgagccctagctacaaggtaaaaaaggcagcagaagggaccgggaggattgtgtctcag

SEQ ID NO: 679697 - DNA, 366 bp, Homo sapiens
gctcgaccgccttcttcaaggcatcaatcgccgcaacatcaacgccgttcgccgccagactcgcgaccttgcgggtcttgatatcacccgacagcaaattggcctggctcagcgctggtgaacgttccggagacgtcttgcgctctggcaccgtgcctttcttcggtgccggcaagcccaggttctgcgccacgcgttggccagttcgaggtcgatgttggcgaggatctcgttcacctgccgagcccggatgaattcacgctccaccttgcccagctcgaagctgtaagccgcgatgatgtgctcttgctcgtgcttgctcatgctgcggaaaaacaagcgcgcctgggagaagtgatcaccgaa

SEQ ID NO: 679698 - DNA, 113 bp, Homo sapiens
caggacaaacattatcatcatcaatggtgtttttttagaatacattttataacacaaggaagaaacacatgcacagcatgttaccattcaacattcattaagcagagattaag

SEQ ID NO: 679699 - DNA, 206 bp, Homo sapiens
ggtcgatctagagtatccccccgcggtcatgtcttacgtggctaatggtgtgcacaccaattttacctgagtacaacaaaagacgtactccctctttgcaaagggcaaggcagaatgaacaccacgaaaacaaaagaaaagaaaaaaaaagtcttaagaggaattatttatctatcgttctatttccccgtaagacataaccgcgg

SEQ ID NO: 679700 - DNA, 639 bp, Homo sapiens
ctaccgttaaggctgcagtgcatgcggctgtgatgaccgactcgtgcgcgagcacgaatgcgagctgttcacgtggcatagcggcaacgttagcgccgagtgacgatgacgcctgggaaatagatggcgccgccgtcaatggttttggtgctgacaaaaacatctacatcatgcatctccattttgttgaccagctcatcaacgagcagcgagtgacgaaacggctttgcgctttcgaccaatgccttacggaataggtcgatttcaggagaaatcttctccagggtcgactgctgagcttgcgccagcgtcgatgccaatgccagcatgagtgcaaaaataactttcatgataattcctaattaagttgacctgtctcgtatagggaccaccacttcatgcactgcgtcgtgtacgccgacaggtcgctagactgtgttacagggcgtgcaagcccttctcggtcggggccttcgggcttaggtaaatcttgcgcactactcgtttgctgaacacgtgactttcaaggtccgggcccagcagacctcacaagccgacctctgaggacactttcccatcatcgggctgggcccgattcatacggcgtaacacatgactgacattcaggccactaaagac

SEQ ID NO: 679701 - DNA, 863 bp, Homo sapiens
  misc_feature (1)..(1): n is a, c, g, or t
nctggccgatctccatttattacattcctctcatgctttttctttacttaggcatattaccccacaatgcttcattcttctcagatgtacgacgaaaaccatcccagtttagctgtttcttcaaaacttcatttcctttagaaggctcctgggtcacataacacatattaaataaatttgcgcacctttctcttgttaatctgtcttttgacacaggcgtcccacccaatgaacctaacatgggtacaaatggggtaggaggcggtaccgtatatcaaattatactcaagactaactaaaacagggttggggcagaagcagctttccataagacatgtatgggtgggtgactcccctgatacagcagcctatgaataaatggcctttgcttggtctaccctggttgggctctaccacagcctataacttcacacagctcgagtgggagctggacacatcgataggcaatcagatttttaaacatccctttggcccttacatgctaagttaaactctgtgaacacgtgttcttggagcacacattctactccacctcttctttgtgaaaaagcgaaaaggaagcctttccacttaacgaccgagaggggccggcctaaaagttccccgagttcaggggggccctttcaggcttagataaggggggtggggcggctgaaaaaccagggcttgaggggagaaccctcaccggttgggtgacggggcaccatcccgaaaacaaaatatcgcccaccttgccggggggggattttgggagtgacagtccctatctttccgcacttgggtggaagacaccgactggggaacgctatcaccgggttaaggctcccaggcatatagagctt

SEQ ID NO: 679702 - DNA, 174 bp, Homo sapiens
agatcctgtctctactaaaagtacaaaattagccagatacagtggcacatgcttgtaatcccagctattcaggaggctgaaggagaatcgcccgaacatggaaggcggaggttttcgtgagccgagattgtgccatcgcactccagcctggcaggaagagtgaaacttcatctc

SEQ ID NO: 679703 - DNA, 142 bp, Homo sapiens
gaccaacgtttgctgtattgccaggcaggttcaactcctgggctcagctatctcccacctctgcctccctaagagctgggattacaggtgtgagctgctgcgcctagcaatttaagtactttgaagaacagaacacaaagga

SEQ ID NO: 679704 - DNA, 192 bp, Homo sapiens
cttgctgtctgcggtcgcctctagacggactcccctccgtacgacgcgcccggccgtatcttacaatttgtttatccatttcatccattgataaatgtttgggctgttacggaagcgctcgttacggacggcgctcgttacggaagcgctcgttacggggcgctcgttacggaggcgctcgttacggaggcg

SEQ ID NO: 679705 - DNA, 955 bp, Homo sapiens
  misc_feature (1)..(1): n is a, c, g, or t
  misc_feature (62)..(62): n is a, c, g, or t
  misc_feature (92)..(92): n is a, c, g, or t
  misc_feature (100)..(100): n is a, c, g, or t
  misc_feature (119)..(119): n is a, c, g, or t
  misc_feature (124)..(124): n is a, c, g, or t
  misc_feature (164)..(165): n is a, c, g, or t
  misc_feature (171)..(171): n is a, c, g, or t
  misc_feature (173)..(173): n is a, c, g, or t
  misc_feature (185)..(185): n is a, c, g, or t
  misc_feature (187)..(187): n is a, c, g, or t
  misc_feature (191)..(192): n is a, c, g, or t
  misc_feature (248)..(248): n is a, c, g, or t
  misc_feature (359)..(360): n is a, c, g, or t
  misc_feature (363)..(363): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (380)..(380): n is a, c, g, or t
  misc_feature (462)..(463): n is a, c, g, or t
  misc_feature (466)..(467): n is a, c, g, or t
  misc_feature (481)..(481): n is a, c, g, or t
  misc_feature (489)..(489): n is a, c, g, or t
  misc_feature (496)..(496): n is a, c, g, or t
  misc_feature (504)..(504): n is a, c, g, or t
  misc_feature (511)..(511): n is a, c, g, or t
  misc_feature (524)..(524): n is a, c, g, or t
  misc_feature (534)..(534): n is a, c, g, or t
  misc_feature (538)..(538): n is a, c, g, or t
  misc_feature (547)..(547): n is a, c, g, or t
  misc_feature (551)..(551): n is a, c, g, or t
  misc_feature (558)..(559): n is a, c, g, or t
  misc_feature (562)..(562): n is a, c, g, or t
  misc_feature (571)..(572): n is a, c, g, or t
  misc_feature (597)..(597): n is a, c, g, or t
  misc_feature (650)..(650): n is a, c, g, or t
  misc_feature (943)..(943): n is a, c, g, or t
ngggggggaggatggggggggggggggggcgtgggcgaaacagtgaaagggaggagtgcgtnacaggcgtgggcgagagcgataggggtttnaatgaatntcctttgtgctcaaacagngtatntttaacttatcggacaggagcgggtgggagcgggcttaannaggagngngtgtgtgtgtgnanagtnnagtgcttcgaaggaatgtctttctccttgaacacggtgtttacagataagacagcnggtctcgccctgagcatgcgaacatgatggcaattaggaggctttcctcctcagaggcctcttgtggctttccacaacttattgtcccatattttcatggccagtttatannggnattncanaagngctttncccaacaattagcagtgtgagagcggactaatacagggtgccatcgggaaggactgcagccaggcggctccaattctccgannggnntgggcacgggggtncaaggtcnaggtgtnaccagggntggttcntgaggcctctgcncggggcttgnaganggcattgcntccntgtgtcnncanggggctgtnnctctgtgtgtgtgtgtgtgcgtcanctctgcttcttacaaggacaccaagcagcttggatcagggcccacccagagcnctgatggcgctgcttttaacctgctgacctctgtaggggctccatctccaaacccagtcccacactgaggtgctggggttaaggctgcaacatgagaatttggggggacgtaattcagccataacagccatgaggaaggggagacgtccagcacttggccgggtctcagacacaggccccaggccctctgaggcccagcttcctatcgaaacagagggcatggtcttgcacctcttggtggcctcctgcccactgtgggatgtgggatgggccagagccacaagaacttctcnaacaggggaggg

SEQ ID NO: 679706 - DNA, 1366 bp, Homo sapiens
gcctacatggcggattacgtccggtgcagcggggtgggcccggggtgccctgtgctggccctgaggcatgggggaaccgcgtgtggtttccgcgtgagtgtttcgagccaagtgttgcatccggaggaccggagtcgcggccggtgtcacggggccggggccagaagccgtggagctctcaggaggcccatgcccgacggaataaaggaagttggaattgccctgtacctgctagatgtttgggtcgcgcgttgtggtccaacggacattgaatgagtcacatgtcccgtgagagtgcagatctaatcgtcgtatcatcccttggcccaattaagagaattcaagagatcacattgacttctcgttcccttgggggggccctccgtcctccaagggaattgacggctctcggtagacacgaatttactagccccaggtgtcaccgaaaggcaatgacccactgcttggccaggcgtcaacgcaggcaaccgagggtgtcaaagggccatttgtcgattgcggcctatcgggcggaaccgtaccaaattgggccaacgcatcggctctagagagttgtctgaagggtagctcccacacggaaaccagttggccagccttgcccaattcccaggtgcggatagccattccattcctttgtggccaaagcctcctcccaatcgagtcccccgttgcagcaatgcagaggttaccttggggggaaacgaaacgatctgggcaaaagaccccccaacaacttgtccccttggcaagtggtgaacagggcgcggctggcagcgctcttgtagcctgggtaccgcccttcatcccccttgcatcccaaggggggcaacctggggacattcggtcttccccggcaaccccttgttgccctaaagaaaaggcttgcctctattgaatggcgcgggtcattcggaagtgaactgcgtaacaaccctcaaagctcccggggcggcttggcatttgtgacccccccttgggagcaagctctccgctcaaagggggccgccctttttggagttgcccatttatacataaagaaaagcctatcaaagaccgtattccttggaacaccccgccggaccctcttggcgcagccggacgaaccatgggagtatcaaacacaagagtttctacccctacttccaacggaacggttcacattagaacacacctcggggtacagagaacgccccacaccgcacgagaggtcaccccgtacgcacgggacactccaccgcgctcccccaggctgatggctaaccaaccactacgggggctttaaactcccacggcagacaactcacagcgtaacttcaacgcgctggacacaaaccacacggacaac

SEQ ID NO: 679707 - DNA, 265 bp, Homo sapiens
  misc_feature (60)..(60): n is a, c, g, or t
  misc_feature (136)..(136): n is a, c, g, or t
  misc_feature (143)..(143): n is a, c, g, or t
  misc_feature (182)..(182): n is a, c, g, or t
  misc_feature (220)..(220): n is a, c, g, or t
  misc_feature (239)..(239): n is a, c, g, or t
gtgctggccgagctgcccaaggactatcgggtaccgtagaccaccatggtcttgcctttnacctgtaccaggctgcgctcttcgaggtccttgaggacgcggccgaccatttcccgcgagcaaccgacgatacggncgatttnctgcgggtaatcttgatctgcatgccatcgggaatggtnatggggtcaggatgcttgccagtttccagcaggcaacnggtacttgaacggcacttnaaaaatgccagttgcccaacttttcc

SEQ ID NO: 679708 - DNA, 323 bp, Homo sapiens
tcggggcgtgcctccctgagccttctgccggtgctgcacctgtcctcttgctcaagtgtcgtcatgagaggcatcgtcgtgggtttccttaggagaccacaggaggttgctggagccagttcacagattctgaactcgcaggtgagtggcaactgagagagatatctgtgacgctgtcgaacattctcagacatggagtatcctgcatgtctccagcacagttgctgagatcttctcggggctcctctccgggctgccgtactcccgcacgaggcagcgcacactcatagggtgcaggaacataagctgtccacgtccattat

SEQ ID NO: 679709 - DNA, 1025 bp, Homo sapiens
ggctctttggtagcttttttgcactaaccttcaggaaccagctcaatgatctcaggactgtatggaaaaactaatctttgatattactactctgtcagccaacttgctgacgcaatatcacgcacttaagctaccacctgaggctggcacatgccaacacattcaaccctcatatcttcagctcacaacagcagcttacaatctcaatcacacgacacaactgactcacgcaccacaacgagagacaccatactgccagcccacatccctagcaagctccatgcaagctttcacgacaacttctcttgctctagcaaacctgccttctaccccctcccagcaacgcaaggacacacccgagagcacacacgcggctaccaacctatgcccccactccactctctcttctgccacaccccagcaggcacttcaccaccctccaatttacttctcactccggcgcgagcctggacttggagccctgggccttgctttcactcatgggtcaaacccgcaccttccccattccttccaacaccttatctccatctaacccggcgcctaaccttttcccgacacccgcaaacccgttggcaacgttaacacacacaacaaaaagaacaacgcacccgcccaacttcccatatgccaacttgactttaccacacaacaacccaccccacatcattcccccacgaccaatatcccaaccaccccataggaaaaccacaaccccaacgccacaccacacctagaccccccactattcacctgtacaaagcgccatatcataccccctttggacacccacgcccaccaccaacgcttatcccgcacaaacacgaacccactattccccccccaacggccaacagacaacccccaacacccggccctgtggaaaacttcccccacacgcccagggcaaacgacaacaccccttccctctcggagcccaccacacaaacccaccccacacagacaccaccccacaaaacacagctatggacactagcgcgccaaac

SEQ ID NO: 679710 - DNA, 976 bp, Homo sapiens
gaagatattcaagacaagatgaagtccatcatcctctatgtcctttccctgctccttatcttggagaagcaagcagctgtgatgggacaacaaggtggatcaaccaggccaatagccaagcggatcttcccaatttccacatggacaaaagggccagcactatcttggacaacaagatcaacaacatactaaatccaaaaggcagattttcctattcaacacacatatcatgtcgacatcaactgactcatgactggacccgaaacaagatcacgcaatatgaataagaatgccctacataaaggcgaacaacaatcacaacacacaactacggtcggaagttccaccaacgggctcaaatctatacaaccacagcaagggccagcagcaccaatgattcactccaaaaacggtcactccaaacaccactgactagataatcacattcaataaaagagacggacctaggcatcattctatagcgtacaacaaacactcctttcatcgaagtactcaagtgggtcactacgcccccattcttgacacacagaggatttatcaaagatacaaacgattacacaaataaacaaagaacaaaccaaaggggccttactggagttatacaaatggtattataacagctaactagaagccaaataacgttccagacacgtccttgggatgacacaccaaaataacaagaggtaagaacaccactaaactagtatgggtcaccccctcaaaataacgacacgagtaaaacattacatactaattacaaacataaacgttaggtacggaaaacacacataaggtaatgaggttatagcgcatcaaagggaagctcacaccacggataggaaatcatattttagacctcaagaatatcatcacaatcccacactcactatcaaaagacgggcggagcaatttatgcaaataacatttggtagtgattgagacggttggaaacagg

SEQ ID NO: 679711 - DNA, 178 bp, Homo sapiens
cctcgggctcgacttcgaggagtgcatggtcttgccagtcaggggtcttcacgaagatctgcatcccacctctgtagtacggtagtaccaggtggaagatggtctgctaccctgtctgtcttcgtcatccaggagatgagtccatcttcctcctatggtgctcggggggctcctctcg

SEQ ID NO: 679712 - DNA, 320 bp, Homo sapiens
gccagacgagggtgggcatacactgcggaaccctatggcttctcttcccctgccggatcagagaaaagggtgccgctcaggctggaggtcgctgaaatccaactgggtccccagacttccatttctgtgggcaagggactctggctccaaacccatgcacaagtggctgttctcatagcaacgctgatccctgcgcctgagggcactttcgccttgcctggctgctggttgtgttgggtcatgtgagacaggtgcacctgcagaacgagtttgcctgcttctcatgccaccacactcatttaacatttgatgctccagat

SEQ ID NO: 679713 - DNA, 379 bp, Homo sapiens
ttgttattataatatgtatactataataaaagctggttatcctgagcaggggaaaaggttatttttaggaaaaccccttcaaatagaaagctgaaggacttttaatatactgagggaagtataatatgtggaaccaactctccaccaaatgtttattgatgttgatgaaacagatcagtttttccacccggagttaatattgggtccatgattttaaatgggaaaaagtaaaaaatgttctgccattttataaatgttcatgtctttttttaaaaaaggggctattgaaattctgtgtttccagcaggcaagaaaacttgactaactctttttgtctctttatgggattttcagaaaaaagtctgacttgtgtttttga

SEQ ID NO: 679714 - DNA, 237 bp, Homo sapiens
aggtcagacttaacgatatatggaggtcagcacggtgctcacgtgtcgacggaacttgtacagggaggcatgcaccgcataggtaaatacacgtcgaccaggctccatgtttaacgtatatttggtggtcagcacggttctcaagtatcgacggaacttgtcccagggaggtcatagcaccgcagtggtgaatacacgtcgagctgcaggacatgcatgcatgctcgtggtactgaa

SEQ ID NO: 679715 - DNA, 137 bp, Homo sapiens
gagtaccttcaccaacaacctggtgtatgacacctcggacagtgatgactatcacctcctgaaggacctagaggaaggcatccaaatgctgatggggaggctggaagacggcagccacctgactgggcagaccctca

SEQ ID NO: 679716 - DNA, 200 bp, Homo sapiens
ttcgtgagacccctgaggtggagagtccctagcctcccagcatacacacacacacacacacacacacacacacacacacacacacacacacacacacacacacacacacacacacacacacacacacacacacacacacacacacacacacgcacgcacacacacacacacacacacacacacacacacacacacacaca

SEQ ID NO: 679717 - DNA, 264 bp, Homo sapiens
gcgacctgcacgtcattagagtcacagaaagaacggctcctgtcgaatgggtgggagacagcatcgagccgtcgaccatgatggagttgtacaaccaggttacctcgacgctgaagtgagcaggatagaatcacttgaatacctggataaaatggagctgctggagcacctcatgcggcattactgcctttgctgggcaaccacaggcggaaaaatgcgcttgggctgcaaggagataacttatcaaatctgtcactcataagg

SEQ ID NO: 679718 - DNA, 90 bp, Homo sapiens
accagtgcaccttcatttggtacaaccagtggcgggctctttgcagataatctcagtgataccttgaagaagctgaagataacagctgtt

SEQ ID NO: 679719 - DNA, 399 bp, Homo sapiens
  misc_feature (398)..(399): n is a, c, g, or t
cacctgaggtcgggagttcgagaccagcctgactaacatgaagacaccccatctcttctaaaaatacaaaaggagctgggactacaggcgcccaccaccacccctggctaattttttggtattttttagtagagacagggtttcaccatgttggccaggtgggtctcgaaatcctgatctcaggtgatccgcccgtctcagcctctcaaagttctgggattataggcgtgagtcaccgcgccgggccagaaccttttcttaatgactctaggagaatacaaaaagaaaactaaggctgaggcaggagaatcttttgaacctgggaggcagagattgcggtgagccgagatcgcgcctttgcactccagcctgggcgacaagagcaggactctgtcttnn

SEQ ID NO: 679720 - DNA, 739 bp, Homo sapiens
  misc_feature (280)..(280): n is a, c, g, or t
  misc_feature (286)..(287): n is a, c, g, or t
  misc_feature (290)..(291): n is a, c, g, or t
  misc_feature (324)..(324): n is a, c, g, or t
  misc_feature (360)..(360): n is a, c, g, or t
  misc_feature (656)..(656): n is a, c, g, or t
  misc_feature (663)..(663): n is a, c, g, or t
  misc_feature (668)..(668): n is a, c, g, or t
  misc_feature (680)..(680): n is a, c, g, or t
  misc_feature (682)..(682): n is a, c, g, or t
  misc_feature (692)..(693): n is a, c, g, or t
  misc_feature (696)..(696): n is a, c, g, or t
  misc_feature (699)..(699): n is a, c, g, or t
  misc_feature (710)..(710): n is a, c, g, or t
gagtctggggctgcggcttcccagaggcgcgagtcgcttttccaggagccgaggcccaaacggggccgggcctgaagggtcccccgccagcccgcggccgcgccatcaatcgccgccgcctcgtcccgcttctcggctgaggctgcctgcgcggccaggcatgctgggtccatggcctcatgcctgctgctgcccatgggtgcctccgtgtggccctccctgggtcatgcatgccctggggtgaaactgaccacccaggcctacttgcaaggatggtgcntgcacnngcnnccaatgtaccctgcacttgcgcctgtcaacggngctcctggtggcctgagaagcagaagccgctgtaanggagcacctccccctgggcggccccggctgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggtttgcagagaagtgtggcctccagaatcgccgagggcttcagcgacactgcgctcatcatggtagacaacaccaagtttacgatggacttgnggtacgnctagnaccaagtgtacnancacctgaganngantgngtgcaaaaccnaacaagacatggaaatggcaagcaaggct

SEQ ID NO: 679721 - DNA, 696 bp, Homo sapiens
tccctgaggggtacgaagaagctaacaagctcttaaaactgggtgaaattctgaaactgcggctgtgacttcatacgtggtgaaaacactgtcttctggtgactaaatgacttcatactgtcacatgaaatctacaaacagtatttcaaagagttaattttcctgctagagactgcttaccaagttgctgctttacccaaaggcggccgacattgaacattggaggcagttagctatccaaggaccactgaacaaacggcatcactataaggtgggcccagtgctgtgtaagtctggaaattgttcacacattttaattttacaatttgatgtagacattcttaattaaaaccttttaatttctcacacgtgatgacaggtcgagcttgatgaacactatctgacagctatatggaaataccatgtatcgggaacagtgacatgatatcacagagactccgtactgatcacaatacactgtgtccccggtctaccggatttggaagcatcaccctcatcttcaccgacaacacggcaaaccggtgcgaaagagacatccggacaaactgacaccttcaatcaaaacatacaacgatgagagctaaatcttgtatagcacacggcaacgcgacaaatacgacacgagcacacatctcgccacgtccacactcacccctccctcctatctcgcgtatc

SEQ ID NO: 679722 - DNA, 587 bp, Homo sapiens
  misc_feature (208)..(208): n is a, c, g, or t
  misc_feature (504)..(504): n is a, c, g, or t
  misc_feature (511)..(511): n is a, c, g, or t
  misc_feature (516)..(516): n is a, c, g, or t
  misc_feature (528)..(528): n is a, c, g, or t
  misc_feature (530)..(530): n is a, c, g, or t
  misc_feature (540)..(541): n is a, c, g, or t
  misc_feature (544)..(544): n is a, c, g, or t
  misc_feature (547)..(547): n is a, c, g, or t
  misc_feature (558)..(558): n is a, c, g, or t
ccctcttaacggttgaagcgcctcgcggcctgtcgttttaaacagaactaaaacgcactcctaagggcctcctgcgtcactatgcgtcaccatgtcttgtgtgaaactgagcatgcatgcctactgggagatggtgctgcacggtgcccacagcccggactgctccgcaaatgggatctgtgtggccatgaagaaaaagacgtgtaanggagcacctccccctgggcggccccggctgcccaccacaccctcttcgtggactgcatccccctcttccacggcaccctggccctcgcccccatgctggaggtggctctcaccctgattgattcatggtgcaaagatcatagctacgtgattgctggttattatcaagctaatgagcgagtaaaggatgccagtccaaaccaggtttgcagagaagtgtggcctccagaatcgccgagggcttcagcgacactgcgctcatcatggtagacaacaccaagtttacgatggacttgnggtacgnctagnaccaagtgtacnancacctgaganngantgngtgcaaaaccnaacaagacatggaaatggcaagcaaggct

SEQ ID NO: 679723 - DNA, 770 bp, Homo sapiens
agtggggcggagggatattttagagttgcccctataaaatggggggccgttttccttcacaatataatacccccctccagaaagggtttatttttttaaaccaaaaattttggaattttaaccaaagaaaagaaaccttgtggtaattattcctggttgtccccacttttactaaaggacagtgctccaaattgataaagagcgagccaaatttctactccctttgtgctgtgtagaccccgctagtttcctgggcctattttaaaagctgtggtagaaatatggcccttagagaggaaaggcccgggtttcccttctggaaccatcatcttccaccagatgggcatatggcatgttagttgcctccaaatctcccctgcttcaaaagtcctccacctccacctccaacaaagagtaccttctttgagcatctctggagctttttcttcaatctgattctatctgtttttccctgctaggattcctcccagtttatggtccatgggaagattcctagtctagtctctgaatacatacatgtggatatatatgtatgaacatgggtgggcaaatatggatatggatgtatgcccacggatgtgtgtgtttctatcatttctaatgacctggaacaggggaaccctgtgtgtgcttagtcccccctcttgtaactctcagagcttagtttcaaataatgacataaaggagctgcccaaatggaaagcaaataaaaggcctataattaaaaccagtgtattatttcggctgta

SEQ ID NO: 679724 - DNA, 386 bp, Homo sapiens
gagagagatagagagagagagagagagcgagagagagagagacacttagagagacacccattctgccaccggtttttcacactgccctatgcctaacctccttcattctccccacacctgttacctacttttatctctccctccactcctttctttctttgttgcctacgcactttcttttactctttccctcccttgttgcccaccctgatctttctttttcctctcttcttgcatctggctcctccctttcctcatcactttgtctcctcctttacttctttttccccccttcctctttcggttttctcttttcatccattgtctcttatcttccccatccctctcctcttccatttcctttttctttctccctttccctcccc

SEQ ID NO: 679725 - DNA, 174 bp, Homo sapiens
cactgagtcgcgactgcttcagagagatgttcagatcattctggagagctgccacaaccagaacattcttggtaccatccttcatccaaatggcaacatcacagagtctccttctggaaggtaagggttcgcacgctgtgtggactctgtcgcattgcagattaacaccccggg

SEQ ID NO: 679726 - DNA, 140 bp, Homo sapiens
  misc_feature (28)..(28): n is a, c, g, or t
  misc_feature (104)..(104): n is a, c, g, or t
tgctgagcgagcccgccaaactcccctnccccccctcagtcctcgaccccccgcacctcgccccttccccaccccctcctccgcctcggtgcccggcgctgctnaggaccactatgaccatgagatccgcggtgttcaag

SEQ ID NO: 679727 - DNA, 168 bp, Homo sapiens
gtggtgagccaggctacaccctaagacaaacctacgccaaaatccatatcactatcatattcatcggcgtaaatctaactatctatacccacaacacttatctcggcctatcctggaatgccccgtacgtatactcgtgactcaccccagatagcatacactcacata

SEQ ID NO: 679728 - DNA, 817 bp, Homo sapiens
gtcagagcagtgtccatgtgcgtttctgtggcagcagtgccgtggggtgggtggggggtgcgtacggtggggcttgtggttaagatgtctctgcggtggtgttgtggggctggaggccgaagccagtgcacggcagataggaacactcacagagcgcatggaggaattactaccctattgacgaaaccaaggaatagccgcacgtctcctcacctgtgggacctccctgggagggtcagacaaaaaactaacaaagggcagcgagtcctcagtggctgcccgggagacaaccagatcagcatctcgggatctattcagactagcgccaaaaaagtctcactgcggacaagactcgccatcatgaccgcacctgtgggctcaggacactccttcccaatatggctcctcttcctctctttaaaattcaaagttcattcaaagctttggaaaacaaaaatatgacgcttaatgccacaaagtaaagacgggagtagtataactggaagtaaatatcattgaggcgcatttgaacatctgtgtaagaacccatcagaaagcgtagacgtcagtagacaatcaaagcaaggacccgagtggtgtagagctggggattgtgcctttcacatgaggcttgcgtataaatctttagggtcagagagtcttgtgacacagccccggtgcctaccaacatggcagcaaattacattgattggtgcctgtgcacctgaagtgaaccactccgtggaattgcctgaaattctccacaggggcaaagaccaggtcatctttcccgggcaagtcctacaagggcaagaag

SEQ ID NO: 679729 - DNA, 468 bp, Homo sapiens
tctcttagaggatccccgctgggcagcagacggtgcccagaaagagggtaaaaataagctcagaagatgcaaagtctgttcattttgagatccatgcacctcagtagtcctctagtgctatcaagtcctagtccagagagtaccttggttaaaccagagccgattggcataaccctccctggtatctcttcagatgtgccagagagtgcccacagaatccttcggaaggatactgtgggcagtggaagataaagtcctatttgcaactagcctttagttttcatgggaagagctttcacaggattcagcagatgcttcctgatccgacgattttgctgcctttgctttatattactattcttggaaaagctctcgctctaggacaagtttgatggatcgccaggctcttttaccagctcctatacattatctgggtgacagttattatgatttaccctaaacacatcg

SEQ ID NO: 679730 - DNA, 412 bp, Homo sapiens
gggggggagtgtggaggggggtgggcttttcccccaggttttttgggcccttttcctaagttggaaaagggggccagccccctccttaggggggggggggggggcttttgggcaaacccaaaaaccatggggattggggggggtggggggcacaaagggaagccccccccgcccctttctttaaaggggggttcccccaattggggggggtggggaggggaatggccccccccccgggggccgtgttgggtttatggggggcaagggcagccagggggggggggattttggggttggttccccggcgggggtggggggtttttggaatttttttccctttgaaatcctatttaagaattttgggggggttagcctttttttttttttaaaaaaaaaaaggcctttttcccca

SEQ ID NO: 679731 - DNA, 137 bp, Homo sapiens
gacggggggtgtctgcgtggtgaacgttggcgtcgcgacgtgcgcggttcgctgcgccttcgacccaggcgacgcatctgaatgtcatgccgaaacgggtttcgttggcgccgccgtacagctcgcccagaacacca

SEQ ID NO: 679732 - DNA, 1023 bp, Homo sapiens
ggggcatgcaagtagcccagcaccagttgtgcaaaagcatccagccatgtggcacagcatcaacagcaacagcagcatgcatagcatgcatgcaagcatggcagcatggcgcatggcagcatggcagcccaacttgggcacacagcacagcacagcacaacacagcacagcacagcaagcacagcagcaggcacccaacatcagttccaacaccagcaccgctccactccagatataccaatcatgtagcacactgtcatccttcacatgtgcttgtcatattccccaacagtgcacccaagcacatagcgcacaatcaccgcacgacacgccaccacacacagcatgtggcttgcacacgcagcatcgcctgtgggccaagcacactcaccacagatgcaacagcacacacaaggcacacagccatattcaggcattccaagggcccacagtgggcaaagccagcaatatttgggcacatgcaatatgataccgcaggcacagccttggcccagacacagacggaccaattctgacacgcacaaggtatcgaagcaccataccatccactgttcaacattaggcaagccttaggtgccagtcgcaaaagactccctatgacgggcaaattaggcaccacacaattgacaaattccaagcgacaccagtcactaggtgacaacacacaacgttgcaggggcacaagccaacctggatactcgcacacgcccacaacctgggtttacacaccttcaagctacactaggcagtcagaatttgggggacatttagcaccaacctggccacgcgcgggcaccgttggggacacaattatgaacgcccattacaccatggaggcaactaggttcgcccatcgcttccaaacgcatataaccttaatgggaatgaggcattggacccgccaattgtacagttacgtaattcgcccgtaaaaaaggagtgcctggaggatatggcacctacgaccacacgctccataggatcaactatcaacccaaaaga

SEQ ID NO: 679733 - DNA, 633 bp, Homo sapiens
aaaatgtatgtagtaattactacttttatattaaattatatgtaatttttaaaatatgccaatgcttaaataccatttgccagcaccttcttttaagttcagaaatagagtcagacataacctccaaaaagggaccaaataataggtcctgagtctgaaggagtggaagagctttacgattccaatggagacattcctgccgaaaacagaattcctagaattatcgaagctggttcacagggtcactctaggctttctaggcagatttccaggaggtacaactacgctccatcctgtattaccatcgtttcctcattcataaaatacaggtaataactgtacccacttcaaaggagagttatgaaatcatttaacatatacaaaacatttaaaatggtgcctggtaaatggaaagtactgtaaaagcttagctattttgtcgtcattcttttattactattatttttactactacaattattactatctttactactactactaccaccaccaccaatgctagcatcatttctaagactattgctactacagaaacaagcaggcaatagagtgtccctccctcatgtgaccattttccaaagagactatgtttgccaatttgacctcaaagaa

SEQ ID NO: 679734 - DNA, 974 bp, Homo sapiens
  misc_feature (944)..(944): n is a, c, g, or t
gagtcccaaaaagcctctcaggcacaacaaaccagcacagcaaggcagtgacaccaagattcccctcttcccgcggctcgccatgacgacccaggacagacttgcgcgcgtcaatgtgtattcctccatcatatgctgactcttgggcaactgcgtgcccgagatatttgtcaacaaaggatctggtttcggcgtggggtgaacactggcatgtgcacacacaccaaacgtcttgcaagtggctgtgccaatttcgcaacgtgccggtagcatctaagtacaggatcactgtggtaaagttacgtgggatgcttggagaccacaataccacagtggtgtgagtatggtctgactttcagcagaaacgtggaacagtgatcccaggtctggcaacagaaatcggaggtgtgaaagaccaggatgtgtcagaggtttgaaatggtgacaatttgatacctagcgttctcaggcagagcatcagggataacgaaggagggtggtagaatcaaagtcttcttacaaagagggagtgtattaagctgtggttgtgagtgtggacttggtgatgggtgctggactgcaatccgaatggtttcagggtgtcttggtcatgagggctggttgtggtggtaccaagatgagtgtgacaggggcagaatcaaaagttgacaggataacttgcagtggctaccggagatgggacttcaggtacttgctagtgtcactgtgggaccgatgggcgtcagttctcccacagtcggcgaccatctgacgttcagtaacttggtgcagtcagttcaatgccccgtgggtagcgtaataagcgatcccgggcccttggcaagagccactatggaggcgatcaccgggggggacccctcgggggggacatgggaaaaggcgcgggaaaacaggaacagggttttaggcaaaaagatatttantctccttacatcacccgactcgctgtgggg

SEQ ID NO: 679735 - DNA, 124 bp, Homo sapiens
ctagtttagaagtttcaatagcatgcagtagtacactctcagtgtctctggtcatctagtaaatataagttaaaaccacagtgaggcagctgactacatacctatggaaacttctaaaactagg

SEQ ID NO: 679736 - DNA, 322 bp, Homo sapiens
atacgaaggggggtgctttctagcgcctgctgatcggttgagatgatgaacaggtggcagtgatgtccctatcctcctccctgtatcccttcagttccatctctcctccaatcgttggggggggatgagtgcttcacaaggtcaaacaaacaatttttcagttgtaagtgcaatgacccgagtcctccacatgcccatgtgagctgtgtgctaaccttctcttcactgtgagaactgagtggtacttcagtgtccctccccctgtattgttgcaaggtaatgcggttgtatcagattaaacggagttgttttaatcaaccta

SEQ ID NO: 679737 - DNA, 364 bp, Homo sapiens
gagagaactagtatagggcagttgtttgcctttactgggcccttctgctgatagtgtcaaagatgttctgcttggggattacactggcgctacacgttggcaggacctgggacgctgcatatactgaggaacatgctagcaagcctgatcatgcccaaagacctaggtggagctgcttggtacagtcccatcatcagaggaagcagaacttttaagatgatgggacttatcttcatcatttcgacattagttaactacaccatgagctgctctagtagtggacatcccacatggctgcagaacgattggacactgccatgagtgggtacacataatgtcttgcttgcaggttacagcgctcctg

SEQ ID NO: 679738 - DNA, 155 bp, Homo sapiens
ctcaggatggattccctggttctctctaaagaggggctgcctttgtgcccaagaggtcttgcttgggcacagccaagagttgggagggcccggcccacagttacgcagtcctaaccacccagcccagggtgctcacgttaaccactcctgtggct

SEQ ID NO: 679739 - DNA, 996 bp, Homo sapiens
  misc_feature (224)..(224): n is a, c, g, or t
  misc_feature (703)..(703): n is a, c, g, or t
  misc_feature (776)..(776): n is a, c, g, or t
  misc_feature (804)..(804): n is a, c, g, or t
aattttaataaggttgtatgcatacagtgagcagccaaagtggtaggcttcctagatcgtgtctcaataggcactgaaatccaattcccctaaatcctaattccatttttctgtgtcatgttgcagctgcctcactctagtattctggatgtgatttggggtccaatgagatgcacttactaatatctgcagtgtacaatgcaggcagcagcagcgccagctanaagctgagctctggtagagttggattggatgtttacagtgacctacctcttcagtgtgatatttcctcacggtcatcagctacaggctgtgagacagcctgggggagacaggatagccatgtttcccactacctcccaaccactggctggtgcaccagcttcctggccttaggtcgcagccacagtgacgtgacctcctacaatccctggcaagctggaggagcagccctgcaaccaagcctgctctaagataaggctttctgtttactaacctggagctgctctattctttcacccttgttcccctttcagctgtctcgcgcaagtactaattttgccattaaatacgcattttgttttgcaaaatgagaagagcttataaatacttcaaattttctccgtctgtttcactcctttccatttctttctaaaattacagctaaaatattaactatacaaaatattgttgtatttatacnaaacaacaataccataaaataaaacactacatagttgaagccctctgaggatctctccatttcttccagcatnacgaatacctgaacttacgtctcttttncctttggcggtgctttaattttctacatctgaattttcttcccgttttacactttctgaatttccctgatacttttccgtgattgccttgccggttgtggacaccatggacggtaccccgagataagccgaaaacggggggttccacaatcggcttgatagataagggtccctaactggtctggaagggcag

SEQ ID NO: 679740 - DNA, 703 bp, Homo sapiens
ggtaaccggtgttgcccttcttcttctctctagctttgcttgttgcaccggtgtgatggacttggatgcacacgagagtgacgtggctcctcgccggagacattggggataagatcacactagaccctcggtgtggatcgcctgtgctcttatctctcccaccgtccgtcctaagatcatgtcacctaagtgactgagggaacagaatttgctgaacatgtgtagctgatgagtcagctgaaaattgtggcgactgacttcataccctatctggagacatactatgcacagactgccactctacgcgatacctatggtgaaacggctgactgctgtgcagaacatgatcctgagagaaatgaatgcttcttgcatcacatatatgacaacccatacctccctcgattggcgagaccaaaagtagatgtgatgcgcgctgcttttcatgacagtgaatagacgttgctgacatgatgcttatctgaaattgccagaggacgtccttacttttatgacccggaactccttctctttgctagaaggcataaagctgctgttacagaatgctgtcaagctgctgataaagctggctgcctgtggccaaactctatgatcttctgcatgtacggatggcttggactgcaaacagcacttaagaggggcagctccatcggggacttgcgcatgtgcttgctgcctggcc

SEQ ID NO: 679741 - DNA, 113 bp, Homo sapiens
tgatccttagcgcgacgcttccatcaagtgtctcacccttatccatgggcacacacattcctttaatgagggttaatggtctggtatgagagtctgatggaagcgtcgcgcat

SEQ ID NO: 679742 - DNA, 325 bp, Homo sapiens
  misc_feature (250)..(250): n is a, c, g, or t
  misc_feature (270)..(270): n is a, c, g, or t
  misc_feature (310)..(310): n is a, c, g, or t
tttttttgtgttcaaaatagttacaagatgtcagcagagagattgacatcattaactatattttatagatgaggaaactgaaattcagagtttctcaaattatactgctagtagagaatggacttgcactgtagaccagggtattcatttgagtccttgaaccttttaggcatcagggaaactccctaggaagtacatggaaatgtttgtgtattaaggactatggcagggtgcatttttttttttcccngaggaaaagggatacaaatncatgtggattttatccaggttttccaagggagtctgtggnccctaaaaccattac

SEQ ID NO: 679743 - DNA, 214 bp, Homo sapiens
ggattttttacttatttcggttttggaatccccccccagattcccgggcccctttggaaaaattctttattcctttgcctttttaaaaaaaaattttgtttcctatttaaagcccctggattaggccatgtttcgtgttcccccttatttgaaccctttgcccctcccaaaaaaaaaaaacctgtttgtgtttttaataaaactgatgtaggga

SEQ ID NO: 679744 - DNA, 145 bp, Homo sapiens
gtcaaagtgaagaaattcaatgaagcgcgtgacccggccaagtacttcattcgagatgagtttctgaggatcagcacttccagttgagattggcgtcactacttctaccctcatttcacctctcgctgtggacacttagaacata

SEQ ID NO: 679745 - DNA, 960 bp, Homo sapiens
  misc_feature (16)..(16): n is a, c, g, or t
  misc_feature (75)..(75): n is a, c, g, or t
  misc_feature (142)..(142): n is a, c, g, or t
  misc_feature (235)..(235): n is a, c, g, or t
  misc_feature (254)..(254): n is a, c, g, or t
  misc_feature (275)..(275): n is a, c, g, or t
  misc_feature (283)..(283): n is a, c, g, or t
  misc_feature (292)..(292): n is a, c, g, or t
  misc_feature (294)..(294): n is a, c, g, or t
  misc_feature (296)..(296): n is a, c, g, or t
  misc_feature (306)..(306): n is a, c, g, or t
  misc_feature (311)..(311): n is a, c, g, or t
  misc_feature (314)..(314): n is a, c, g, or t
  misc_feature (394)..(394): n is a, c, g, or t
  misc_feature (399)..(399): n is a, c, g, or t
  misc_feature (435)..(435): n is a, c, g, or t
  misc_feature (465)..(465): n is a, c, g, or t
  misc_feature (477)..(477): n is a, c, g, or t
  misc_feature (493)..(494): n is a, c, g, or t
  misc_feature (500)..(500): n is a, c, g, or t
  misc_feature (608)..(608): n is a, c, g, or t
  misc_feature (627)..(627): n is a, c, g, or t
  misc_feature (629)..(629): n is a, c, g, or t
  misc_feature (650)..(650): n is a, c, g, or t
  misc_feature (663)..(663): n is a, c, g, or t
  misc_feature (667)..(667): n is a, c, g, or t
  misc_feature (675)..(675): n is a, c, g, or t
  misc_feature (677)..(678): n is a, c, g, or t
  misc_feature (688)..(688): n is a, c, g, or t
  misc_feature (691)..(691): n is a, c, g, or t
  misc_feature (696)..(696): n is a, c, g, or t
  misc_feature (869)..(869): n is a, c, g, or t
  misc_feature (890)..(890): n is a, c, g, or t
  misc_feature (958)..(958): n is a, c, g, or t
cgaatttcccgaccancctgattcgctagatttttttaaggaaaagcttgaaagccaggacacaacgctgctgcntgctttgtgcagggtcttccggggctcagccctgagttggcatcgcctgcgcagggccttctggcgntcagccctgagctagtgtcacctgcacagggccctctggggctcagccctgagctggcgtcacctgtgcagggccctctgggctcagccctgngctggcctcacctggttcnccaccccgggatctcttgccntgccctcntgcccgccntncntcctgcctgngcagntcnttccctaggtacctctgtgctgcgtcccaccagcctgagcaagacgccctctcggggcctgtgccgcactagcctccctntcctntgtccccatagctggtttttcccaccaatcttcacntaacagttactttacaattaaactcaaagnaagctcttctcntcagcttggggcagcnnttggcntctgtctcgttttgggaaaccaaggtcaggaggccgttgcagacataaatctcggcgactcggccccgtctcctgagggtcctgctggtgaccggcctggaccttggncctacagccctggaggccncntgctgaccagtactgaccccngacctcagagagnactngcaggggngnntggatgactnaanacccntcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttntatgttcatgttagttttgcnccttctgtgtttttttttgaaccatatccatgttgctgacttttccaaataaaggttttccctccccnaa

SEQ ID NO: 679746 - DNA, 295 bp, Homo sapiens
ctgaggaggcctcagaatcatggcaggaggcaaaaggtacttcatacgtggtggtggcaagagaaaatgaggaagaagcaaaagcagaaacccctgataaacccatcagatctcatgagacttattcactatcatgagaatagtatgggaaagaccgccccccgtaattcaattacctgcccctgggacccttccacaacatgtggaaattatgggtgacacaattcaagttgagatttgggtgtggacacacagaaactgtatcacatatgttcaataaaataagtaaattcca

SEQ ID NO: 679747 - DNA, 220 bp, Homo sapiens
cgattcttgccctagtcagagactatagcagcccccagacgtgaaccaattggccatctccagaaagtttaacaaaacccgaccaggttgcccccttcactttcttacaacctcttccccttccccaggggctctgctcctcactccagatcatcctttagtttagagctgcgcagtgaagtggatatcactgaaggagataggacgccagactacactg

SEQ ID NO: 679748 - DNA, 110 bp, Homo sapiens
tgctggggtcttgtctggtttcttgtgctggatggacactgctcaaggccacactggtgggcagtggaagcctggctctgtgtggtagggatgtactgtgacacacaatg

SEQ ID NO: 679749 - DNA, 144 bp, Homo sapiens
tggggggggggaaaaaaaagtcctctccaggcttgcagaacccttgtgggtcagagttgtttacttttggtaattaatgtacctgaactctgctggaacgctctctcgcgtttcagaaagcgctgtttgggctattgtacagtc

SEQ ID NO: 679750 - DNA, 449 bp, Homo sapiens
  misc_feature (25)..(25): n is a, c, g, or t
aagcttggcacgaggctgaaggtcnaaaggccattaatcagttaaaacaagccttgcttaaagcaccagcccccagtctttctgtagggaagtcctttaatctttatgtatcataaaggaaaggaatgaccctgggagttttaattcaagttcaaggcccagctcaacagccagtaggttacttaagtagagagcttgacttggaggctaaaggatggccagcttgcctctgagcagttacagtagtggccctgctagtcccagaggccaccaagttaaccctggggaataacctgtttatgcctcacataaataatgtggcaggcttgctgtcctctaaagcgagtctctggctaacagacaggtggctcctcaagtatcagactttggtgctagagggaatcttgcagtccaggttaaaaacctgaccttggcctgatccccagaca

SEQ ID NO: 679751 - DNA, 447 bp, Homo sapiens
ctttacctcgttcggcaattccatggggacgagataaagtcggaaaatgacacaaggcaaagaatcgtctatacacgcctaatcatgagtagagacaaagcgacgtgttcaagcagtaagtcctctcaatgaaaataagaaggaactattacttttgtttggtttgggaaacggatgtggcagatatgttgctggaagtagcactgcgggaggttaagtttaactattcaggatggacgaagcaaggggcaaggtctgcagccataaacttagcaatgatagttccatggcaacagttctttggagtgattgggctgtttaccctagcatcattcaagccggcttatctagctctctgaaatattctgtaagctacctaaaagtttaaataaagtatctgtctgttaaactaactagggtgggtttaacagacaaggtagagccgag

SEQ ID NO: 679752 - DNA, 425 bp, Homo sapiens
agcaggatctccccagctactcaggaggcaggtatcagtctgcttgaactgagtactctgtatggcaaaggaactgatatattcatcctctgtaaatggtatcccaagaaagggaggcatccctgattctgtgggagaagcagccatatttaaccacaactacgttgcccatatactcaaagtagcaagcatacttctcagatatagcttcaactatattggagcttcacaaaaacaaaatctatagtatgctttggatttaatatgctttaactttttttttttgttttttttgaaatggagtctcgctttgtcgcccaggctggagtgcagtggcgcggatctcagctcaccacaagctccgcctcccaggttcacaccattctcctgcctcagcctcctgagtagctggggggtacccgagc

SEQ ID NO: 679753 - DNA, 1309 bp, Homo sapiens
  misc_feature (863)..(863): n is a, c, g, or t
agcggagtcgacggtgccaactctcgcactctgttcttccgccgctccgccgtcacgttgtctctgccggctcgcggatggatacgaagagatcgccgaagctggatcatatgacaaatggcatccggcatgtgcaaacgcttggtattcgctggtgagacgacgctccccgagccggtgtttccgttccagtccgtctggacgcaccctataacaaccatgggggtcaatgactggagtattggcgtacatgaacggagctccatacgatgtcgcagatcgaagagcaccaagaagactacgaccgtggagctattcgcatagtagccccttgcaaaagattatcgccagtattatgaaagaccaattggggcatccagatgcgatccccataacttgtgcgcacacagcagccatttgcgccatggagaggaaatacgtcgggtcatcctagccaagctcctattccttatccacattctggatgacgtaggccggaccgattgggaactcgccccagagtaagtgtatggcaatcgccaccaagattggccttggacttggaagccgaaggggcacacacacccctggagagcgctccgcgaaaggcacgcatatacaggtaaggacgcaaaggactgcaacctgcaggtactttacctgcttggtgacggacaccatatcagaaacaagcctcgcgggctccacatgcatatgcgtttgtgtcacacttcgccaagtggaccccgatgtaacctggtaacctcttcatagcgtaccatcttgcgcggtcggcaacacaatttagtggacactttgtcctatgagggatcttctgggcgacagaaccggggtgtgccacnccacaaccagtcgagatttgacttcccaaattcctgaatcctgagaagtgagagctgtaaccgccaccctttcacccccgacaaagtgtccctaatacccttggtctgattcctagtgagacttcttggggccttggagggccccgtggggagccctttggtaaccctggaccctctatccttgcctaattgtaaaatagaattccctttccactttgtaggcctcaacgggtctttacgaggttttgcaaccccaagcgcacacgggctgccggaaaccggggaggaaacatcctgtgttggccggctgtaaacagttccacaaggggtgaccgcacaatcccgtttgttggccttaccggttctgcctcacttgtgtgacttttccgcatcctatggcaaaaattgtggcgccacacccgaacccggggtttccgtttccctgc

SEQ ID NO: 679754 - DNA, 304 bp, Homo sapiens
ggggacttgcctttgtctacagtccatggtttctgtattggctcaagccttgaaatcttgaaacaagcctaaattaaaattttctcttagcttaagaaaaaaagttacatattgtcaagacccttatgtgtgtggtcattaaaaggtcttgatattagaggatacagcaaattgtttcttatccacacagctttgctttcagtgtctttgtggtggtttcgtagtcagtggtacacttcacactctccataggcatatatattgtggcacactgttatacacaggctgctgggtcatctataat

SEQ ID NO: 679755 - DNA, 787 bp, Homo sapiens
  misc_feature (673)..(673): n is a, c, g, or t
  misc_feature (690)..(690): n is a, c, g, or t
  misc_feature (718)..(718): n is a, c, g, or t
  misc_feature (747)..(747): n is a, c, g, or t
gtggcaaagttactactggaaaaacactataagtacaaagtttttggggttttatctttgctttagaagtggatgtgtacttcacctcttggctgtggaggaacttagttgccaggaaatttttttttttttttccaaacggagtttcgctcttgttggcccaggctggggagggcaatgggcaccgtctgggctcacttgcaacctccgcctcccggggttccagcgattctcctgcctcagccttccgagtagctgggattacaggctcctgccaccacgccgtggctaggaaatttttggtggttaatatgacatttgggattaatctccagtttcaacagtacttctttggtccataaatctcaggaatgtttaaggcagaaaacgggtttaacccgtgtggataatcagaaggagtgtgcttaaggattaatggcataatactatccttaaatggcaatcctaggtatctatagcatgaggtggccttagggagttggtggaagtgcccatgtttttccaagagtaaaattttaagattaaaattttatcctatatatagatttctagaaaactgggttgggggtcgcacagttaaagtgtgggatcactaaataaccatggcgggtaccgtttggtgtaaccttactcattcggatatatccctttnatggggaaggatctttngccagggtaactaaaacttttcagtccnacttcatgatgggaactgactgcacgttnattacatattaccaggtcagcactaattttatactttata

SEQ ID NO: 679756 - DNA, 274 bp, Homo sapiens
ggttttaagccaaaaagcaggtcccccatgggggtccctttttttgccctgccctttcagcttgtgagccacccgggggccttttttggtttgttgatatgctagatttgggccgttaatgggcttggtttttcagcctgaggggggttggtttttgggttcctgtagtcccaggggggaaaagcttttttaaaaatggccatgtttgggggggtgggggggggggtaaatttttagtttttggtaggggcgggaataaaaaaattccttctta

SEQ ID NO: 679757 - DNA, 115 bp, Homo sapiens
  misc_feature (31)..(31): n is a, c, g, or t
  misc_feature (60)..(60): n is a, c, g, or t
  misc_feature (83)..(83): n is a, c, g, or t
ctttcctcctgtccacaatggccccggctcnttctacccatccatgtttctacctccagnactggggggattgacgctgcctngggttcccagcattggcaaggacttcagaatg

SEQ ID NO: 679758 - DNA, 245 bp, Homo sapiens
  misc_feature (24)..(24): n is a, c, g, or t
  misc_feature (198)..(198): n is a, c, g, or t
gcgtacggacacacgcacggagangggagcttggcgcacaggctctgccccacactaggggcaagaagaggagcagacctgagaccccgcgagatggtcgcctcttccgccctgtcctcccacctatatctcgaacctcttggtcccgcataagctgattcctctactgggagtgttcttcactttctcatcctgggnaacccagaccagcccttcaagaatccacccttctccggtggcgtggt

SEQ ID NO: 679759 - DNA, 781 bp, Homo sapiens
  misc_feature (435)..(435): n is a, c, g, or t
gagaaaacactctggatcttatatggagaatgacattgattctcctgtccttgtacatgtacctgactggggtcattgtgtaagacttattattttatcctgaaaccttaaatatcaaacctctgcatctctgatcccttccttgttaaaagttaccagggttggccaggcgcggtggttcatgcctgtaatcccagcactatgggaggccgagacgggcggatcacgaggtcaggagactgagaccatcctggctaacacggtgaaaccccatctctactaaaaatacaaaaaccaaaaaaaattagccaggcgcattggctcatgtctgtaatcccagcactttgggaggtcggaggggtgggggaggatcaccgagtcaggagatcgaaaccatcctggccagcatgatttatccctatctctactgaaaantcaaaacattattcgagcatggtggtacaacgccttaggaccaactactcaggaggctgaggtatcgaaatcgctttaactcaggaggcatatgttgaaatgagtcaagtttgtgccaatgcacttctaccatggtgacagaagcaagaacctcttaataagggaagatgtgcccatgggttaaaaaaatccggttttaaagtccattgatgcaataggttgccttttagtacattatatgggaaccctaacttgtttaactggtttgaacgttttccggttaaagtaagttatcgtaataatcaacttactttcctcaaaggcatttgttaatgcttcttaatta

SEQ ID NO: 679760 - DNA, 856 bp, Homo sapiens
ggcgacacgtgagtctagggagcgagaaggagaaggagtgggatgctgctcgagtgcgatgcgagataacaccgtcgagctcgcgagacttgagagctctaggccccggaatggctgatggagcccgacagctcggatctgatgctgcggcccaggcccaggctgccttgagctgcgactgtgtgcctgcaggcctattgcccggatatccggtggatgcgagtgcatagatccagctgcagcatgcatcttcacgaactcggtggggaacgggatgcagatatatttaattatcattataccacttcacatttcacataaattccatttccaaactatccttccttttccattcaccacatatacttacatttacatttattatataatataaacgatgaagaaaaaaaaaatggagacatctgcgaatccccaaaagagaagcgaaaaagcgcagcagcacaccgaaaccatggagcacacaacaacctaccagcgcccggtacatacaacgaggaaaagtccatcgcgtgcacacctcgaaaagtgctcgaggaaagagataatgaggactaaataaacaggagatattttggaaaaacaaacaatctcgggggggaacaaattacaataagggatcttataaaagatagaaaaaggagttattacgagaaaaaataagggatgaggggagttaagaataaaaaaaaggctatagaatacaaaaaaatacagagggagcgcaattagaggtaagcgagaaaagtggagtgtaaaaaaaaataagggagatagaaaaaaaagaggtgagtatgggaaagatatagaaaggataagaattagagggatagaagag

SEQ ID NO: 679761 - DNA, 130 bp, Homo sapiens
tcgtaataatttagtatgctgggaatggaatagaacagatgtggttaatatcttctacttatacttctcatacaaagtgctgggtttacagacatgagccaccactcttggcctttatttacttattttt

SEQ ID NO: 679762 - DNA, 232 bp, Homo sapiens
cgggataacacttaacagatcaaaggaagcagtcccagagccatgcgggtggctctacctttccagatctttctcatggtgccaggtcacctccagaccagcgggccttttatttattattattatttttttggagacggagtctcactcggtcgcccaggcgggagtgcagtggtaccatctgggttcacggcaacctcggcctcccaggctcaagtgatggttcccggcg

SEQ ID NO: 679763 - DNA, 116 bp, Homo sapiens
taacctggtgacacacgggtgtcacgaccggcgctgttcttactggacgacgggtacggggggggacggggacgcctaccgttccacgtcgcccctgtatgggacttgtctcggga

SEQ ID NO: 679764 - DNA, 840 bp, Homo sapiens
  misc_feature (454)..(454): n is a, c, g, or t
tttcaagtgtcgcagtttccttataatgacccccatctccctgaaagggcaggtgccgcccgctaggtaatggcaaaagatgtctcatttgaaaatactgtgccctgatggaaggtttgtgcccaattgctggaaggcccccttcccaaggaaaagtactcgtcgagaaccagcgtttggggttcctccctcgcttgcagaggaactccacgttttccccgccagtgtgtgttttgacctcagtagttcacaccgtgcacagatcgtggaactcagcgagaaaggccaagtctctgtggcctcggaagacccagaattccagaaaattgggatgtctctgctatttggtgtgggcgttcccacaaaagtgggatgagactcatctggtggcagagagggctatttctcttcctctcacacgttttttgtgccccatgtccgtctgggacacatntcccaggtgagttgagacaacttgcgcagtctccatgagaagggtcctagagaggtgagacgtctctctcaccaggaggaagggagaataaatctcctgagatgtccccaagtaggggacacacccccggtgccttttatgcaaaaagtgtgcgcccctcccaggaatatgtatgggcggtgtgccccaccaaaagtatgttgtgtgtgccctccattgggggagtcaacttggccccgtaaaattttgctatccaaacagcaaaggggtcactcctttggggccagcggtccaagccaaagggctcccttgtggccttgggggcccaaggcacgccagggcctggttaccatttcattccattctccctcctgcaggagcaaggg

SEQ ID NO: 679765 - DNA, 144 bp, Homo sapiens
gtggacctgtcgtgtggcagcgacctcccggttcaattcttcagtccggctggtgcaccaggcttcagcatccttccggttctgctcgcgcatgccctcatattggcttcgcatgtcactcaggatcttggcgcgatcggtgcc

SEQ ID NO: 679766 - DNA, 941 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcaccctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctcacatgcgttacgggttgattggtacatggggatggagtctcatgctgccctaagctgagagctttactcccaattcac

SEQ ID NO: 679767 - DNA, 1012 bp, Homo sapiens
  misc_feature (25)..(25): n is a, c, g, or t
  misc_feature (959)..(960): n is a, c, g, or t
  misc_feature (962)..(962): n is a, c, g, or t
  misc_feature (965)..(967): n is a, c, g, or t
  misc_feature (977)..(977): n is a, c, g, or t
  misc_feature (979)..(979): n is a, c, g, or t
  misc_feature (984)..(986): n is a, c, g, or t
  misc_feature (991)..(991): n is a, c, g, or t
taggctaggtacgaggctggcgtgngaatcggccgagctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccagctgtgtggctgtcggggttggctcttcccaggaaatccctcttcccgatcaattgttcacagttcttcaaacaaatcccattccaatttgggcnntnggnnnggtgccggcnanccttnnnggggngccccgggcgggagggcccct

SEQ ID NO: 679768 - DNA, 771 bp, Homo sapiens
gagtatgggatatcgtcgaccacggccgtcgctgaccatgaaggacagcaaccactaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 679769 - DNA, 878 bp, Homo sapiens
cccacgcgtcgatgatgggctctctcctggctgccaccactgatgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaacaaaaaacaaaacaacaaaaaaaacaaacacacaacaaaaaaaaaagcaacacaaaaaaaaaaaacgcgagagaacacatacgcgggagcagcacacagcgaggggcacacgagggagacagcagagaaacggagggcagggcccacgacgtgagcgaacacgcggggacccacagcgcggaacccaaaacaggggagcggcccgacgagcagagaaaagcaggggcgacccgggacacct

SEQ ID NO: 679770 - DNA, 411 bp, Homo sapiens
atcagcgacccatgagggacctcaagagaccgagatcgcaataacgcgcaagaggatcgcaacaaaccggccagcggactctagagggataaatgctcaacgtataagagcgatcggctgtccttagaggtggaggcattccggctatgcatttgcggaggtctgcgacctactaaagacggtcagagtgtcgtcctctacctcttccatcctcatgaccgaggcccgtaacatggttcaggtaggtaacccttgcactgagcgagagtcgtagttccagtcaagcatcagtagagagggatcgtctacatcccgtggatcctcaaagtccagagaaccaaagcctcgttacagatcaatatctcgttatccgtgcatatgccttgaagaatcgtgccacgtactactgcc

SEQ ID NO: 679771 - DNA, 2012 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaa

SEQ ID NO: 679772 - DNA, 2259 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaacaaaaacaaaaaaaaaaaaaaaaaaacacaacaaaaacacaacaaaacaaaacaaaaaaaaaaccacggggagcccccagcggggggggcacacagcgctacacgggcgccgacgcggtaaaacagtggtctcagaagaccacctttgtgtacgaacgagtggatatagcggggtcccaaaaagggggacaacatatgtcagaaagcgcagaccgctatagcccacagcaaaaggt

SEQ ID NO: 679773 - DNA, 2489 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaacaaaaacaaaaaaaaaaaaaatcttcgcgagagggattcttttgttggggtgtggggagaaaaagggggtgtaatgaaaaggggcaagtgtgggtcacataaggctgtttcgctctgaaccaagtttttgttgttcaaaggtgggaaaaatctgcgcgcggtttcccttatatagggaggcggtcggtatttaatttccgaataaacccccggggtttacccctgtgctttttttgaagcatccttcggagtataagaagagacagcggggaagaagatacaacacgagagccataaaagacgaggggggatgaataataggcatagccgaacagcgactcaatacgtagaggagacacatatcgttgtcgagcaagaagaagacgatactatcacagaccaaacaaaaacccccggcactacaccagagtggaatgttatggcaggatacaagaaagctcacgac

SEQ ID NO: 679774 - DNA, 434 bp, Homo sapiens
acccaacaccgcaatctagttcatcaaagaagcgccggttctttcccatcagtactttgatgggggcaggcaccagcacatttggtggcaacacccccgttgactcaacagagaagatataatgatctcgaacccgggcaagcctcacaaccttctttagcttctcattccggaagatttctctgctgaaggtatccagccgggggttggcaactctggccacctttttaccttggacttcctgcacctcaataacaccaggtgagaagcacctgctcaactcctcagctgcctccccttccacgggctcaagcagggtgatgtctggcaggagcctgtaactggctgttgccactggtgaaaacttggcatggatctttgccaatgcccttgacacagtgcatgagcaagtcaatttcttggccaggccgcag

SEQ ID NO: 679775 - DNA, 2374 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaacaaaaacaaaaaaaaaaaaaacccgcgggggcttcttttgtgggggggggggaaaagaggggtgtaagagaaagggcccagtgtgggccattggcggtgtttccgcgtggacccgagctttcttttgtaccaaggggggaaaactcgtggcggggatcccacataagaggagaaggcggaataatgttgccgaaaaggcgcggggttaacccgtcgctatatgaacgcgggggggaaacaacacgggggaaataaaaacccgcactatagaggggccacaaaagggagagaccacagagcaccagcgaagacccagaacacaggagaagctgggcgcgcaacacaaacgac

SEQ ID NO: 679776 - DNA, 2285 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaaaaaaaaaaaaacaaaaacaaaaaaaaaaaaaacaaaaaacaaaacaacaaaaaaaacaaacacacaacaaaaaaaaaagcaacacaaaaaaaaaaaacgcgagagaacacatacgcgggagcagcacacagcgaggggcacacgagggagacagcagagaaacggagggcagggcccacgacgtgagcgaacacgcggggacccacagcgcggaacccaaaacaggggagcggcccgacgagcagagaaaagcaggggcgacccgggacacct

SEQ ID NO: 679777 - DNA, 210 bp, Homo sapiens
acagactataccgcagttgcctgtgcatacaccactttctactccaacctgacggagaacgcccgtggggtgaagctgctagctgccttgctggaggacgaaggcgggagtggacgacctctgttgcaggcagcaaagacccttgcggcagcagagtcagaactgctgcgcagtgcccaaccagccagtgctgagccccgtcagaacctg

SEQ ID NO: 679778 - DNA, 107 bp, Homo sapiens
tgtttatcgatgccacccacttggcttcccaaggtgctagcattacaggcatgagccaccacgcccagcctgttctattaaaaacatcttgacctttttttgtttaa

SEQ ID NO: 679779 - DNA, 2253 bp, Homo sapiens
tttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagcccctgcaggcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagaaacaaaaaacaaaacaacaaaaaaaacaaacacacaacaaaaaaaaaagcaacacaaaaaaaaaaaacgcgagagaacacatacgcgggagcagcacacagcgaggggcacacgagggagacagcagagaaacggagggcagggcccacgacgtgagcgaacacgcggggacccacagcgcggaacccaaaacaggggagcggcccgacgagcagagaaaagcaggggcgacccgggacacct

SEQ ID NO: 679780 - DNA, 464 bp, Homo sapiens
atataaaaatccccagatgtgttcttctggtttgggatttcttagggcaagatattcaagcactgtggctttcactgtcttatcaaagtatgcttctatcaaacatcccttgcttaaactgtttttgaatttgaggataatattgctagtaaaagaaacaattcttggctgggcacagtggctcacgcctgtaatcccaacacttggggaggctgaggcaggcggatcacctgaggtcaagagtttgagaccagctggccaacaataaaattagttgggcatagttgcgcacgcctgtaatcccagctactcagcaagctgaggcaggagaatcggttgaacccaggaggaggaggttgcagtgagctgagatcacgtcactgcactccagcctgggcgatagagtgagactcagtctttaaaacaaacagacaaacaaacaaacaccaagaaaaaaaaaccag

SEQ ID NO: 679781 - DNA, 214 bp, Homo sapiens
  misc_feature (206)..(206): n is a, c, g, or t
agttttgtggtctggtaattttgggtccaggttacaggatgatttaaatcatatccccatctggaaatacctggacaactggacattaactggagtaaccactaacaccactgaattttcaaagctcggacagaaaagtcagctgaagtggttaatcatggtgttacaactagacaaatagtcctgcttcaattcttgcaggtagnctaaactc

SEQ ID NO: 679782 - DNA, 127 bp, Homo sapiens
  misc_feature (1)..(1): n is a, c, g, or t
ncagtggggcaattttggacaatgggggcaccctgcatccagcaatgccgcgatgtgtgaagaaggcttcgggttgtaaggcacttttgtccggaaagaaatcgcacttactaatattaggtgcgga

SEQ ID NO: 679783 - DNA, 205 bp, Homo sapiens
gcttaaacatcccattttgacacttgtcttgcagttagtttgacattttgtagttaatgattccaaattggtttagttgggccatctcatttttcacttcctgtaaaccactccatagatttgtcttttttcaagaaattagttttctttcctttatttgattgatggtcattgactactaaaatcaactatgcattttaagata

SEQ ID NO: 679784 - DNA, 637 bp, Homo sapiens
gcttgcatccagccaaaaagaatgatgccagcgtcatcaacgcgtatttacgccacggtgagcaggtacaatttttcctcagttttcactgtccggtgccgttttgtgccggctgcggactgagctgatacctgtagatcggcggtgccggccaggtaatttcgcccggatggatcacggtcgacgccggcgaattaccacattcatcaaagatcaacagtgatagttgccgtctttctctttgcacaataatgtttcaggcagattaatcgatggtttgtgacgtagagctgtgaggactgcgtctggcagactggccggaatatcgttataagcaatcacttggacaccatttgccgtcactgaagatttcacccggcacggtgtattcacagttgccgccgtttgggcgcgtgcctaggtcgacaatcacaactgcccgccttcatggagtccgaaccgatttcacgggtaattagcttcggcgctggttgcctggaataagcgcggtggtgacaatgatatcgacctcttttggcgtgggcggcaaacgagttccatttccgcttgatgaaggcgtgcgacatcactttggctatagtcatcgccgctgccagcgttgctctttaaaatccag

SEQ ID NO: 679785 - DNA, 757 bp, Homo sapiens
  misc_feature (17)..(17): n is a, c, g, or t
  misc_feature (178)..(178): n is a, c, g, or t
  misc_feature (180)..(181): n is a, c, g, or t
  misc_feature (196)..(197): n is a, c, g, or t
  misc_feature (209)..(210): n is a, c, g, or t
  misc_feature (212)..(212): n is a, c, g, or t
  misc_feature (217)..(217): n is a, c, g, or t
  misc_feature (229)..(231): n is a, c, g, or t
  misc_feature (319)..(319): n is a, c, g, or t
  misc_feature (358)..(358): n is a, c, g, or t
  misc_feature (371)..(371): n is a, c, g, or t
  misc_feature (385)..(385): n is a, c, g, or t
  misc_feature (404)..(404): n is a, c, g, or t
  misc_feature (468)..(468): n is a, c, g, or t
  misc_feature (470)..(470): n is a, c, g, or t
  misc_feature (478)..(478): n is a, c, g, or t
  misc_feature (546)..(546): n is a, c, g, or t
  misc_feature (749)..(749): n is a, c, g, or t
ctccacttgggtgcganaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgatntnnccgccgctcttccannttcccaatgccnncntccanttcccatacttnnncccaccctaccagcctatctacccccagtcgcaagatccttactcccacgtcaacgacccctacagcctgaaccccctgcacgcccanccgcaaccgcagcacccaggctggcccggccagaggcanagccaggagtctnggctcctgcacacncaccgggggactgcctcanaaactaatcggagcctgaaaatcattcgacatgggacatacaaagcggcacgaggacctcctananttttttanacgcactcaactcaggactcggagacctctcgatccactccttacctcacgccatcgaggaggtcccncatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaatcttctgttcagttccgggtcgcctctcgctcctcagctccacctcgaagtacaangtcacggt

SEQ ID NO: 679786 - DNA, 1361 bp, Homo sapiens
ggacgcttctggtttccgggtcggttctggcgaggtctggagctgctccgacttccatgaggagactgctgtgtcgacgtgcgtatgcaacgcagcgggggtactctgggcgagcccgtgacctccctgaaccctcattgttcagaagagcctgagtgggccttgagggcggggcccaggtaatggctggcgggccgtgtgggcccgtgaatcgtcacgcaccatccgtcgtgcgagtcatccatctgacaaaagaagggattccaaatgcgctcgccaggtcttggacaacgaatttcacgggggacctcttaagatgggctaagcctagtccttcctgtttcacaccacgtcgagttccacaccgctaagactcctaagtagttactatatgctggaacttcctagagcgtacgtgagggatgtgcaggcgcaatatcgggaaaggatagaaaatattcggcacgcaaagattcatttggccatggagtttggccgtgggtgcaattccaggcaatgcaaaagtaggtggggaggtcaatgaggtataggcagaagagatgttttgaggacaatcagggggtggctggcctgggagagggggaacgatcatttcacgtagagtgaatggttaggtagatggcacagtaatggagaattgtttgacacagataagggcgttcttggtcgaggctgagtgatgtgcgtgtaatggacatgagtgaagaagaacagaggggaagtgtacccaggtgggggcagtaagagaatgtagcttgcctttggtgataatataacgaagtcctaaagagaagtcgttggaaatcggggcggagtttaggagcgggaacattgatgagtcacacaggggaatgtcaatggcgggaaggtcgtaatgtcacttaaggataatttggatttactaattaaacaaggacgaacaaggaccctaaggttgctgggaaaaatttttattcgattaaaaatgccgcgccatgaggtgaacattgttatatcgccggagaataccgccgaagttggaagccgaggattccacggagtccagaatccagtgacaatagactgagagaaatgacttcgttgcaggaagagcaattgtttctcgatgggctagatcttggcagggttgtcagggaatcgaagtggatccgcaatgtttgaaagagcttgcttaggaagaaggacagggacttgggaagggttgttctttgctttgggtgtgcccgcagaaggaagaggaacatggcgcattggaagtggtttgccgagagggagggagggctctttgggagataggcctcggatagtgagagaaaattgggggcgtggaattgagaggg

SEQ ID NO: 679787 - DNA, 567 bp, Homo sapiens
  misc_feature (82)..(82): n is a, c, g, or t
caggtttttttcctccccagcttattcatcacaggctggttagaggtgtgctttctccaatctgagacacccacgacttcanaacgccaagaatccttgcagttgatgtttcctaaacttctttaggattttgcagtatccattcattttcagatctacttgccttttctctggttcattattggtattctttaggaaataaacccagcatctgaaaatatttccctctgtggtgtttcattacatgaaactacacgtgatacacagaccctgggcttttttatttctcacgttttgcagctagtgtaaataaagaagtcactaggcgtcgggccccccaacgccaagacccgagcccctgtccgaaaattgagggctttttcggttggttggttgaagaaagcagcaccgtcaccacccaggtggcctcgctgcttacaccaaaggcgaactggggataatgggaacagtcaggccagggccccacttggcaggcgtgttgtgtaacagtcgcgcctggaagtgagcagcttcgcccgcaaaggtgccgcgtcccgcggcggccgc

SEQ ID NO: 679788 - DNA, 107 bp, Homo sapiens
  misc_feature (12)..(12): n is a, c, g, or t
ctagctcggtanccccctgaaatggtcaaggtataagtcttggactcaacgttggaaggtctccacctttgctatggaagtcaaacgatctttctttgaaatgaaaa

SEQ ID NO: 679789 - DNA, 386 bp, Homo sapiens
atcatctgggtggatcttcaaagatgagtgaaatacagttctcaaacagatacagaaacacacacacgacagcacgacacagatataaaaacatgactcacatagagtgactacatgtcaaagatttatgtgactcattagtgagggacctagcaagattgtaaatctgattttgtgcaagtatatgttctcttagttatggtactaggtggtaggtatgaaggagatggtcattatagaatacttgctgatgtgtctagggatgagggcttataacatctaacttgagtctcatgtagttctgcaataaaagaagctatagtacttaattatgtgtgggtatgggacagggatagataaagcatatgtggcctcgataaacacag

SEQ ID NO: 679790 - DNA, 528 bp, Homo sapiens
tgggggtaaaaattctcggtgtttttttttccccgcgggtaatttttttaggggttccccttttttctctcttataaaaagtgagaaaaaaatatttcccaaagtgtatataaaagggggtctctccgtggagccctctttctcttttctattttctctctctctctccgcgtgtacacaatagagggtgtggcttctctcttatatgagcgcgccgcacattactctctctctgtgtgtaggtctctgtgtcagcgtgtagtagggcgtctcacacacacatatctctcttcacagcctctctatactaaacacacactatctcttctgtgtgtgtgtggtgtctctctatccctctcttatctctctgcacgagaaaagagagtagtgagagatgtagtagcgtctcgcgcgcacacacacacacacaacaccaccctctactactcgtgtgtcgtctcgtcacaggatcacaccactacgtcggcgcgcgactctcatctctctctccgcgtgtgagatactctc

SEQ ID NO: 679791 - DNA, 136 bp, Homo sapiens
catcgagctcggcccgaatttagaatctcaggtttaggtacgagtcctatagtctagaaataagagggtttgaacctctattttttactctatcaaagtaactcttttatcagacatatttctatgattagtgggg

SEQ ID NO: 679792 - DNA, 433 bp, Homo sapiens
agcaatgtactgacttttcctctctagctcagatacatcttcttccaggagaaggctgtttggtctgtgttgaaaatctgttgattagtgtagccactttcgttaattatcttagctggtcttctgggtaactgcgtgcagcttctacgtcaaccctgtcgcttttatggtatggagacgtcttcgttccataaggctcatgaacagacctctgctactgtcggacttttctcctgcagctttcttacgtctattagcctacatagaatttaagggttagggctttactctggattcagccttggcttaagggagtgttgtggctagttcgattgtctatccagaccactcaaaattcctccatatcaacaggctgttttacttccttatcacttgtgtgtacaattttaatttccttcaagactttttcttt

SEQ ID NO: 679793 - DNA, 338 bp, Homo sapiens
  misc_feature (24)..(24): n is a, c, g, or t
acaatctgtgcctcaaaagctgtntataaaaaaaatatttaacaaagtaccacttgactggggcacggtagcaacacttggggaggctgaggcaggctgatcacttgaagtcaagagtttgagactgggcaggtgctgtggctcatacctgtaatcccagcacttggggaggctgaggtgggtggatcacctgaggtcaggagttcgagactagcctgaccaacgtagagaaaccccgtctctactgaaaatacaaaaaaaattagccgggtgtagtggtgcatgcctgtaattccagttacttgggaggctgaggcaggagaattacttgaacctgg

SEQ ID NO: 679794 - DNA, 622 bp, Homo sapiens
  misc_feature (16)..(16): n is a, c, g, or t
  misc_feature (28)..(28): n is a, c, g, or t
tgggactcggcccccntcagtataaaancaagtagtcgatgtctatactatccacaatgtgatagcatgaacatgatctcgcgaagtctattagcgtatactgtagcttcaatagacattgtgctttagataatgcagttagacacgatgggcatagtctttatcatagagattcacacatccctgattatataagtcgtagcatgtgtaatcacatgtaagcacgttgtcagctcatacattgaagtaattgtagttgttaatatgcccctactgtctaggctttaaacagattagatcattcatatatcctaatcgccatgccttttttcacgtcgatggtctgggccatcatatactttgtatgccatatggactgtccccaagtagttgcatctgttatgagcaagtgatcatgtctgaattcagcccggtaacacagttcacaacatttggttcacgttttagtacttaaggcagtgcagtgcaggcatagttcatgcttacatttcaatgacacattatagatggcgcagtggttaatctatgtatgtccagccatttgcaagtgccatgagctacgatcacactcgatcgagagagcacagtcagttcagtcaat

SEQ ID NO: 679795 - DNA, 612 bp, Homo sapiens
taatcccagcgactttccagcaggccgcaggcggcacggcatctacgcagggatcaggcagcatcaagcaccatcctgggctcaaccatggtgcaacaccccaatctctgggtggagtggccgcagccacccatgtaggtccccccagagatcacgtcccaaggccaggcgcctgcaggcgcccaagggcagccaacatgcaaccggttgcacaccccctgtggtggacagggttgcggccagacctattggcgcccaggtgtgcaaggcggcccgccacgccactgggcgttcggccccaacttgcgcataacttttaccccaaaggcccctatggggcgaccggaaaaccacaagggcaacgggaacgcgaaacgcgggaccaacttccacccgggcggccccaaagaaagagccgccccacgtccagcagcacgcaagcacgcaacaagaagcacacacaacgcaagcagacagcactcagaagcaacaccgcacgaccccaacacacaccagcccagattggtgcggagagacgaagcgaaagcccccgccgcggacagcactcggctgcgagcaggcacccccgcgaacgcgcaagaacgaaagaca

SEQ ID NO: 679796 - DNA, 218 bp, Homo sapiens
  misc_feature (8)..(8): n is a, c, g, or t
  misc_feature (20)..(20): n is a, c, g, or t
  misc_feature (24)..(24): n is a, c, g, or t
  misc_feature (60)..(60): n is a, c, g, or t
  misc_feature (91)..(91): n is a, c, g, or t
  misc_feature (101)..(101): n is a, c, g, or t
  misc_feature (123)..(123): n is a, c, g, or t
  misc_feature (132)..(132): n is a, c, g, or t
  misc_feature (139)..(139): n is a, c, g, or t
  misc_feature (142)..(143): n is a, c, g, or t
  misc_feature (154)..(154): n is a, c, g, or t
  misc_feature (157)..(158): n is a, c, g, or t
  misc_feature (167)..(167): n is a, c, g, or t
  misc_feature (178)..(178): n is a, c, g, or t
ctcgtgcnaattcggcagangctnaaatcccctagaagtcccactccctaaacacatccntattactcgcatcaggagtatcaatcacctnagctcaccanagtctaatagaaaacaaccganaccaaatanttcaagnacnncttattacaanctnnacctggganctctattttanccctcctatcaaagcctcatgagtaacttcgaagtactcc

SEQ ID NO: 679797 - DNA, 174 bp, Homo sapiens
aaatctgttcgcttcattcattgccccacaatcctaggcctaccagccgcagtactgatcatctatttcccctctattgatccacacctcaaatatctcatcaacaccgactaatcacaccacaatgactatcaactacctcaaacaaatgatacacaacacactaaggacgac

SEQ ID NO: 679798 - DNA, 263 bp, Homo sapiens
ctagaggatcccctgtgggagagggggtctcagcatgggtcctcaggcacccagctctgagcagtttctgaacataatcccaggagcctcatttccctcgcaggccttgtccagtggatcatgtaaaagtctgggggactggggcgcgggggctcatgtttgggaatcccagcatcttggggacggtggacggcgggagcatcattgtgagcccagaaagttaaagaccatgctgggccaaggtgggtgagacccgtgtctcc

SEQ ID NO: 679799 - DNA, 1408 bp, Homo sapiens
gcgtccgcttcttgtgctgcagtccagcggccagatggcttctacctgctctgtccaaacccaccatctcccccagacacaggccccgtagaaagctagtcggatcactggagcaccgggactccccattggaaccagatgccccgtgcccatgcgcaggcctaaaatgctggttatcagtggaggtgatggctatgaggactttcgattcatcagctagaggagtgcggctaaccacgcaagtcgagactcgtgggtgctcgagacgttacacgtgacgaggagacgcatgcacactcctggtggagcggtgtagacccttgtcatgcactgttgggcgccgaaggaccatcagccacggaccacgactcgtgccttgtccagtccgtgccttagccctttctccacgtagactcactacagacggcaagatcgtctatgcagcgcgatgggaccgtattcgcaaggccaggggatgcacttgcaatgattgctcatgacgttggcgacttcgtgcgctctgatcattcggcagtagaagatagattccttagagtgacaaaggacaccaacatggagacatcctcagatgaccattggagactgcttcccacagaacccgcgtcgtgcgcgttggacacccggggttgcctttcacatagttcaattgacgtcgcgaattggggagggaccaattgttggtacctgaacaacatgcgagatctccaaaggataaccccttgcaaagttcgttttcgggtaaccgaccaatggagcgagccaaggcatttgaaggtctcttatggtagaactctcggcgaacatgggtgtgtcgctcgccaggggaacgtggagccccacattgcgttagctgaaaattacttcttcgctcgacgcagatgcttttgtcccatttcgcattggagcatggcctcgaggaccattgggcattttggacgggaaagtcttacgggcgaaattggttaccccgccttgtttccaccatgatagccggtgtgatgtgggcacccagattggttaccacgtgttacagccgcagggacacgatcgattcgagatgtagggcccgttggatatcggtgtggtgcgaaaccatggcccagtttgagtcgattccttaactaagtgagggccgggagcaagccactacctcgaaggaaagtgtgcgagaggacagtaacgtggcctgcgctgaggcgcgggtgagcgcgagcccgtgtgttgacccactgtgtgccgcggatgcctcatatgtctgggcgtgtgaggccacccccggggggctggctttgaacgggtcattttcacccttagtacgcttgggtgtgcaacttggtacacgttctgagcgcaaatgcgcctatggtatctagagagacccacctac

SEQ ID NO: 679800 - DNA, 154 bp, Homo sapiens
tgtggcctgtgccttggctctcctttccctggtgtttcatcattatggacccccacagctctccttcagtcacatctcctgctccttgccgagtgcattgctccatctcatttccttttgtattcctggccctacgtgtccggccgtgttcttc

SEQ ID NO: 679801 - DNA, 429 bp, Homo sapiens
gtgtgggaccccggaaattcggccataatgcccggaaattttaggaataattgggccggataaggtttaccttaaaataaaggccaatggaaagggctggaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaacacagactccctccaagagccacctccttaaaacagcccccaccttccagcgccccctcacccgtctcccccaaaacagaccccctatccaacatcaggctccgttttgtaaccctgtgcctccccctatccattaaccacgtcccaaccaatatccactgccaccctggcgccttcactcctggatcccaccccctgcccttgccaattccaaaaagtcccctcccc

SEQ ID NO: 679802 - DNA, 101 bp, Homo sapiens
ctcggagttcgcaacacccagacccaaaccctgacatgctctggggcgagagaggagccaggagctgagcgcgccgggggctacttcgcctccggctcggt

SEQ ID NO: 679803 - DNA, 483 bp, Homo sapiens
taggagactaggataaggactacatttattaagacggtcagattaccatatttaagtcgtcgataatggctggtgaagtaggtgggattattagttaccatattacagatgaggcggtattctagctgtcatgctacttcctcgtgtctatgatgttcttctcccttgtatctttccctgctttgaggctattataaagatattctcctgagtcttctaaatagcttgaacgtttgacagtatttcagaagtgggtcttgggtatatctggaattaattttatatatagtataagatcggaatctagtcctaatttggccccatatatggaaagacatttatttcaagagtcaatttattgtcattgctattcttctgcaacttcggcaggtatgagatttgtgtcagattctctgtatgctttgagtactgcttcccggaagccaatatgggagttggtttgggtatagatatgtattgaga

SEQ ID NO: 679804 - DNA, 356 bp, Homo sapiens
tgtggtggctcatgcctgttatctcagtactttgagaggccgaggtagacagattacctgaggtcaggaattcaagaccagcctggccaacatggcaaaactccatctctacaaaaaatacaaaaatagccaggtgtggtggcaggcgcctgtaatcccagatactctggaggctgaggcaggggaagtgcttgaacccgggaggcagaggttgcggtgagccgagatcacaccactgcactccagcctgggtaacagagaaagactccatcgcaaaaaacacaaataaccggaagccttgacagactgatataattatgtaattaggccgtgcgccgtggctcacgcctattccc

SEQ ID NO: 679805 - DNA, 125 bp, Homo sapiens
  misc_feature (40)..(40): n is a, c, g, or t
  misc_feature (87)..(87): n is a, c, g, or t
  misc_feature (105)..(105): n is a, c, g, or t
atctaccacctcacccctcactcgaagcagcagcaagttntccagcctgcgccagaggaagacccagagctgcctcaagagcagccnccagaagactctgctggnaggggagactgtggacctct

SEQ ID NO: 679806 - DNA, 435 bp, Homo sapiens
tagaacctggcgagcaccatttctcggacgctaaagaccgtgtcggagcttcagtcatctccaccacacaggtacagcagcgcttactggtattcgcgcttagtgtcttgctggatataatagtacagggacttgccgtactttctcttgaattcagacctaattttcaacatgtccactatcactagcgggagaccatgattctgatcaggaccttatctcgcgtccccttgcccttcatggatgtcatatcaaccgatcagcaaaatacaggggcttgttttgaatgcacttgaaccaagagttcaggacaagcattttccaggtctccgtttaacctcttgcctgatgcgttccaatatgtcataagggctgtatctcttgtacctatcaaatactttctcggaggtggggcacgctccgcacccttggaga

SEQ ID NO: 679807 - DNA, 476 bp, Homo sapiens
  misc_feature (384)..(385): n is a, c, g, or t
ggtgcgacacgccggacggcagtggcccggacgaccgccctaccgttgaggacatggcttcaagcctggacgaagtggcccgggtgatccgcgacgaacagcccgacatcctgctgttgcaggaagtcgacgaaggcgccaagccgtccagctaccaggaccaactggccttgctccaggaacgcctggccgacctctacccgtgcagcgcccaggccttcgactggaaagccgacttcgtgcccgacctgcacatcttcggcagcgtcggtcgcaagctggtgaccatgagccgctatcagatcgaacacgccgagcgcctgcaattgcccgtggcccgcgccaacctgatcagccgtcaattccaggctaaacccgcgttanngctgacctacctgccgttgagcgacggcggccagctggccgtactcaatacccgcctggacggcacggcccccgggcacaacgcggtgctg

SEQ ID NO: 679808 - DNA, 207 bp, Homo sapiens
gcgatacgtccaaagcattcaggtttactcacgtcatccagcagagcatggaaagtcaaatttcctgaactgctatgtgtctgggtcatcatccatcacgacattgaagattgactatactagaagaatggagagagtaatagaaaaacgtggagcattcacgacttgtctttcagacaaggacctggtctttctcatctacttgta

SEQ ID NO: 679809 - DNA, 728 bp, Homo sapiens
  misc_feature (16)..(16): n is a, c, g, or t
  misc_feature (50)..(50): n is a, c, g, or t
  misc_feature (581)..(581): n is a, c, g, or t
agggttcgcgttcaangagtttagcctcatgatgtatgcacttcgactcnatcggatcacccacccatgtgccgctcccagaccttaggagttactgggaaatacaagttatcaggccgctgtggagtgcggtttctaaaagtaggattaatacagaagaggcggccccaaccctgcctctgggagcaaaaccaaaaagagccacagccacagcagagaattcagaaaagccacctgcacaaaaggccagagcagccaagggaagctgggggcccaggccagtgagccctggggccaggtatcaggcccctcaaagagcagaaaacagattttttaggtgaagccgacggtctgaggaaatgagatgagctcacacacctgatgacagcttccctcagcaattccacccgcctccacaggactcagaccaagtcctggtgttagaataaatcactaggctacaagaaagctcaaacccccacaggttctagcactcctagccaccaacacaactctgttcaagatccacctatcaacaggggtggggtgggaaggcggtccccatcctcaggccattcttnctccgtgggttgcagccagggtttcctgtgggtcgtcttgtgcacgtcacggtcctgcccacagcataaaaacatacaggtgtgagggagatgagcaagacagctagctttttacaagaaccaggaaggcttggtgcttcgacttat

SEQ ID NO: 679810 - DNA, 186 bp, Homo sapiens
tcgtggtcgccaactgaaaacctcagacgaaattgcagcggaaacttaccctcgcagcgggcagcgcgcgagatgggcgttgcttccctgccccacaaaactgtgtacgaggacaaactccgtggcagtccaactcagtgtttcgatcacgtgctcttccacgagttgtctgtcgtaaagcagcgt

SEQ ID NO: 679811 - DNA, 130 bp, Homo sapiens
aagcgtgccatctctttgaaagtgagcggcacagtgataatccattttattcattgtaaccccgcagggtatgtattccgcctttaataataaaagggattaatgctttaatcaaaatggaaatccaaaa

SEQ ID NO: 679812 - DNA, 151 bp, Homo sapiens
acgttctcgtagatgacggcacagtcgatggctgacggttgtcacatctcggacacagtagatgccggaagatgtagatcattcctactatctctccaggaagctgcaccctgaccggtgaaatcgtgggtaccgaagctacgaaattcgt

SEQ ID NO: 679813 - DNA, 346 bp, Homo sapiens
  misc_feature (24)..(24): n is a, c, g, or t
  misc_feature (34)..(34): n is a, c, g, or t
  misc_feature (47)..(47): n is a, c, g, or t
  misc_feature (51)..(51): n is a, c, g, or t
  misc_feature (100)..(100): n is a, c, g, or t
  misc_feature (103)..(103): n is a, c, g, or t
  misc_feature (113)..(113): n is a, c, g, or t
  misc_feature (152)..(152): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (214)..(214): n is a, c, g, or t
  misc_feature (228)..(228): n is a, c, g, or t
  misc_feature (266)..(266): n is a, c, g, or t
  misc_feature (270)..(270): n is a, c, g, or t
  misc_feature (292)..(292): n is a, c, g, or t
aaagggccccgcccacggggcccngcccaccccnggccaaatccccncccntttggaagtgaaggcccagggattcctccaacaaacaagggagggaggnatnccgttggtgntcagaaaaagttagtcccttaggtgggggaaggcaggantcccgcttgaaaaaaaaaggagggggatatgccccccctgccccatttgcangancctnaanatccagttcaagtnccatcctgccaggggcccccaaattgtggggttgggangccnggcctttgtgtccaaaaagggnccctcctggggttttttttttgattttttttaaaaaagggggctatccccccca

SEQ ID NO: 679814 - DNA, 1146 bp, Homo sapiens
gaccaccagtgagccccaccttcaccagccccagcccgcttcactgcccggggtgggcgatgtcttcactcccagatgtggtgtgccatctcgcctggtggccgaggaggagggaggccccctcctcaagtttattgcccagtgctggagccctccagcacaatgtctctggctcccaagaaacctcccacaggcccttatgccaccaagtaatggagcctttgaacgagaagtttgatcccagtggcctctgtcccctgtgtgcgctgcggaggcagcaatggaggtagcaatgtgggcctggacagatgggtgagcgaccccgcaaggaggcgaccatgggcagggctcagcagcatgtgataacacgcctcgatttcctggaggctgcacagccaggaacgggagcaatgccagcaagggggtcatgacgggcaaagccctcgcctaacccattccagcactccgcatccttggaccttgaaggaggccctcacaaacacgtcacagatgggcacccaagcaccgtcgaccgggcagactgccaagtactccatgatctgtccacaccagcaactcagaccaagccaatgaggcatgggcagactgcatcagaaagcagtgacttcacccagtgcagcgccggaggggacaaaagaggcagcccccaccaagtactgctgcacaaccaaggcatgcgggacactcctgagcgaaggtggaagcgtggacggccgcagccagcgtaacaccagccaatgtacggaggagaaccagagcagagacgccacgaatatgcatcacaccggacgccacgaacagagcactgaggaccgcggactggcaacgggaagcaacacggagccacaggcacaccgcgagaccacaggctgcccaagcgggccacaagcacatgtaaagaaggcggaggaggggagacagagagtgcaggaggggggacagggaggaggggacagacggagagagagacggcgagagagaacacaaggactaccgagacgagaaaggacaggagagacgagacgagaacccacgacgacagaacgagaaaatcgcgaggacagaaaaacacgccgaggggagaacacgagagggacagaagcaccaagggagcgatcgagagga

SEQ ID NO: 679815 - DNA, 343 bp, Homo sapiens
tccctgttcaaggaagtctcactctgttgcccaggctagagtgcaggggggcaatctcggctcactgcaatctccaactcccgggttccagcgattctcctgctcagcctcccaagtagctggctttacaggcacccaccaccacgcccagattattttctgcatttttatagcggggacagggttttcaccattgtcggccaggcgtggttcttcaacttccgtgacctcaagttgactccgcccgccttcggcctcccaaagttgctgggaccacaggacttgagccatgtgcgcccagcctgctcttgcttgatttttaaatttgtcagatcactaatgg

SEQ ID NO: 679816 - DNA, 125 bp, Homo sapiens
tgctatggaggatggttgatccatgagttgtagttgcagtgagcgagattgcaccactacactccagcttgggggattcattctcaaaaggtgattgcattgactgacatcctccatggtgctga

SEQ ID NO: 679817 - DNA, 557 bp, Homo sapiens
  misc_feature (14)..(14): n is a, c, g, or t
ggcaaatcctgaanactgtgttcaatgtcatacattcaataaatatttacagagcaccacattctgttccgggcactggggataaatcagtgaaggaattcaaagagccctgattggctgggcgtgatggcttacgcctgtaaatcccagcactttgggaggccaaggcaggtggatcatgaagtcaggagatcgagaccattctagctaacatggtgaaagcccatctctactaaaaatacaaaaaattagctgggcgtggtggcgtgcacctgtagtcccagctactcaggaggctgaggcaggagaattgtttgaacccgggaggtggaggttgtggcgagccaagatcgtgccactgcattccagcctgggtgacagagtgagactccatctcaaaaaaaaaagaaaaagaaatttcaggtatggagcaagaagttggtctacattagaggttataaataaatgtgtagcttgaggctaaattcaacgtgtctgtacatatgggttcactagcaaagtggttatgtatgaaaaatgcgggattaattgggggc

SEQ ID NO: 679818 - DNA, 838 bp, Homo sapiens
  misc_feature (321)..(321): n is a, c, g, or t
  misc_feature (323)..(323): n is a, c, g, or t
  misc_feature (332)..(332): n is a, c, g, or t
  misc_feature (343)..(343): n is a, c, g, or t
  misc_feature (359)..(359): n is a, c, g, or t
  misc_feature (403)..(403): n is a, c, g, or t
  misc_feature (421)..(421): n is a, c, g, or t
  misc_feature (432)..(432): n is a, c, g, or t
tcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccncntttaacaanccttaagttcnaggcatctctggcagngaacacttttcaccattcaggccatgctgagacaaagcagctgncagtgtacccgcatcttncccttggtgcnggattagtcctgactagtttaaggagactggccgaaggctctgcccaaacaatctgtggactggcaaaagcaccacttgctactgagagagggatgatgaatgactgaaaggttccagaatcttgtggaggaattttgaatgaggcttccacagaatgaggcaaagctgaattgagtcaacttctgaagataaaaccttgaagaagttactggggagcctgctattttatattattgactggctttttaagaacacttttgttgagtggactctgataaaaatctaggatctctaatatttttaagcccaagccccttggaccactgcagctcttatcaggtattggcttattccaccaattcattctttgcggcttattaagccgcgagaagcctggcgaatcaa

SEQ ID NO: 679819 - DNA, 394 bp, Homo sapiens
  misc_feature (153)..(153): n is a, c, g, or t
  misc_feature (213)..(213): n is a, c, g, or t
  misc_feature (330)..(330): n is a, c, g, or t
  misc_feature (369)..(369): n is a, c, g, or t
  misc_feature (372)..(372): n is a, c, g, or t
aggcggggtctcactttgtcacccaggctggagtgcagaggtacaatctcagctcaatgcaatctctgccttcctggctcaagcaattctcccactgcagcctcctaagtagctgggaatacaggtatacacgagtacacccagctaattttngtatttttatgtggagacagggtcttgctgtattccccaggctagtctcgaactcctggnctcaagcagtccgcccgcctcgggctcccaaaatgttggtgttatacgtgtgaagcctctgcacccggcgggcaaaactgggcttttaaattcaaccttttgggctaaaggatttcncctttttaatttatttttaaaagggattcccatttttanctntctttttgatattaaaatgttg

SEQ ID NO: 679820 - DNA, 553 bp, Homo sapiens
  misc_feature (10)..(10): n is a, c, g, or t
  misc_feature (34)..(34): n is a, c, g, or t
  misc_feature (52)..(52): n is a, c, g, or t
  misc_feature (62)..(62): n is a, c, g, or t
  misc_feature (120)..(120): n is a, c, g, or t
  misc_feature (214)..(214): n is a, c, g, or t
  misc_feature (295)..(295): n is a, c, g, or t
  misc_feature (514)..(514): n is a, c, g, or t
atgaagtgcncctggtagagggagcacttttcanccccaccccggattaagngaaaagtaancagcaactgggctggagtacctccgggaaaaaaatttacccccccaacccccattttntcccttaacaatattggtttccctgctgaagcccatgttccacagggttaaaaagaattcctagacagaaatatagctataattaaagcattantcagtctgtgctttgaccccacttcccttgtaactgaaagtcacataacactggatactgaccatttgcatccctggttgntcctatagatagtatttctggccttagattggatctctggtgttagaatcatgaggcttttgtttaagaattgtttaagtagatcctgaattccaatttaacagctgaggccatccagtttaaagaccctcacagaagaaccgaatcagcctaagaatagtttcttcatttccctgtcctatggctttaccctgcattcgttgaccgttcaatctttanacttcaacccactccaaaacccctgaaacgcttgagagg

SEQ ID NO: 679821 - DNA, 636 bp, Homo sapiens
aagaaataaagtacatttgaaaccttaaaaaaaaaaaaaaaaaaaaaaaaaaaaaaaaaaaaaaaaaaaaaaaaaaaaaaaaaaaaaaaaaaaaaaaaaaaggggggaggaaaaaaaatatattataaaaggggaaaaaataaaaaaaaaaattttttttaaagggctccacctaataatgtagcagtataaagtaaaatctgccgcccctccgcgcgatatacacacacgacgggcagcagagagagacacacagcagcacatacaacaatctttggacagagcaccacttcttgaggggcacgcaaacacttggagaaaccctactcatctaggtatattataaaagctgatagggggaaaatcattcaagataattacaagatgggatctagtgggttagaagaaaagagagagatattaggtgacgggagatcagatgaaataatttggctactagagtggtattgatgtattgagaacagataaactaaatttttatacagaagaggagggtagtatgttattgaaattcactagcaaatctagaagagagagtaatgcatcagaatgataaacatagtaaataatgagaaagcagcagacagaaagaatctgtagataattaattatacg

SEQ ID NO: 679822 - DNA, 936 bp, Homo sapiens
gtcgcgcacgggtggagtgcggtggcacgatctcggctcactgcaacctctgcctcctgggtgcaagcaattatcctgcctcagcctcccgagtagctgggactacaggcacacactgccacgcccagctaattttttgcattttagtagagacggggtttcaccgtgtgcccaggctgttctaaaactcctgaactcaggtaatctgcctgcctcggcctccccaagtgctaggattacaggtgtgagccaccacgcccggcctttttttttttttttctttttggagagggagtttcactctgtgtttgcccaggttggagttgcgtgggcgtggtctgggttcagtgaacctcgtgcctcctttggttcaagcaattctcctgcctcagcctctcgagtagcggggattataggcgtccgccaccatgccgggctaattttgggggtgtcttagtatagacacggttccaccatgtgggccaggcgggtctcgaatgccgggcctcaggtgatccacctgcttgggcctcccaaagtgtcggggattgcgggcatgaaccaccgagctggcctaaaattgttttaaataactgtacttgtactcatcaccctactccaggtaatagtccaggctgggggtgagaaccccaatgatcagatttgggggaagcctgaaaggcaatggtgggtggaccattgcggcaaacgtgggacaataggtacagcacctcaaatggtcaagagctggcgagaggtgaatagctatgcgacgacccggccgccataggggaaaacttgggggtgcaccctgggcaaacggttaaatacgcacgagggcccggaaccgcgtggagagggggcatgacaggggcgggagaccccaaataacgcggggcgcgctcggcgcgctgacagaggcacacgagcgaaacg

SEQ ID NO: 679823 - DNA, 487 bp, Homo sapiens
  misc_feature (22)..(23): n is a, c, g, or t
  misc_feature (290)..(290): n is a, c, g, or t
  misc_feature (356)..(356): n is a, c, g, or t
  misc_feature (373)..(373): n is a, c, g, or t
  misc_feature (407)..(407): n is a, c, g, or t
  misc_feature (422)..(422): n is a, c, g, or t
atggggaccaggctgaggtggnnatcaccttaggtcaggagtcaagaccagcctggccaacatggtgaaattcaatctctgctaaaaatacaaaaattagccaggcatggtggtgcacgcctgtaatcccagctactcaggaggctgaggcaggagaatcgcttgaacctgggaggcggaggttgcagtgagccaagatcgtgccatagcactccagcctaggcgacaagagtgaaactccgtttcaaaaaaaaaaaagaaaaagaaaaaaatttaataagaaaaagggnggcaaatgatatgaatatgcatttcccaaagtgcggggattaccggctaaaagttattttttttanatacggtttttggtggngttgggcaataaaaatcggtttctttagcttaangcgaacgggtgattngaaagagatttacctcaaatgcctggtcagccggggtctccattcagataattcctcagcctggg

SEQ ID NO: 679824 - DNA, 817 bp, Homo sapiens
cacgccgcagtgttaaacaggaacgaggaccgccacctggcctatagagtggtcttcacaatacaggaacaacatctaatgtgacatggagagttgactgaagttggcccacaggattgtgagctgggcagtgccttcatgaaggcttgccaccttgggacgccccagtttactggggtgtcttgcggagtgcagaaggctttctggcagctgcctgggttaggacagaccctgcctcccctcccgccggccaacccctattccccttcctgtctccacttgcattcagggagtggctgctgttctgagaacattagaactgggaagagagatggagtcacatggattaaaggtgggcataattctaaactttcgtatccaagtatagtcccccttattccacatgtggcatagacgtaactaagcagtatacctgatgcctgctgctgaagagctgctcacaggaggcggcggcggacctggcactgccccttgcattaggtcttgtgtacgatgtgttcttgtgaatctacttcgtcagaacaaacatatttacagcgatcgggtccaggaattctaattagactccccatctggctgtgaaatcaaggaaaccatcccgtatgccctagtatatcacccccaagtaaggtgtacatgtagacaaacgtgcatctgaccactacggggccccctggtgacccacagcacattcacagcgtgatcaccgcctgcatcggccgatcggctggccatcggcctccggaacacggctccccacaatcgaggagctgcgcccaatccgccgagcgccacc

SEQ ID NO: 679825 - DNA, 447 bp, Homo sapiens
gaggaggaaggagagaaaggatataggaagagagggaagcatgtaaggggggcattgttctatttaccgcacaacaaagttatttcaaaaaaaatctgtattatgctgggatatgtcattggcaagaggaagaactggtgtttagaaagcagtatggatgctttaaatgcctctcactcttacaagatagtaggctttgagataataaacttacccgtgtcaattaacatttaaactggcatatagaagaaaaggaggatttttctgcattgtaaaataatcagtatggtttatatgttgaatttgacatttgtgtgtaatttcatggtggcctagtgttgtggtgcttctggtaatggtaatagaagctcaactattttttttgtggatttcagtttttatcatcagaagtcctagacagtgacatttcttaatggtgggagtcca

SEQ ID NO: 679826 - DNA, 738 bp, Homo sapiens
cagcgccgcaggaagctggcacgcgggcccaccacgacccttgctgccgcgcgctgcgtgcgcagcagcccccaggcaaggagcgctcccgcgatcgtgccctcatcggtgccttgcgctcagccgcatcaccacggggcgctgggtaccaggagctcaacgccgaggacgcagatcgtgcgcgtgcgcaggcgttgctgcttcagaatggctagccgcgagggggcctctcggcgggtcgcagaggcagacggcggagcccctaggccggacgctctcaggacacagcgtgccagtctcacggaggtagccggagcgagcactatggccacactacgcgtgtcccgttggcgtatgagcaggctcttggggggcccgtcgcgcggcagcgcccggggctccgacggtaggcatcgaggagctaagaggctcgggatggatcctggccccaccgactcaggagccagcgcaggaccagggctcggaggaggcggcggcgagctcgggctggggggatcaggtggacagcatgccactccggggctggatcgcgcatcacctcagtccctcggccacccgggggtcgctcacctcagtgcccaccagcacactgcacgagcctcatttggacaaccagatctgttatgcttttgtcttcgtcactgcggcggggccctttgatgtcttagtctgtatggggtggaaaaatcaccggaaaccccctggagttcttgaaaa

SEQ ID NO: 679827 - DNA, 805 bp, Homo sapiens
gaggaaccggaacccgcggttataaagtaaaggaacccgagatctgcgcaggggttccctttgccgattgtctctcaccatcacctttcaaagcctaaactcgagcctgctgattcaccggaccatagcatttgctctcgaccatggcatcatcagacgactagctgaccgtgcaacagaggcagactacaaggcatatgaatggccatattcagtctgaaacacaggacacgtcccgaactgcagccaacaggcacgacagcaacactacgactgcaaacggccagaagacacgagttcaacagtacgacgacaagggctcgcgctctgggtgggccaaaaagcccaccaaatagggaagccctaagcagaacgcgaacactcctacgctcggcgccccaccataacccttcaaccctcggaacgggaccactggaacacaccggcaacgcgaaccgccgcccacacgggcacatttaggggaacgggcccaaagagccaacgtcaaccaggtcccaccacaccattttccaaggcaagtgtctcccgaagatgtgtgacactggacatctccacatgcccgacggaaccttcaaagcaggatacccattccgatggaacaagagcaagaaagggaaaaggacaaagctcgagaacagcgccggaattcagagtaaaggtgttgcgcaaagacccccgccacagggggagacaatagacgaacgcacgggcgtgtatacgacaagcgcgcgaggctgtaccaacacagaccggaacacggcggtatgtgggaacacacaaaagg

SEQ ID NO: 679828 - DNA, 1520 bp, Homo sapiens
tacaaagtacttcttttattgcacatacagagaatttcatctatatgtcttgctgtgcgtgtccttacaccttccaatcttactcttgtctcttggagatcgcttgcaacgcagcatgctctaggcaaggggcatgggactagacttctacaacatcatcatatctgggcacccatggcgcacatggctcactcggggcaagcacaccaactcatcctgcccgcgcaccagcatcccctcagcatcactctctgcgcatgctcacctttctcatgttcactcaccacatttggcaacaattaccgcaccacaaagtacctagaataatacacgcagagatacaacgcaccgtaccaccagctgactagcttgagacgaaacacggctacaaccaaagcaacactccgtgcgagcccaaccacgcagaaacacgcaaccacagaccaaccaaaccttggcgcaccgccccggaacactgggttcgcacactggctcacacaccggcacatggccagatcgaaacacctgaactcacctactgcgcccagagcggggcataagcactgcatgggaagccacaactacaagcggcacccacccgctccactccattcccaaaccccctccgacgtacacggtccaccccacgtaacaacgccaagcacaccccgggcgactcggagcaacggcgctgacgcacccagtgcaacccgtcccctggcactgatagcacgcgccaaacaaccccacaacacaccggtcgcgcacacctgcacaacctaccaaacatcactgccccaaaagagccgaccagaacaaacccagcgtacggacatcacacagcaacccactgccagactgaacaaacaacgtatcccacacaacccacacgcacacgctgaaccagctgcgccccccagcacttaccttccaaccaatcggccaccgcacacgacggtgagaaccaaccccggccacaaagaacagcgcgacagcccacccaccaacgcaacccacacaccaccacaacacgcacccacgcaccccagctgcccccatcgccccccacaccacgtcgcgacacacacacaacacccactaacgcgccccaacccctcaccgcacacacgtcaccaccgacccacaccccacccacccaccggcccacacgcaccacacaaccacacaaaaccaacatgcacagacggtcgaacacacgacacccaccacccaccgccacgagcaactcacacacacctcgacaggcaatcacctcccccctctcgccctgcgcctacgcaccggtccgggcccgcacgccgccccccaccccctcgcgcatccaccccgcgcccacatcagcgtgccgccaccacaataaccccgaccccgtacggccccgacgacaacaccggccgcccaccacaccccccccccacgcatcctcccacgccacccgccactccgccgcgccaccgcgccgacgccccccccctccccccccccccccccacacaccc

SEQ ID NO: 679829 - DNA, 601 bp, Homo sapiens
  misc_feature (250)..(250): n is a, c, g, or t
  misc_feature (455)..(455): n is a, c, g, or t
  misc_feature (582)..(582): n is a, c, g, or t
ccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccatcctcctcctcggccccccctcgcttccctcctcccacttcccgagctccggcggtgtcccggccacgctcggacgctgctgcaggaacaaaggaagaccccgcggtgggcggcggagccnaccttccgccttgctgctcctgacccggcttcccggtccgcggcgtgcggcacccagggcgcccggctcagccttcccggaggcctcggcccggcctcatcgtgccggcttcgcgcgcgaaacccggctttcgcatttgggaccctgcaggcagaaaatatggctcaggagactaacccagaccccgggggcccatgctgtgtanacacaggatgtggcttctatggaaatcctaggaccaacatggaactgtgtcaggttgctaccaagaacattcttcagaggcagcaaatagtggcagaatgagcccaatggggacacgctaggtggtncaacagtcctacctcagat

SEQ ID NO: 679830 - DNA, 744 bp, Homo sapiens
  misc_feature (250)..(250): n is a, c, g, or t
  misc_feature (598)..(598): n is a, c, g, or t
  misc_feature (725)..(725): n is a, c, g, or t
ccaggcctcgcggcgcgcggtccgctcgccctcttcgtccgcccaacctgcggcctgtggaggcgtgaggcgacgacaggcgagcgcctcgagcagcgttagccgctgcggccgccggtcctccctccatcctcctcctcggccccccctcgcttccctcctcccacttcccgagctccggcggtgtcccggccacgctcggacgctgctgcaggaacaaaggaagaccccgcggtgggcggcggagccnaccttccgccttgctgctcctgacccggcttcccggtccgcggcgtgcggcacccagggcgcccggctcagccttcccggaggcctcggcccggcctcatcgtgccggcttcgcgcgcgaaacccggctttcgcatttgggaccctgcagggccctgaaaaggagcctttaaaagtcaattctactccattggcaaagagggaactgcaatctggaaagtaaaggacttgccaaggtcactgacttagtggcagactagagactggaactcaggtctccattcccagcagagaccagaaaatatggctcaggagactaacccagaccccgggggcccatgctgtgtanacacaggatgtggcttctatggaaatcctaggaccaacatggaactgtgtcaggttgctaccaagaacattcttcagaggcagcaaatagtggcagaatgagcccaatggggacacgctaggtggtncaacagtcctacctcagat

SEQ ID NO: 679831 - DNA, 125 bp, Homo sapiens
ggttagtatgagaatggatgctactacaagggctatgtggttgattgaagagtatgcaatgaccgatacttaggtatgttagtcgaaggccgatggagcttgttataattatgccccatagggat

SEQ ID NO: 679832 - DNA, 437 bp, Homo sapiens
gcgtcgacatcgccatgtgaagtgcctgctcttcctctgccttccaccatgagtaaaaactccttgaagcctccttagaagccaagcaaatgctagcaccatgcttcctgtacagcctgcagaactgtaggccaattaaactgcttttctttataaagtacccagtctcaggtatttctttatagcaaagaaagaacggcctaatacatacagcaacaggtagctggatgggttgctgagttttatataaagtctgactggaatcagagaggcctgtgtctgaattctggctctaccttctactagttgtatgataattcacctctccatgcccgtttccctaagtgcaaagtaggtagaagaacagtgtatcctggccaggcacagtagctcacacccgtaatcccaccactttgggaggccaaggcagtcgacgc

SEQ ID NO: 679833 - DNA, 371 bp, Homo sapiens
tcgactggagatggagtctcgctctgttgcccaggctagagtgcaatggcgcaatcttggctcactgcaacctccgcctcccgggttcaagccattctcctgcctcagcctcccgagtaggtgggactacaggtgcccaccaccacacctggctcaatttttgtatttttagtagagacgggatttcaccatgttagccaggatggtctcgatctcctgacctcgtgatcctcccgcctcagcctcccaaagtgctgcaattacaggcgtgacagccgcacccggccagcattatctacctttcttaaccaactaaccattcatagtaatcatggttaacatgtacataccaggtactcttttacatgttt

SEQ ID NO: 679834 - DNA, 378 bp, Homo sapiens
cgaggattctcacacctagtcaagaccttaatttattatattttgatcgacagaattttaatgatcaataaatgtgctatctattctcttgtccaagggctatgctttattactaaaactcaggatctagaacaacttctgacacacagtaagaactcagaacccatgtttttcaagcaggacacagtggctcaaacctgtaattccagaactttgggacggctgagactgagaggatcacttgagcccgttagtagctaaaaggtaggtgtgcacgtgatgggggtaagggtaggttggtacattgatgcctgatagccttgtgctgccagggtccagagaagtctaactactcctcatagactttgaaccaaatca

SEQ ID NO: 679835 - DNA, 591 bp, Homo sapiens
ttaatggtgactgatgagaaatgttatctgtagtagttaaataatatgtgtatatctaattctagagtaagtctgtacgaggagtcattgtgctattttatttaggtgcatagtctgtccgtgtactaaaccatccacctttctagtgagggcttgatcctctgttccttgatataaaaaagcactttatataccataaatatcagcccttcgtctgtggcatatgttaggaatatttctctcagtttgtcaagtactttgtcttctgactttgtttaaggtgtactgtgatttttaatttggtcgaaaatttaaaaatgttcatagtaatacaaatgatcagatataaaatattatggcctctagatcttaagtcatagttagaaagcctttcccacccacaagtttaaaaaaggaattaacccatgtaaacattaagaagtagtatcatggtaaacatctagatcccaaatccacttggagtacatatctctgatatggtgtgagaatagaatcaaatatcaccttttcccaaatagctacccagaagtccgagcaccataatataaaaagtctgtctaaacccagatg

SEQ ID NO: 679836 - DNA, 152 bp, Homo sapiens
cccgataccactgaccactcgggctcacctctgtgtcgcacgcctggacacctagacgacaacggacggacgttcgacgcactgacggctcacccctgtgttctactgaccgcaaacgactcaccacggccactgtggcctgtacggtgtcc

SEQ ID NO: 679837 - DNA, 972 bp, Homo sapiens
  misc_feature (517)..(517): n is a, c, g, or t
  misc_feature (556)..(556): n is a, c, g, or t
agcgccgcgtggttagcgtcggcggctttaggcatggtcgactttttctggcccggctgggccaatcctgtcggttatccgcaggaagatgtcgagtttcaaacaggaggtggcgcaggttcggaagcgcatagagcccatgcgaaaaagaactagagatacaacttactcctggagtagtctatgtagcgccacctacctaaccttacgttgacgaaagctcagatcttttcatgatttactcgccagtttggcagctgtgacacgtgttcaggcgtgtccagaagtaacaaggactgggtaagagtagcagaaggctactgcattttgtggaggttgtgatgtctggacggatagtctggcataaatagtatgcgtgagaacatatgagagcatagtaccttgtattgtgtgacaagaactcttaggatgtgtacattgtatagtagccaccctgaagaacatgtacgagtacaaggacacttccctttaacagacctgggaagttattaccatntgttaagcacgtccatcagtatgcccatcaggtggaganagccggtataaacgtcggacatctggaccaactaaacatctaaaagtcgtgacggactgtgaggacgcgatgtgtaaaacacgaagagacaagcattacctcgaggaacggaaatctagctaatctaacggacattgagctactgcatttgtccttgcttcgagttttaccagaataaccggaacagtattttgcacaacaagtaaatcggtcgaggacggtctacgcaacaggccagggtttctcacgtacaggaacgaagacaccgacagtttccagggtactcttgaacactccttgagcaacgaactgtgggatacgcccaggggcccgcaaaccgaagtttgtaacaccaaccattcctcgggacgaggcgaacaatctccacgtgggctgcacctcacctgctgactgca

SEQ ID NO: 679838 - DNA, 284 bp, Homo sapiens
ggccttccccgcgagcggacgcggcagcgcctcgtctcgctttttcttatttttcccccctttcccctttctttttattttttttctttccttttctcccctcccccccttgcaccatttcccctgggaggcgcttacccggggcaggggcagagcgggtctcaccccgggcaactcccggactggtgggcatgtgcggataggcagccaatgcaatcagggatcacgagaaagagagccatgagagaagagtaacagcgagacagagtgcggcagaacggcga

SEQ ID NO: 679839 - DNA, 661 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 679840 - DNA, 81 bp, Homo sapiens
ctagaagattcagcaaagtacttttgtgctcttggggaaggaatacccttactgggggatatgggcaccgataaactcact

SEQ ID NO: 679841 - DNA, 756 bp, Homo sapiens
  misc_feature (663)..(663): n is a, c, g, or t
  misc_feature (671)..(672): n is a, c, g, or t
  misc_feature (678)..(678): n is a, c, g, or t
  misc_feature (681)..(681): n is a, c, g, or t
  misc_feature (684)..(686): n is a, c, g, or t
  misc_feature (688)..(689): n is a, c, g, or t
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 679842 - DNA, 586 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcctttccctgtgtgaattttgtatctagcctaaagtttccctaggctttctttgcttagaaacttttccattttgtgctctcttgggtgatgtttccccgcagcattcaccaaata

SEQ ID NO: 679843 - DNA, 1009 bp, Homo sapiens
  misc_feature (1009)..(1009): n is a, c, g, or t
caagggaggtgtgaatccaggaaaagagagagagctcgacgcaactttaacagcttataggttattcctgcccgaagtcagaactttgacatcttgcaaagtgccatcagtaagcatggggggggggttgactgtaattcctgacagcacggaatggctcgtgttttctggtgtaatctagtaaagctcctggatcatactatgggtacgggagtgagactctactcaccatctcctgcgtccctcggtgctacaacggcttctttatttccttgctcactatatgagaggggggaagcagaacatcctatagaaagagggacaaacttaaggggcagctggaggccacatagtggctgcagttgcctcaaaaccctcacgaccatgataccgaccccgtgcgtcgatcagaagcggcgaatcaacgaggctgactagcacgagcacatctgattcgcgctgctaagtccagatgacaatgcgttgtactccatacgttgaccacccgccagctcgatgccgagataaataatacagagccacacgactccgacaacccacagacgatagaaccatatcgcgtgcagacgcgcatgccagcgtgcggccagtaagaacacgagagaacacgcacagacccggccgagggcgcgccccggacaacccgagccactgactgcagatatctcacaccgacacacccgtcagccgccctgagcgccagcatcgacgcaagatcatcgcaggcatggtctgggccaggcatctcacacgtcctaccccctcgcgtcgcccacaagcaaatcaccgaagatactagccagcgggggcggcagccctcgacaggacctcgcttacggacgaagtgagaaaccaggctcgacgaagcgcgtatgaatgagatcatacattgcgggacgacctagcgtacggccaccgagactcacgcgattgccagagactgcacatgaatcaacggacaactgtggctctaagagtagcagctagn

SEQ ID NO: 679844 - DNA, 141 bp, Homo sapiens
ggcagagacttcatgtctaaaacaccaaaagcagaggcaacaaaagccaaaatcgacaaatgggttctaataaaacgaagggctccagcaacagctaaaatctcaaagagaagaggagacactgagggaacaagacacttc

SEQ ID NO: 679845 - DNA, 464 bp, Homo sapiens
  misc_feature (47)..(47): n is a, c, g, or t
  misc_feature (74)..(74): n is a, c, g, or t
cacagtcactacattcaactagattaccaaataacaagcacattcanatatcttcaaatgttacagaacataanacattttcagaaatttggttctggatgatactctgtaagtctgcctaagaattcctttcaaaaagctggttattggccaggcgcagtggctcacacctgtaatcctcccaggactttgggaggccaaggcaggtggaactcccgaggtcaggagttcgagacgagcctggccaacgtggtgaaaccccgtctctactaaaaatacaaaaatcagccagatgtggtggtgcgcctacaatcccagccactcaggaggctgaggcatgagaatcgtgtgaacacaggaggcggagcttgcagtgagccgagatcgcaccactgcactccagcctgggcaaaagagcgagactgcacctcaaaacaacaacaaaaaacaaacaaaaaaccaaa

SEQ ID NO: 679846 - DNA, 402 bp, Homo sapiens
catgcctggcgggtcgactctgaagaatcccttgtgaaagcacaccttcatccagcgatacctcgccaatcggcgcgccatcagcgctgtaatgcagcggccgcatacacatgggcaccggtgtgcggcgacagggtgacgcgccccacatttaccggacactcggggccgaactgccacacgcgctcctcctggaacggcgtatcgcccggccaggtcggggtggccgtgctcaagggcgggctgatatcccaccacgtttttattgggttcattgcaaggctctcactcgttactgaggtgaatgatacgagggagggatgtgaattttcttgcgaattctggcgcgacacgggaaatctttcgcagttactgcgaggaaacatcggtttgatgcacaga

SEQ ID NO: 679847 - DNA, 698 bp, Homo sapiens
  misc_feature (605)..(605): n is a, c, g, or t
  misc_feature (613)..(614): n is a, c, g, or t
  misc_feature (620)..(620): n is a, c, g, or t
  misc_feature (623)..(623): n is a, c, g, or t
  misc_feature (626)..(628): n is a, c, g, or t
  misc_feature (630)..(631): n is a, c, g, or t
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatctcgtctcttcttggatgatgtttgccgtcagcattccccaaataaacttgctttttgggccaanaacaagannaacaanaanacnnnannggaattaaaacccagggatgcgtgacacacaagaaggccaaagaaagggccaaggggacaaaccctg

SEQ ID NO: 679848 - DNA, 148 bp, Homo sapiens
acatccctcagtcggattcattttgacagttttgatctcagatggctatggtagatttcctaattccagtaacttttgtacctctttttgatgccccatcctcgtttaagttcaaaactacaaatagcaatgatataggtggtatcag

SEQ ID NO: 679849 - DNA, 523 bp, Homo sapiens
  misc_feature (10)..(10): n is a, c, g, or t
  misc_feature (19)..(19): n is a, c, g, or t
  misc_feature (30)..(30): n is a, c, g, or t
  misc_feature (82)..(83): n is a, c, g, or t
  misc_feature (85)..(87): n is a, c, g, or t
  misc_feature (92)..(92): n is a, c, g, or t
ttacgccgancccaaaacngtttatttttncccgaagagcagaacacacaagaggggggtttttattaaaaaccagaccgcnnannncaagnaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtaaaaatcttgtggcaaaacatgaagacaacaattttttttaaatattaaaaattccccccaatgtgcttaaaggtaaagaccttcccaagcctccca

SEQ ID NO: 679850 - DNA, 821 bp, Homo sapiens
  misc_feature (366)..(366): n is a, c, g, or t
  misc_feature (417)..(417): n is a, c, g, or t
  misc_feature (445)..(447): n is a, c, g, or t
  misc_feature (459)..(459): n is a, c, g, or t
  misc_feature (519)..(522): n is a, c, g, or t
  misc_feature (528)..(528): n is a, c, g, or t
  misc_feature (531)..(531): n is a, c, g, or t
  misc_feature (536)..(536): n is a, c, g, or t
  misc_feature (544)..(544): n is a, c, g, or t
  misc_feature (618)..(618): n is a, c, g, or t
ttttcggccctcgcccccaaacccttaagagggtgattgtgaagtgtgggccaacgccctatcgctttttagcgcttttggggtgtgagcgctgattttagtggttacttgtgaccacttgggaacactgtccccaattcggcgttttatggttatatttatagatttatagagattgccgcctttttggtaattggtcaatattcaacgatttttcgccctttttctacatattatctcgcctttgttccttcactctcccattaggctaaaaagttgttgaaatgatgaaagtcccctcctcttgactatttcacaggcgccccaaagggggatatgctacatgtctattaatgttgagtaacnccagttttttcaccagtttcgcaggttgtaaaacgtctaccacttgtttanggagtttttttttttttttttttttttnnncagcttagaacnttctttattaaggaaggtctttcaggcactttcattaacaggcacatataagcttagcannnncccttncanagtcncagttccnatggcctttgtaaggtccacccagagcccagagaaccacacatcatgcctttcctgtccaaaccataaccaccnacccactctagcttctggtcctgtgaggaatgacgggaagtagggagtcaagacttgatattaatgtagatcgcatgtgacacttgcgtggccagcagacaaggccccccacccatgcccaggcttggacaaaatggtggctatgttttctacatagtcggtccgcgactgcctaccccccccccccccgcttccccccctcg

SEQ ID NO: 679851 - DNA, 756 bp, Homo sapiens
tcaaccgccgcaccggggcaatcacacacccaccctgctgtggcagagaaaagatatcccgcaacagacccccgccgctggcagagagcaccggggagagtggggatgacaaatcacgaatatctgtactctcctgggagatcaaccacacgacccctgcggctgggggacggccgccagaccgactgcgtccccgctcccaccaaagaggagcacccaccacgcgctgcgactctgcctccggcagcgagacaaaattaccgtgggggagaaatagtagtatagaaccactcgcggacaaaacgccccctgctggtggggagagccccccccgtatatagggaggacctgcgtgagacagagagcgcggggggataaaatacaagacaacgcccccccgcccaggtgctgttcttcgccccacaaacataggcagagcgcgcccctctctcaatacaagagagggggttgattgccaaaagcaaaaatagggcgcttcctggtccgaaccgattgatagacgcgctcgctctaactttagggggtgcgagagatatctctctctctctgtgtgggatagattaactctcgcagtcagctctgatcgttacctggtgttgctctaaagagtcgccacagagcgggtatagacacacctctctctcttctcaagggcaccgggcatagttaatggggcaaacgccccctgccgagtccaattacgcgcttttggaacccgcccaacaaatgcagaca

SEQ ID NO: 679852 - DNA, 344 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaagtcttcggtcggtgggatcctctaggca

SEQ ID NO: 679853 - DNA, 374 bp, Homo sapiens
tacgatcggctcggaccctaaagccaacccccgactggtgcataaaaaacggaaacaatgggcaatttctggcactagtgcaaagattttgcaaggggttcagcgggccccaaccacagaggggcctaccaataacgccctggcttagcctccccgggggggggggctgttctttcccgccctaatcccccttttgtggcctttttcctctctggccatttttaaaaaacacacataggcggaaatcgacccatcaaatgtcattacagatttattaagcctgatggagaaagacttttaacagtaacgtctccagaaagcttaaaaggggcccttttattcagtctggtgctttgaaaagctaaatatatttt

SEQ ID NO: 679854 - DNA, 416 bp, Homo sapiens
  misc_feature (225)..(225): n is a, c, g, or t
tgctgcttaggtttgggtgggggactaacaactgctgggaggggagctaggggcatggaaaactggtcaaactcaaggtggctcctttgcaaactgaccccagggttggttgctgggggcatgttcccgcttatgcaacctttgcagtttggtagtcccctggcccttgggggacccctcccaaagccctgtttcctgggtttatcccccctttcctttccccanagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 679855 - DNA, 1058 bp, Homo sapiens
tggcgacctgggtgcggagtgggcaaaaagccactgggggaggccagtcccgatcagtcctttctggctccagctccagatcccgtgcggagcaacagctgcggtcgcagtctccaccaactgactccacctccatcgccgtcgggggaggtggccgtgcggaccccgtgggtcactgccgaggaatgaagagaggcggctgggaccccgagcatcctgacccggactagggccttgccccctgggagcccagagagggtggaggcctgaattttgatctatgttctacctacatccagctggctgaaagtacttgaggatcacatgaccctggacatggatgcatgttctgtcagattaatgtccgttccacaggagcagagccagggactagcgcgagatctcctagacggacaagacttgggctgtgaactgccgccctcagtgattttgaacagcgtacgtcaaagtccatgctggaaacctacccccatccttatagtgagggggagtggttggctccaggaccccctgaaacaagggttacttgacaggagagcctacgtcgcacctccaccgagccatccatccagacggcaggatgacaatcgattcaaagcattcaggaatctccaactgtatacaaatgaagacttccagacaggcattcatacgagagagacctcaattgagcagtacatgctgggttgcacttgggaacaggggcaggggcgttgaactggatgagatgagatgatggatccccagcctcaacaagaggactgcctacctttggacaactaactggcccatgggcaaacatgacaaccatgccattgacagaccaaccccattgagagaatgttgagggggtaacagatggaacgggaggaacactgacaggacaggcaggaaagagcgctgtacatggcacctggataggagcaaaggggcagaaaacaagggcaacagcggtagaagaaagcgcgaagtaaggaagcagagaggaacacagcgccaataacactcagcacggcacagcagaaaaaagaaggaga

SEQ ID NO: 679856 - DNA, 295 bp, Homo sapiens
ctggccgtcgtattaacaggatttggtcggtccccaaggcctctggtgtaccggtggttcgggcccatgagagtgctgtgacaggcctcagccttcctgccactgccgaatatctcctgcgctcctccgatgctcagtactgcgctatctctgacatccagataaggcccgtgctcaccacggtgacccatgaaccctctggctgctctctcacctgtgcacagttccaccctgacggactcatctttggaacaggacccatggactctcccatcacgatctgggacttgctgga

SEQ ID NO: 679857 - DNA, 625 bp, Homo sapiens
tattcctcatcacccaactaaaaaaaaaaaaaaaaaaaaaaaaaaaaaaaaaaaaaaaaaaaaaaaaggggggcgcataaaaaattttccccgggggggcccaatttattctggaccccctttttttgggaacgagggggcccccaaaaagggggcttttaaactaatgccacgctgccctgccttactacaaaagcgtccgtagtatgtgggaacaccgatgctaagctgggaactttcttgtgaacacaagcaccctactaacatcctgttgggggagacacatatttgtggcacaaatccacatcaaacgaatttagagcgccctccaggggacatattatcaatactttgacagtgttaatgtgggtgtaaacaacaagctgattatttcccgccacgtgagcgactaaactttggtccctcgctgactttttgatttttgctaacaactttttttttcccccgggacctatgtataataaaccaacccttcgttctatacaaatacttctcacactatactactaaactaaccttccgtacaccaacagagaaacactctctcctacttgatcactatctaccaactactatcatattcatacacagcaccaactacaca

SEQ ID NO: 679858 - DNA, 1530 bp, Homo sapiens
ggcattactgcaggaaaaggtcccggagagctgagcagtcaagatgtgtgacttcaccgaagaccagaccgcagagttcaaggaggccttccagctgtttgaccgaacaggaggctgacaatgaggtagacgaagaagaggaagaaggtggcggaggaacgaggaggcacggaacgaagaaggtgatggtgagcgcaagaggatggagatgaagactgagcgcaacgctgactcagctacgggcaagcgggcacgctgacgatgatgcaaggatgaccgactgtccataccaagcaaccacaacgaccgcacgaggatcgaatagacagcgaacaacaggaaacagttaacactaaaaaacaaacaacacaaacacacaacaagcacacccaaaccaccacaaccaacaaaacacacccaccccccacaccacaaccaaaaccacccacccaacacccacccccacacacaacaacccaccgacgaccagacgacgaaggcccaaccagacaagagagccaacaccagcaccgaccaacacgccccacgaccgcaaaccaacaacgccacccaacgcaaaccgaccgacgcaaccagcacagcgcacacgaaaccagaacgaccgaccgaacgaccacaaacacaacgacgacgcacaaacgctgacgacagacagcaagtggcgacgcaacggccacacgacgaccaaccaccaacctcaacccaacggccaaccgcaccccaacccacaaccccacgcacaacccccaacgctacccagcccacaacgcacggcgcacaccacacggacgcgcgcgaacgcccacaaccgaacgcacgacgcaacgcacaaaccgacgcgaacgccacacacaggaccgcagcaaccaacagctcacagacgcgcacgacgcgcgatgcacaacccgaccaacgcacgcacaaagacgcaacgcccgacgaacgccagtaccgcacaccaccccccgccgacaccgaggcgaaacgcaacggcagcaccagaacggcagtaacccaaaaagcgacgcgagacacaccaaacgcagaatgggcggcgcagcagaaccgagagcgaagcacacacaaccactcgaacacagcgtgccgagggcgaaacaacacacacaacacacacgagtgaacaaaaccaacacgcgaaacccaccaaaacgccacacacaacaaacgcgaccgcaacagacgcaccaataacccaagacggacgacagccacatcgacgaacaaccataacgacgggacgagctcaacgaccgaacaacccaacgcccgcacaaaccaagccgaaaacagcgacgatgatcggacaccggacgacgcaaacagacaaacccaggcgaagcgacccacaacgccaagagggcgagcgatcaacaaccagaccgcacaataccaggcgagacacgaaccaagacgacagcgacgaccacgacaacccagcagcgagccgcaaaagacccaatgtgacgagaaccaaaggccagctgacca

SEQ ID NO: 679859 - DNA, 168 bp, Homo sapiens
ccgtgaaggggtccaagacgtatcgttacaggcctatactgtggcgcacgtgaaattagacgttatcagatgtccactgaacttctgattcgcaaacttcccttccagatgtcatggtgcgatgaacattgctcagtgactttaacaacatgatctgctgcttccaga

SEQ ID NO: 679860 - DNA, 243 bp, Homo sapiens
  misc_feature (50)..(50): n is a, c, g, or t
  misc_feature (52)..(52): n is a, c, g, or t
  misc_feature (54)..(54): n is a, c, g, or t
  misc_feature (57)..(59): n is a, c, g, or t
  misc_feature (63)..(63): n is a, c, g, or t
agtataaaccgaacagggaaaggcacggactctggggagactgggaagtntnanccnnncagntgatggcaagatcctgtacagccagtgtggggatgtgatgatggtgatgggggtggtgatgatggtgatgggggtggtgttggacagtggagatggaagtgatgatggtgatgatgaagtgatgaggtgatgggggtgatggtgatggtggtggtggtagtgatgacagtacctgttcag

SEQ ID NO: 679861 - DNA, 706 bp, Homo sapiens
ggcattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggcttttttgtttcagcaactttcccatcttgtcttttttggatgatgtttgccgtcagcattccccaaataaacttgctttttgggcca

SEQ ID NO: 679862 - DNA, 292 bp, Homo sapiens
gtagagacaggttctcgctctgttgccagggttggtctcaaactcctgggctcaagggatcctcctgccttggtctcccaaaatgttgagattataggcatgagccaccacgcctggctggggttttgtttttgtttttttaacatttgtcacatttcacaaaggtatttcagaatctctgagaaaagtgctataatgtctaatgatactttatatttggacagcactttcgtttgttttttttggcggggggggtgggagaagtcaagtaacttacatatagtgaaattta

SEQ ID NO: 679863 - DNA, 971 bp, Homo sapiens
ggagagaattagcagtaccagagggcaatggtggctgctgcatgcatcagcccacaccatgctgaccccgccgttgctcctgctgctgcccctgctctcagctctaggtctgctgtgcagtgctatcgacgaccacctaaagtacattgacagtccacaaggcatgtttgccctgcatgaggtatccagaaataagacctgttatctccaagaaggtgcatggtcggtgtgcgaacgtgtgatgcacgggacgtgccctatgaacggaatactgatcggagtgtcctcccatgcagtaattttgtccagcgagatgtaaggtcccatggcgtatgccatgaccataacgagcataactgccttgggtactgagctgtgtgttcccatgtctcctggctctgcaaatggggtccaggactgctatggacggctcactatgaggggcccacactgcccgatagcgtcgcaaggtcaacattgtgtcttcgtccacctgtgcgcttgagcaaaggcacacaatttgttgtctcctcaacgacatcggaattgcggcctcacactagctttagctggaaacgaggcgaggcgttacaaggcttttcatgggcaggattggccaagaccttgcacaaatgacttgacggagtggaagtgcattcaagatggtacgggcaacccgtgccgatacccacgccttaatagcaccaaagcgaccagaacgggccatccctttcacttacttgtgagctagttggtgtgaaaagggaataaccctccttgacatgcctgtgattaaacccggcttcccttgccacatgggaccacatggaaacggggaagccaaggttatgaaccagggccccccccttggtagagctgtctcgactatgcccaaatattcccaagaaaaggattctttgggccaacggtatcccttgaagttggaggggccccagaggtagtcattacca

SEQ ID NO: 679864 - DNA, 920 bp, Homo sapiens
tgaaagttgttccttgaagtcggataatccgcaagtccttccggggggtctaacaacattaggggctgtaaaactaactggcaaaggtccgtgccttcattttcggaaggccagccagaacaacgaatccgacggggagggaatgaacaactcccagataagtcctcgtagtaacactcgcccgtgaggtccgcagcttcgttgattgaagtcagctacacccaagaacccacgtggaaggaaccaattactgggacacagggggacttagcgcacgcagcgctccatgagaccatgagctttctcaccgggcaggaggagcccatccccagctacacgtctggggcccagcgctctcggagcatgctttggagaaacatgctatggcgtctagtctagtgccaatggccaggctcctagtggactctacaggtttctccaggtacgaagagatgtcttctgtgcccagaggagcagtactcaagccgcaccagagatggctgcctgcccaggacagagaccttcctggcctttggacgaccccctgggagctcatgctcgccttcggtggcgctcatagctggccagcctgcgcagtagtctggtcctcagaactgttactgaagcaccgagacacacctgtggttcggggccaacaacagagcctctcagctgcacgccgctcagcttccctgaccctatgtcgccactgctagtcccttgccttgccttggttgtcccacacgctgccacctagccgcctctaccagaccagcctggccaacatggtgacagccctgtctgtactcacaaatacaaaaattaaccagcgtgtcgtggtgtgcaccatataatcccagctacttgggaggctgaggacaggagaatcacatgactgggtatacgacggtggcaggagc

SEQ ID NO: 679865 - DNA, 403 bp, Homo sapiens
ttaggaggacgccaatcatcctggatgggggctgctccagtgacctcctgttgccttcatggcctctttaaggtcctgtcttcaaatacagtcaagttttgaggcattagaggtcaagacttcaacatatgaatttctgtgggacacaattcacacataacaggaggggtggcataaacttcctcctgtgagttgagacacaggaagagcagccagacatgggcaagtgtggaggagagtggcctctttccacctgtggaatgtggagtgttgcccagagaaggcaaggtgagtggggcttgccagggacctggccaagcaccagccactgaatccttggtctctaataaaacgaggctgagcttgccaagctttggcaactacacatggttggttgggggtg

SEQ ID NO: 679866 - DNA, 904 bp, Homo sapiens
acagcaatgtatatgtgaactgaaaatgcaacagacaggcagaaagaattaggaatgctttgttattataaggtattgtgcaaactgtgaagtggtgatgtgttattgtattatttaaaagcaatcttggattgcttgtaaatgtagattacaaacactagggtaaacactaaaacagtaaaaaaaaaaaaaaaaaaaaggtatatttgaaaatgccaagaaaagagaattctaattctcataaaatgctcatttaaaaccacaaggccgggcacagtggctcatggcctgtaatcccaccattttggaaggctgaggtggggtggaatcacctgaggtcagggcagttagagaccagcctgccaacttagtgaaaccccatctctactaaaattacaaaatttagccaggtgaattgtcaggcgtctgtaatcccagctactcaggagatcgaacgcaggaaaaatcgttgacccctgggaggtggaggtcagggcgtccaacaccaggctgcccacgtgttaaaacctcatctctactaaaaactccacaaattcgccagctggtggtgtgcgctataatcccagtttatagcgcagacttaaggcccgaagaatccacttggaacccaggagggacgaggtttcagtcgacgccagaatcatgcatgccttcagtctgcggacgcgaccattatccttcctaaaaaaaacacaaacacaaaaaaattttggcgggtccgcccaaagtctaaccactcgtgggcgcggcccgagtactacggctcagtgtcagaaccggcacagtgtgttcccaaaagccggcagcggttgaacacagccggtcgctcagcgcatcccccgcgccgacacgcgacgggaagcacccccccggcaccatgata

SEQ ID NO: 679867 - DNA, 382 bp, Homo sapiens
atccgagacactacgttgtaaacgaggggagtcctcaccaggcactgtttcccccattccatccatgaagtgccactcaaattcggtagcatactctggagattttgtaaagttcatagaaggaatagaagtggaagcctagtgaggcaagtatgtaaagtgccagttcccatcggggcatcatgggtccttggcacgaaggttcccgatgcctacgctgagagtttctccgggctgtcccgggcatgcggcgacggcaacgttcacgcgcgccgcgatttcccaagagccctctttcggaacttccgagtcccagcgacatcgtcggcggctgccattggcccaatgtcacccgagatgaagaatggcatgaaatcactga

SEQ ID NO: 679868 - DNA, 201 bp, Homo sapiens
cgaggcacgagtgaataggcagactgagtcctcataaacttttcacggaggacagaatccggagcgcgtccccagacgactgttctactcgtgttggagtagacaacagccctactctccgcctggcacaggatgagcatggcttcggaattgctaagctgcaggctgtctccattcttaatcgtataatggccgtcattg

SEQ ID NO: 679869 - DNA, 408 bp, Homo sapiens
attcgcggccgcgtcgacggcatttgaggctgtagtgtgcaatgttagcaccatgactaggcactggactccagcctggggaatgtagtgagaccctgtctcttaaaaaaaaaaaaaaaaaaaaaaggccaggcacagtggctcacatctgtaatcccagcattttgggagtccgaggtaggtagatcacttaaggtcagcagtttaagaccagcctggtcaacatggtgaaaccctgtctctactaaaaatacagaaattagccctatgtggtggctcatgcctgtagtcccagccacttgggagtctgaggcgtaagaatcgcttgaacccaggaggtggaaattgcaatgagctgggatcatggccctgcgttccagcctgggtgacagagcgagactcagcctc

SEQ ID NO: 679870 - DNA, 143 bp, Homo sapiens
ccctctgaaaccagagggcttatatcaaagcaaaggtcaaccatggcatgcatcttctctgtctccatctcaataaaagcctgacttttcatcctcatcaatatgtaattctttattgtcccataaggctcagcaagcttgag

SEQ ID NO: 679871 - DNA, 576 bp, Homo sapiens
gtaaagtcctggggttcggttgagcactgcccctggagcacagacggtgtatcactctgtagcccaggcgtggtagtgcaatggctgcgatcttggtcaccgcaagtccccgctcccgggttcacgccattctcctgcctctgcctcgcgagtagctggaactactgtggcgtaccaccagatccagctaattgtgttgtatttttagtgcagactgggtttcaccgtgttagccaggatggtctggatctccgtgaccttgggatccgcccgcctcggtctccgaaagtgctgggattacaggcgtgagccagctgtgcccggccgagacttaaaattatgcattgccatattgcgtggcataaaccaaaggccaacagagaggtgacctttcaaattactggcacaagaagagccgagatcagaaagctccaacttaatgcaaacatcgacaagaaatcggacagaaatgacttctgtgtctggtcaacttaacataacatgacatattgccaagcatatatggcttttgaggtagaattgtctataaaggttaactgctttacacaatataca

SEQ ID NO: 679872 - DNA, 203 bp, Homo sapiens
caagcagttaatacagactcagagacacttgggtagggactgaggggagaggtgggagggaaagaaagaagatttgggatgagttgcttcgggaacagagactagggagggaccgatgtgtaaaacgaatgcctggacgtagaggcgcctcagcaccatttgcccattttatgaacaagaattatctacgatcttgtacggat

SEQ ID NO: 679873 - DNA, 504 bp, Homo sapiens
tttctcttttatgccttgaaaaatgtgtagcattcattagtgaattaggatttcattattcaaagaagacataaggtcttcgaagagcagatgactgaataaaataatacctaacagcagtagaatgaggggaggacatattcaaggaacattttatgcccattagattggcagaaatttttaaaaagtgacaataccgtataaaggtgaactttcctatactgatactgggaacatgaatttgtaccattcagggaagagaaacttgataatatctggtgtagtctgaaggggcacagtccctgtgacccagtgaggacattcctcattatttcccttgccaaacatttcacatgagtctataaggagctctatataagagaggtcactgcagcctcctttgtaagagcaagaaaaaaaagcaaataagtgtttaacaataggaacatagataaattaggttatgcagtgaatatttgcactctgactaaagtgagtgaatca

SEQ ID NO: 679874 - DNA, 496 bp, Homo sapiens
ccacctccacgatcccggagctcaagcaaaccctcctgcctcagcttcccaagtagctgggactacaggcatgcgccaccacgcccggtttttctggtagagacaaagacttacaccatctacaggtttacatggaaaggtatcagtcagtggcgttcacactcccaatatttcacgagcaacagagtaggcattaacagggatagagactctcagtcatgttgcccaagctggagtgcaggtggctatacatctggcacattcatagcacactataacctcaaattcctgggctcaagtgatcctcctgcttcaggtctcctgaataagctgggtactacatggcacagcgatccattatacctcatctgcaattcatctctgaaattatgaaaaccccgtgaaggggaggaaagtaacacagacaagaaattaccacaactccaaagcccaactatcctaacacttattataactatcctgagggaagatagtt

SEQ ID NO: 679875 - DNA, 1288 bp, Homo sapiens
tcctgcccgcccccccccgttgacctttattttccccggcgttctcttataagggggttttacccacagggccccttgtgggttggtcgcaaaattttcgcggcccatcggagatgtgtgcgggggaaatttcgcgggtgctcctacacaaagagtgcccactatgtggtccccccgcgagaaccttggcgggttttttgttggcccaccaaaatcgtttatagttggtggagcccccccccccctggggggggacccccccttttcggagggaaaattctttctcagttgttcgtgcgccccccaaggaggcgctgtataaactgtgttttcttcgcgccggagaatattattggggcgttctccgggggaccacaataacactgtgtaagggttctttgttgagaggggctcacacaaaattggtatcccccttggggccgcccaatgatgtctctcgctactaaaggcccctcctccccggggggagatcttctgctgtttgacacgcgtcttttgattgtgagaggagacgggagctcccctcgcgggcgcgttctctgtttttcgcgaaagagggctcgagcccccgcctctcgtggcttgtgcgacgtcggcgcggcgcttttgggtgccaccgaccactattgtgtgggtgtgtgtcctctggtgagattggagagggcggcacaacaagatatggagagagtcttgtggggggagtagaacaactatctcttctgggggccgtctcttgagaagaatataaaagagagcgatattctttcttctcataggagaggatgagatcgccgctctctgtcacaagaggcgcacaagacggtgtgctctcttcacaaactgggggtcttttgtggcacacaagatgtctcatatcccccacccgcgctgtcgcgcgtggttgctgggatatccgcgccacggcgcccactatatacacacgagggtttcacgcacacagacacacgacggtgggtgtaaaactatcccgctcctctcttcactagtgtttccgccctgtgtatttcccagaaagacacactcgacatttcttcttctgtcgcttctccctacgacggggtggccacccaccgcggccgccgctgtaagaagagaagaaatattcccagaaagaggccacacgagagtggggcatggggcctctgagaacgcacgagagaggagagattaagatccccccgtccctcctgggctgctggattttttcgtgtttcctgcccaattaaccggatcagcgcctttacca

SEQ ID NO: 679876 - DNA, 429 bp, Homo sapiens
cttgccaatgagaccctcaggccccagatcatggagctaactgtattaagaggcagagaggctgcaggtagagattgaccagaagaaggatgctgataatctagtgatgcccagctcaagaacggtagccttgactccccagggaagcaggatactgaggaagcatgaggaggaagatgataaggactcactgaaaactgaagcctaacctaggctacgggtcagaccttcccaattaccgctggacccatatcctgtcgggtcttgggacttggcggtccttttctgtgtgaacttccggctgaaagggaaggacatggtggtggacatccagcggcggcacctccgggtggggctcaaggggcagccagcgatcattgatggggagctctacaatgaagtgaacgtcgaggagagctcgtggctcat

SEQ ID NO: 679877 - DNA, 669 bp, Homo sapiens
gctgtgagtggggtggatatccagttccccggctgccgggcagcgtctgcccaccagcacactgtagaagatgaaatccccgaggccaagcttcacgccgcctttcctcctcttcctccagtcccctccccgtggagtagccagctcgaagggaggctcaatagacttcgagggtatgacaggctccccaaacactgtcatacggagtcttcttccatctccgcggtcgtaaggggagctgagagggcaccctgcagaggcaggggtccacgcttcgccagtgccaatccgtccacaccatgtgcagactgagtatatcaagggcaggcaatatgggctcatttctctcctgggcagtttctaccagcattctcagaggccctttgggacacagcacagccacgagatcatacacagagatggcgcccaggatgacccacgcggaccactctgggaggtacttgatgaacactagggccatgagcgcactgatcatgatgaggtaggcctgctgcagcaccagagggcccttccagtggatgcacaccatgcccactgccccgaagttccagacagtcagcaagagggtggggtagtccatggccacattgtaggtcttgagcacttccccaaggtagatataggtgaagaggaacagcagcatcagtg

SEQ ID NO: 679878 - DNA, 278 bp, Homo sapiens
caggaagtatgaagcagctgttatcagagcaggtatagtctggcacactcaccctccgattgagcctgatcacgcccatcttacatgtgagacccatcatggtcaagtgcttgcccgccacaaggtagcctctcaggaatctatctgggtaatttggatctggctctcaagacccaaacacctctggattttcccaatacccgctaatgtgactcagcatccccgaacccagcaaattctggtggggaaagagtgtggtgggcaagagataaggagcc

SEQ ID NO: 679879 - DNA, 224 bp, Homo sapiens
  misc_feature (199)..(199): n is a, c, g, or t
aatgtcggtgtgtctaatgtcggcgtgtctctctctttctttctttctttctttctttctttctttctttctttctttctttctttctttctttccttctttctctctctctctctttctttctttccttccttccttccttctttctttccttcctttcttccttccttccttcttctctctctctctctctctctgnttcttttttttagctaccctggagg

SEQ ID NO: 679880 - DNA, 628 bp, Homo sapiens
caagtagttttgtattgaggcgcgtttcctggatgctgcgctctgcctaatcttctcagtgtcgattggctggtagtcctcccgcccgttcagtgatagaggttccgctaggctcggagttctcagcttccttcccgttggtgagcgtgatgcctgtcttgggtttattattgcctgctcacttttgcatgaggaactgcatctccttgctgtccttgacagggttgaggacatacatgtccagccggcccacacccattttgtggaagagggtcagtggcccaatggtattgctgaccacacgatatagaggctcagcctggatgcccaggcggtttaagtgctgcagagtgaggcaggcctcctcaatgctacgcttggctttccgggaggcatcaggaagccgcagcttctcaggcacgttgaaaaagacaactccaagctcaggagagataaggttcttcacccagtcgctgtaactgctagagccctgggactgctcctcctctagctctgccaatttgcgctgcagtagtccattgatgcctggcaggttgtctgacccaatgtgtgtgagtagcaccgagtcaatgcggtcaagtgccgtacaggttccaaaaaggattgg

SEQ ID NO: 679881 - DNA, 1070 bp, Homo sapiens
  misc_feature (689)..(689): n is a, c, g, or t
gagtagattcgtcatttctcttggctgagagcgcacatggatgtcgcacctcatccagaccctgaacggatacatcgagacagccgtctggattgacgcagcgcggtggctgatatatatgaggcatgtgaaagaggacgcagctaggcgttgatcggctatctaccaacgcatagaaagacgtgatgcctcgcaatttacaaatgcgctgactcctgtacacctataccccacggctaatcggagcgcctgatgcagcacttccccgtttaactttaggatacccctgctggcacagggcgccttgggccactgcgaactggttagtggcaattcgtggaattgtgggaaggttagttacgacccgtgcctgcactgaaagctcactaaaggtgaactgctatcaatggaggtatcaccgtggtgcacgcggacatgggggcgaacgaccagttcacgatgacattgaacgaagaccatattgcctcttctttactcgtcctttgtgcacgatttctcgcgtctccgtaccccacggtactaatcagctatcaatgctgtaatgtctgaagcatcagagactgctcgtgctgcaacacactgttgtgggctgaggtgattggagcaggggctgggactgctgggtgttcccacttggttacgcttctttgcttgtattcattcacttncaaggtgcttgcgcatctgcgcagttcgcactatgcagaattgctgttctcacctgtcattacgctccccaaaacatgctcttgtagacgtgcgtcataacctgggatgaccaccgagtctactagcatgtagctggaagctatcgctagcggaaaagctaacaagggaccccccttgtggttcggcacactcttttcttcttatcgaactatagtgtcaggggatggctcgccttgagaaggtacgccacgcaagtaggtcgtattcgccagtttgccagtgtcccttctatgtcaattgtaggaatggctcaaccttgctgggggacaaggtcagtgactggagcgggcaaaatgaccgtaaaggggcctcccttgttg

SEQ ID NO: 679882 - DNA, 160 bp, Homo sapiens
  misc_feature (44)..(44): n is a, c, g, or t
  misc_feature (149)..(149): n is a, c, g, or t
cataatgtgaccagggtttgccttcaggtggtggggttatgggnagttttttttctcttttacttctctaacatttcagattctgcagtaagcatgtgttacattgtaattataaaagtaagtaacttcatttatgaaaaaagatttcnttgtggtccta

SEQ ID NO: 679883 - DNA, 231 bp, Homo sapiens
ctagtgatctaaatctacaaaaatttaaaaatagcaaggtgtaggtggctcgcgctgtagtcacggctactcaggaggctgaagctggaggttagcctgagcccaggaagcagagactgcagagagccaagaccctaccaccatactccagcctggcgcaacagagtgaaacctctgtctcgaggactcactcgagccccagggctaccgacgctcgacattcgtaactca

SEQ ID NO: 679884 - DNA, 126 bp, Homo sapiens
cagggtcaccactcaccacctgtccgaatacaggccttcgatacgggataatcctagtttattacctcagaatgttttttgcttcgcggtgattttccgtgacgcctttttaccatctccatgcct

SEQ ID NO: 679885 - DNA, 880 bp, Homo sapiens
atatggtctaggagagtaaaacctaggatataagtcggggaaaaatgagtaacacctcaaaagcacaggcatcaaaagcaaaaataaacaaatgggattatatctaactaaaatgctgttatacagcaaagaaagcaatcagtggagtgaaaagacaacctacagaatgggaaaaatattgcaaactagtcatctgacaggagattaatatccagaatatacaggaaactgaaacatctcaatatcaagaaaacaatctgattttaaaatggtcaaataatctgaacagacatttctcaaaaagagatttaaatatgtccaacagataaataaaacaaaatgtgtggccatcaataatcttcaaggaaatgcaaatcaaaaccacagggagttatcatctcaccccagttaggatggctcgtatcaaaaaggtaaaaaataaaaatgctggtgagaaagcagagaaaagggaactcttatacactgttggtaggaatgcaaactagtgcaaccactgtggagaacagtatagaggtccctcaaaaaactaaaatagaactaccatatgattccggcaatttcccactaactggatatttatcccaaaggacaggaaacttattacatgtggggaaggacatctgcaccccccatggtgtaattgccgcatggtgccataatagccaatatttgggatcacacctagggtgcacgaacgggaaaagggggtaagggccactgggaaaatattcaggccaaaaagaatgtaacccggtgttccaggaaatggggggcggacggaacctgtttgtgaaaacggcgcaaagggccaatatcccccgggggaaaaaagggtttaacaaagacaaccgggggacaa

SEQ ID NO: 679886 - DNA, 229 bp, Homo sapiens
cgactcgtaccccaggagtctgggattatgacccaagtcaaaggtagatgctcaaccacagagccacccaggtgccctccatctctgttttctgcgagattattacagagggaggttctttctgcctaatttatggcttcctcaatggtgacaagcctgtgccataaactagacacaaagccagctgttcagcatccacaatcagataagattagctgatccagggtgc

SEQ ID NO: 679887 - DNA, 924 bp, Homo sapiens
  misc_feature (206)..(206): n is a, c, g, or t
agcggggtcggaagcctgggaggcgctgccgaccgcgcctgcgacagcgtcagccctgacgcggagcgccggcccgatgtgcggtggcggcggcgatggccgagcaggagagcgcccggaacggctgccgcaacatgtctggcggcagtccaggcgtgtggaggtggcatagctgcgcgcctagcggtctagcaatggcgattacntacgatgcgcaccatatgtacctggaccctgtgtctttcatcgtacatgtcctcagtagcaaggctacacgggagagccctggtgatgcctcattgtacgtcggcgtgacgcccctgcctcgttcgttcaagctcatggccaggcaatatcacagatgcagtcaggacctatgttccagtgcttggtccgtggatgtccccttgggatgaacggcgggaaggtggaccgtggcatgactaggcctggctggacacaatctggtcgtacactggtgttccagacctgagttggatcgctccaagcttctccgtgatactgcgtgaaccattgtggtggtccaggacgtccccttgacctgtgttcccctatggggcgctccgggaagcctgtggtccatcccccggggtggcgtccatgactgctgggaccctcaccaccttgtggaaacgatcgaaaactattggtgagtcaagggtatcactttgcatgcagctctaggcggactggggagggcgcttgtgcctaacacttgctggttggacgctattcccagcgttccgcgcggcttcccgcactcgaccggtgggacattggttccgtggcccagtgcccgtggcttacagtttcctctggtttcctggagacccaacgttgcgccactcggtggttctgcccgacgtacgccccaggaagcccccgtccatcgaggacgggcct

SEQ ID NO: 679888 - DNA, 440 bp, Homo sapiens
gttaccaggaatgtctagtggtgcttctagcctaaagtgacccacatttcagactagacagtttaaatctataactcagagggagaatagattaatatcttctcctacggaagagatacccagaagctaccacagcttaaatgggacttacatgcttaaaggtggatatgacatggccaaagtcccatgaggaatggcctccaggtatgatcaaatccagtgcacgacggaacgtctcttctcatagtatccaattgcaaaactggtcaaaattcacccattttctcagggttcttctaaaagctgttggacttgtactgcttcttcggcttctctggctcttgttccagcttccgcagttacaaaatgagaaagacctcgctgtgctgtcctccattcagtgggttctggatggattgccagatcatgtgaagggctct

SEQ ID NO: 679889 - DNA, 118 bp, Homo sapiens
aagatcatgccactgcactccagcctaggtgacagagcaagaccctgtctttaaaaaacaaacaaaccaaaaaaaaaaaagatttccatgaatccagtggacctaaatgcgggccaga

SEQ ID NO: 679890 - DNA, 694 bp, Homo sapiens
  misc_feature (658)..(658): n is a, c, g, or t
gagcaaatttcaaatctacttttagttctttaaggaatctgcatatttttttccataccagcagggtaaaagtgttcccttttcaccacagccatgccaacatctattatttttggattttttaattatgaccattcttgcagaagtaaggtggtattgcactgtggttttgatttgcatttccctgataattagtgatactgagcattttatatgtttgttggccatgtgtatatcttcttttgataattgtctatttatgtccttagccaactttttgatgtgattatttgtatttggttggattttttttttttttgtcttgtgatttgtttgattgccttgtagattctggatattattcctttgttgaatgcttcgtttgtgaagattttctcccactctgagggttctgtttactctgctgattatttcttttgcggtatagaagctttttagtttaattaagttccacctttttatttttgtttttgttgcatttgcttttgggttcttggtcatgaagtctttgcctaagccaatgtttagaagggtttttctgatgttaccttctagaatggttacagtttcaggtctcagattttctttgatccatattgaattgatgtttggataaggtgagagattaggatctagnttcattctcctacatgtgtcttgccttatcccgcct

SEQ ID NO: 679891 - DNA, 434 bp, Homo sapiens
gaccgatagacgtgaatggccggcatcatggagtaagattccctagcaggctctcctggctcctccctaatctgggagcagaggatcagctgtttctctttgctatggctgtgagagagttcaggcttaaacttgctgcccaactttaataactgtgtagcatattatcacatacatttctctcaccaaatttccctctgtcctcactttagtattcagccttaattttccttttgttttgttcatttgcattttgcttatattttcttatacttcaaatattttgtacttaaatacttttttttgagggggggaaccagtaaagaatgaatgcataacatttatcttcagacattctggtactatcttatcatgtcttaaagcccaggaaaatatcatttgattatgattatttctgatgatggacacctagg

SEQ ID NO: 679892 - DNA, 435 bp, Homo sapiens
  misc_feature (121)..(121): n is a, c, g, or t
  misc_feature (130)..(130): n is a, c, g, or t
  misc_feature (242)..(242): n is a, c, g, or t
  misc_feature (416)..(416): n is a, c, g, or t
ccgcatgaggcagaactctactgcaaacagtgccacggacgcaaattcggaccaaagggagtcggatttggacttggtgctggatgcttgacaactgattccggagaaaagttcggtgganccaaacagncgtaatcgaaagaaaaacattgttatcaatctcaaaaactcgtcaggggataagcaatcgtcctatgacagccgaggcattcaccgcaccaatcaatccttcccatagctgnactttctctttcacttttcaatttttattcaattttctataatattcctcaattgctaaaattttcaactttttaattggacatttctcaattattactattattattattattattactctaataatgacattttcaaataattgaatacccctggtactttcgttcctactnataaatattgttaagcttc

SEQ ID NO: 679893 - DNA, 155 bp, Homo sapiens
  misc_feature (127)..(127): n is a, c, g, or t
ctgggcgtctggggggctgggccgggctgggcgggccgggctgggtcaccagcaggcagtggcttagtgagcttgaagttgaccgggtccacccgaagcttgtgcgctgtgcagtgtcgctcacggncggacagcgctgttgggcatgtctgtcc

SEQ ID NO: 679894 - DNA, 412 bp, Homo sapiens
gagagagagatatagatcacacactgcatgccgccaacacgggctggctgtgcccatgctcagcatgcctcgaggagaggaggaggcgtcagctgctttctggtgactgtgcggcacctgaccgcgcgctgaatgctcgctagaatatcgcccagtgtccatgacatgagatacatgcgtatcactgagtgccgatttattttgtgcgcgcgattctgctttgcatgcagatgtccactttgcgtgcacttccagtgctcggaccctccgcatccatacatgcggttcacggcacgtatgtctagcatatcctgccctgtatatgttcacttactcacagtcactaacacctagtctcgcacgaatacttcaccgcaggccttgccagtgctcctagtacgaccgtcttgcc

SEQ ID NO: 679895 - DNA, 796 bp, Homo sapiens
  misc_feature (53)..(53): n is a, c, g, or t
  misc_feature (122)..(122): n is a, c, g, or t
  misc_feature (157)..(157): n is a, c, g, or t
  misc_feature (178)..(178): n is a, c, g, or t
  misc_feature (183)..(183): n is a, c, g, or t
  misc_feature (191)..(191): n is a, c, g, or t
  misc_feature (198)..(198): n is a, c, g, or t
  misc_feature (202)..(202): n is a, c, g, or t
  misc_feature (213)..(213): n is a, c, g, or t
  misc_feature (215)..(215): n is a, c, g, or t
  misc_feature (241)..(241): n is a, c, g, or t
  misc_feature (244)..(244): n is a, c, g, or t
  misc_feature (247)..(247): n is a, c, g, or t
  misc_feature (270)..(270): n is a, c, g, or t
  misc_feature (273)..(273): n is a, c, g, or t
  misc_feature (277)..(277): n is a, c, g, or t
  misc_feature (282)..(282): n is a, c, g, or t
  misc_feature (291)..(291): n is a, c, g, or t
  misc_feature (329)..(329): n is a, c, g, or t
  misc_feature (349)..(349): n is a, c, g, or t
  misc_feature (416)..(416): n is a, c, g, or t
  misc_feature (434)..(434): n is a, c, g, or t
  misc_feature (443)..(443): n is a, c, g, or t
  misc_feature (453)..(453): n is a, c, g, or t
  misc_feature (456)..(456): n is a, c, g, or t
  misc_feature (461)..(461): n is a, c, g, or t
  misc_feature (523)..(523): n is a, c, g, or t
  misc_feature (531)..(531): n is a, c, g, or t
  misc_feature (544)..(544): n is a, c, g, or t
  misc_feature (550)..(550): n is a, c, g, or t
  misc_feature (559)..(559): n is a, c, g, or t
  misc_feature (570)..(570): n is a, c, g, or t
  misc_feature (585)..(585): n is a, c, g, or t
  misc_feature (588)..(588): n is a, c, g, or t
  misc_feature (606)..(606): n is a, c, g, or t
  misc_feature (641)..(641): n is a, c, g, or t
  misc_feature (644)..(644): n is a, c, g, or t
  misc_feature (662)..(662): n is a, c, g, or t
  misc_feature (672)..(672): n is a, c, g, or t
  misc_feature (675)..(675): n is a, c, g, or t
  misc_feature (677)..(677): n is a, c, g, or t
  misc_feature (700)..(700): n is a, c, g, or t
  misc_feature (705)..(705): n is a, c, g, or t
  misc_feature (714)..(714): n is a, c, g, or t
  misc_feature (717)..(717): n is a, c, g, or t
  misc_feature (720)..(720): n is a, c, g, or t
  misc_feature (786)..(786): n is a, c, g, or t
ccaatccacagggctctggtcaaaaggcatctatgtggcttctaatacaaaangataaacgagaaatacagaaagaaaatatcaaacaagccagtgacaaaaaaaaaaaaaaatcccaaccnacaaatttgtcacatggggcctgcgttagaaaacnggaaaaaagaaaaagaaaaanaaaancagtcccngaaaccnggcngggggtttttngnggccacagggggcttgcctaagtcanccnggngaaaggggacagaggtggttttnggnatanggccnccgcctccngtttcttgccagccatggtcacctgaggggggggggcnagcctggccacccaacattnggcatcacttatgcggtttgagggctcaaagacaagcggccttggggtttcccagtccatatctccnctgaatctctcccatatncagtctctngtcactcgangcngaganaatgaggggctcatcagggtggaaagccactccattgagggggccagcttggccgggcagcntaaacaanattctcctgcttntggtancccacaaanaaacaaacctnttggctgagccagcngcnattttgcttccatcaggngaccaagaacatctcagaaggttcttttcaaagtngtncacatttccttgaaaaanctttacacanctntntttgggggcaaatggccggacancccanaaacgaacngtnttntccattgcattggacaaaagaaaagagccttcagaacttaaactcaggccagttactgaatctgcntggcctctca

SEQ ID NO: 679896 - DNA, 280 bp, Homo sapiens
ctgtggaactctcaaagggcgaggcgggcgcagtagtccacacctgtaatcccagagttttggaaagctgggtggatcacctgaggtcgggagtttgagaccagcctggccaacatagtgaaacccctctactaaaaataaaaaaaattagccaggcgtcgtggcacacccctgtaatcctggctactcaggagtctgaaacaggaaaatcgcttgaaccggggagatagaagttgcagtgagatcgtgccactgccctccagtctgggtgacagagtga

SEQ ID NO: 679897 - DNA, 125 bp, Homo sapiens
atatattagtatattaatgtatgtgagttatatattctatggtatattatataaattattacatgtggataataacataatagtaataattattattaggcaattttttgatgggtagtcacaga

SEQ ID NO: 679898 - DNA, 215 bp, Homo sapiens
aattgccgcttcaacaggtacaagcaagtattgccgattacgcactcgctaatccatcacacacactagtcaaactacaacacaactgccagtcatgatgcgctacacgttcaatcgatcaggctaaccattacggccagcacgcatgcgttaattcccatgtcattgattaacatcacactgatcttctatggcttggaccattaaggcttaaa

SEQ ID NO: 679899 - DNA, 997 bp, Homo sapiens
  misc_feature (557)..(557): n is a, c, g, or t
ggcgtggtcatatccactagtgcaatgcgggctgcctagggagtgttgttgctgaggctaagctgggattgcgtagctgcgtcagaccgcattgactcgaggcttctgatttccgcacgacgagtgcgccgactcgcgatctgtactgatggtactcagtgacaatcaagtggagcatacagtcgcattgcacgcctatcaaggcgatgatacgctgcatgatcgtgaagcaaagtgttcacttcagcggagacatcgctgggtcccacagtggctcatgaggatcgaatctgtagcaactcgacgattggctgaactctggcaaggatactgaggtggaagcatcctcagaggcaccccttgtagaccgtcatatgggggcgagtcgacaggctcgccctgttgtcatgtaattgggcgagactgcccgagagctagcgagacgttacccatgctgagcaaatgtgccatgcgttgaattggagaggatcgaatatcgccgtagcttgccgtgaacgagagtccgcatcatctatacggggtgagcacttcgtccnccattccttccttcactcaaacgcaacgcataagttacagactgaggggtcagatcgacccgccactttacccatgcaaacgtttttcatccgtcgggcagtccggaattcacccttcgttggccctccaattggtgacgctcatgtggccaatggatggtgatgaacaccggatgccgcttgaattctagaccttgttgaatccatctttatgatcaagtccacaaatagggggtgtgcggccctaccactgtgtgcctcacctatgcgtcccttgaatgtgggccatccgctttttctagggatgccccgacataagtggcaccccttaggcgccaaggcctgttccatggaccttgctcttactgcccaaggagatgcaatactgggctgctgctgccacaggcatctatcgggggtcaatcagccagcccttccat

SEQ ID NO: 679900 - DNA, 659 bp, Homo sapiens
cagcggcaactccaggtctgcatcgccgaagtccttatcacagcgtacaaaaaccttcaccagttagctctttcatcaccttgctgagttctgggctagatgagtagtccaattccgcgaggctggcacgccctcgacagtgcatgcttgcaagattgcttcgttgaacctgtaggaagcactctggtgccagtacgactgactcgtagccgtgggggcgtatacgcctttcgggctctttatagttcacgagcgcttcggagtacggcagagatagtgaggtacaccatgctgggctcaactgtcggcataccgcttagcaatatcagtactgtctccgaagaagagaaagccttccgagtaggcagagcttgttgcctcgaggcgacagcaaaaaaccattaaacgcgttggatgctgccttaccagccaattcaagcgaggggagaatgttggatgtgtccttaagggacccaagttctaggtcatgggtgtttccaggctgaatgcgcttcatatgccgtaatcaggcgataccatgagttgtcgtcggagtcttctccgagaggtagctggatccagttggcgaaaccgtatccctgggcgtggagttcgtaccaaaaacatccgcattgattcatgatcgttcgtctgaggga

SEQ ID NO: 679901 - DNA, 4595 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (4259)..(4259): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679902 - DNA, 3112 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagctaaaaaaaaaaaaaaaaaaaaaaaaaaaaaaaaaaaaaaaaaaaaaggggggggggcgcaaaaaattcccccgggggggcccattccccccccttttttgtttcaaagggggcccccaaaggggggggataaaaaaagacgcgggcgccgtttaaaccgcgctgcgcggggaaacagtctccctggggcaccggggaggaccccttcttggggcggggaccaggcgacccccccacagaattaagaccgggaataaaactcgggttgcagtggcaacccgcgcatgcctcgctgaattggctcggttatataaatagcaggcacaagatcaaatacggaggcagccgccacgattggcttcggttaaatacacagagcaaaagcacgcacatcaaagacggtaaatcgactacatcaaccaagacacacacatcatca

SEQ ID NO: 679903 - DNA, 4909 bp, Homo sapiens
  misc_feature (4573)..(4573): n is a, c, g, or t
ccgtggggaattagaatatcatattcatagattacaggtgtttaaatgacaaatctggtcatatttcttactctgaattaaaaattggacccttgggcccagctgataggagctgatgggtatactgggctgggggctgttaccaccccagttctcccgttctccagtcttcctgctttgttgaggactggctcattgtttgcttctttttcctgccaggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679904 - DNA, 897 bp, Homo sapiens
  misc_feature (259)..(259): n is a, c, g, or t
  misc_feature (342)..(342): n is a, c, g, or t
  misc_feature (344)..(344): n is a, c, g, or t
  misc_feature (466)..(466): n is a, c, g, or t
  misc_feature (510)..(510): n is a, c, g, or t
  misc_feature (537)..(537): n is a, c, g, or t
  misc_feature (552)..(552): n is a, c, g, or t
  misc_feature (589)..(589): n is a, c, g, or t
tcacctcattccaccctggcacacaccgacttgaagctggcccagacatggccagtcccccatggcagcctgatcttagtagcagacaatgcagtgtgtgcagtacatgcactcacaacagcatgcacaacacagtgttccactcccacatacacagtgcaggacatcagccaaccatgtaccgccctctcgtctctatgcaccaagaggctgggtcccagcagcaggtggggtgcagtgagcaggcaacacaggaggnctggagccagtgcaccctgccagcctcccggactcctctctggcaaccagtgccccgctgtgctgcaccctctgccacgagcngntggaggacacccattttgtgcagtgcccgtccgtcccttcgcacaagttctgcttcccttgctccagacaaagcatcaaacagcagggagctagtggagaggtctattgtcccagtgggganaaatgccctcttgtgggctccaatgtcccctgggcctttatgcnaggggaaattgcaacatccttgctggngatgtgaaagtgaanaaagagagagactcgtgacttttccggtttcagaaanaaccaatgattacccttaattaaaactgcttgaattgtatatatatctccatatatatatatatcaatgacaagggaaagtgtagacttccataaacatgagtgtataatgtggattggtggagaatacattgtgcttctatatatgatttagacgacaaagaggtatgtagcttataaagacatttctttgcttgtgttaacgttgattgagcatatctttgtgctttattatcctggtgacagttaccgttgctatgtaggctgtgacttgcggcttgttttcagagcacttggcaaatgcagaaa

SEQ ID NO: 679905 - DNA, 187 bp, Homo sapiens
aaaacccccccccccccgggggaaattcaaaattgttttttccgcccaagggttttccctgggcccagattggaaaacccgggcgggggggggggggggggtgggggggggaggggggggagccccccccccccccccccactttttttggagaaaaatgcctcctggggccggttttgttttttta

SEQ ID NO: 679906 - DNA, 5093 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (4757)..(4757): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679907 - DNA, 224 bp, Homo sapiens
taggataccccatagtatgatgctatgcaaacttctgggacactcccttaactggcagggattagccccatttcaaagaagtagagaggagtggcatccatctcccctgacggcggcaccatgacgtcataaattcatttcccctgggctgcttgcacggtgatgtcatacattcttttccccgggctggctgtgccggtgacattcataaatttcaggggtac

SEQ ID NO: 679908 - DNA, 5390 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (5054)..(5054): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaataaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679909 - DNA, 470 bp, Homo sapiens
cgcatggagcgctcgcgccgcgcgcggtcctcgtccaggcgctggatggtggtgcgaacatgctccaggtgctcgccgatgcattcgcgggcgcgctgcgggtcgccgtccaggatggcctgcatgaggctctggtgctgcacggtcagctcctgcagggtctggggcgcgctcaggcggaacatatcgtggcggttgcgctccaccgtggacagcaccacggtgaacaggctgtgcatgacctgcaccagcaccaggttgtgcgaggcctcggcaatggccaggtggaactgcgcgtcggcacgcgccgccagctcggcgtggccgctttgctggtgctggatcatcacctcgaagcagcgctggatatggtccttgtcgcgctccgtggcgcgctgggcggccagccaggccgtactggtctccagcgcatggcgggtttccagcacgtcatagcggtagtgggagtc

SEQ ID NO: 679910 - DNA, 4400 bp, Homo sapiens
  misc_feature (4064)..(4064): n is a, c, g, or t
tttttttcttgagtttttctaatcctatcagcagctttaattattcagcaccacaattttacatccatttccacagtcagggttacatttcactctccgaagtctcctgctctttgcagtcaaaacagaaacatgagtattcatcctcatgaaaacatgaacatccaagctctgtcttagcatcggtttctgtttcattttaggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679911 - DNA, 350 bp, Homo sapiens
cggtgcagcgatgtttgtggtcgtctctagcaggatcccctgatgcgtctctagttgagcgcgtcttcatagtaatgtcacaggccggtgacacggagggggtggaggtgagtgggacgaagtagaggcctgagggtctgtgcctttgtcgaaagtccacagaggaggagcctgcacatcttgacatcgtttgccggggaagtgaacggtttaaagctactgtaggttaaccacagacagtgaagaatgtcaaatataagctacaggctactctctgtggcagcactgtattccgacggacagcagcagcggacaccctcatctgtatacactaagccctcataaacacg

SEQ ID NO: 679912 - DNA, 3981 bp, Homo sapiens
  misc_feature (3645)..(3645): n is a, c, g, or t
tttttatgtttcggttttttccgccatggtgtgcgttgtgcatcgctgggttgatatctgatgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679913 - DNA, 248 bp, Homo sapiens
cctgtactctcggctccttccgggtcttggtacgcgacggacttggcaactggcccgtctgtcgttggggggtgtccggcgctgtgttttggtgggcgacttgtcctggctgtggttcgtgcgactttggggctacctagcgggctggtcctcctagctgggcggctctgctcacggctgagcacacggtatgcctcgctcagatccacaaagcgggtgtgcaggctttggtaccccggaaccgggga

SEQ ID NO: 679914 - DNA, 620 bp, Homo sapiens
ccagtcccagaccccccgcctggtaaccggtgcgggcccccagaaaggcccccgacccgagccccggaactccagggactccagagtgatggcgaggagaaccagccccggcctggtgatggagccgcgctctgctccagtgatgagagagtcctgaaggcaatcccgagccaccactggagggagacccccgggagccggccaactggcgttcaccatcgagcccccctggggtgccagcctccagccaatggcggaaccagagtgagtggctgagcgtcccaggctgcgccgatgagccaccaccactacttactgatggccctttcgggggtccctgcgccccaccggagaggcccggtgcaccgggccccccccggggcttgggggcatccccggcttcccccatagcagctgctcttgggcctcgggagaggagagacccccgttcccctgggctgccctttccccgggcctcgtctgttcttgggtgcctttggtcaatagttgcacccgtttttattgctccccaccccttttgtagtgggctgggttttaagttataaatgttaactgcctctgggtgaaaaagtttttaataaacccctattacctcctga

SEQ ID NO: 679915 - DNA, 4269 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (3933)..(3933): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctgtggttctgtggttccggctactcaggaggctgaggtgggagaactgctcgagcctgggacatggaggctgtagcgagccacgatcgtgtcacggtattccagcctgggtgactgacagagcatgatcttgccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679916 - DNA, 1575 bp, Homo sapiens
tttttctttggaggggggggcgccgcaagcaacctccttctttggtttgaatactattcgtcccgccacgtcagttcgtggtgtgtctgtgtcgtatgaatgtgtgcccccgccctgtgggtgatagtatgttggtgtgctgttcgttctgagtactcttgccttgcgacggtcgtgtgtggagttgtggtatggctcgtcgccacgggtgtagttgggggggggagtgcataccccctcacctcctatccttcgctccctgtggctttgttcatttctatgactggttgcggggcggacccgatctattttttcgctctcgcctacagtcatcgggtgcggtggtgggtgtctttctgtggttccacgcgcgtcggtgatttttgttgtgttcgcagccagcgcgtctgtctcctgcttgttgtctccgtctaccggctagaccgaacgcagggatagtgggggtgctcgcaccgacatatcattgtagactcactgcctttgtgtggcgtgtggctgggtggggcaccccactcctcctttgttgtttttgtgggatgcgccccactcattcctgtgtgtgcgtgtttttgttgggtggtggctgaccacatcgtcggaagggtggctttgctgccccctaggctcgtgtgtgtttgtttgtctcgcggtacctagattacagaatagtgttgtgttcttctccctctagtgacgggaggagtacagctgcaactctgtttttttctctcgctttgtgtgggtcccgcccccaccaagcgcccgctgtctcgcagtccagctccgcctactgggtggggcacccgcgcttagtggtgggctctttttgtatagtgcagtggagtgtgcgtgctccccaccccaacacacagtaggtagtatgttgtagcggccccgcgccctgctcttcgcctacgcatcgttcgcaaacacccgtgtggtgtcggtctatttatctcaacacgcgcctctctctctttcactctcagctcagagtgcgagataatatatttatttttatgattttctctcccgctcggcgaggggcggtgaggtgcgagtggattatctttctccgccgccgccgggcggacacacacgttgttttgtgtatcaccgccacgttcgtgttttggttcggaggaatatatatttgtttgggccccctgcggccgccacttgcggtttttctctccccacaccacgacatagatcaccactttctttttcttatcactcccgcgcggggcgcggggcagggtgtgcggtgcaccccacttcttgtttagatagtgatcactggcagctagtttttcttgtgtgacatacgtcgcgcagcccactcctggttgtggagacaagaggctatgcttatttctgcttaataaaagatacgcaacccttcttataagagccggcgtaggaattcaatcaggggttttttttgtttcttttcgcaggttgtgtgtccccaccttttggggtttttttgtttgtgggcccccccccaaattttgttcaaattttttttagagttccccccccccaacaata

SEQ ID NO: 679917 - DNA, 5221 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (4885)..(4885): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679918 - DNA, 5419 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (2140)..(2141): n is a, c, g, or t
  misc_feature (2159)..(2159): n is a, c, g, or t
  misc_feature (2179)..(2179): n is a, c, g, or t
  misc_feature (2184)..(2184): n is a, c, g, or t
  misc_feature (2196)..(2196): n is a, c, g, or t
  misc_feature (2199)..(2200): n is a, c, g, or t
  misc_feature (2207)..(2207): n is a, c, g, or t
  misc_feature (2214)..(2214): n is a, c, g, or t
  misc_feature (2226)..(2226): n is a, c, g, or t
  misc_feature (2239)..(2239): n is a, c, g, or t
  misc_feature (2241)..(2241): n is a, c, g, or t
  misc_feature (2243)..(2245): n is a, c, g, or t
  misc_feature (2252)..(2252): n is a, c, g, or t
  misc_feature (2283)..(2284): n is a, c, g, or t
  misc_feature (2286)..(2286): n is a, c, g, or t
  misc_feature (2292)..(2292): n is a, c, g, or t
  misc_feature (2298)..(2299): n is a, c, g, or t
  misc_feature (2316)..(2318): n is a, c, g, or t
  misc_feature (2324)..(2324): n is a, c, g, or t
  misc_feature (5083)..(5083): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagataacaacaaaaaaaacaataannaaaaattaccatcatatntatttctattctcccaacanatgtnaaggaacaacanaanntatcacnaataacnaaaaaccataanacaaaaaataaanancnnnaaaaaanacaaaattgtctaaaaaaatggtgtaatcannanaaaaanaaaaanncttataaacaaaaactnnnactacnatttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679919 - DNA, 217 bp, Homo sapiens
gcccggtaatgcagctctctctgatgccccgtgtaccaatatgtaagggcagtgtggaaagcaccttcatcgaggatacagagactattgaccgagtccgtgtaaatggctggcataccctattcctccgaatcagcatccccaccatcaacatggcagaacaagaccacgtgcttctctgtggacattgactcggagctggtgtaggagctgccgg

SEQ ID NO: 679920 - DNA, 175 bp, Homo sapiens
cacgggccgtcgttgtccactaacagctataaccatgcatggcccgtcgttgaccgctaaacagctatgaccagtcactggccggtcgatgaccactaccagcatataccatgtacgggcagttcgtttgcacgcaaacggcctataaccatccacggcccgtgcgtggtaccag

SEQ ID NO: 679921 - DNA, 270 bp, Homo sapiens
atggcatggctttggaaaggagaatggaaaaatagaagaaggtcggccgggcttggtggcttatgcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggag

SEQ ID NO: 679922 - DNA, 206 bp, Homo sapiens
gtgtgactccgttccttctctgtctccccaggattatcctgatgcccttatcaccaactactatctatggcctgctgtgcacttagccaacttctacctggtcccccttcgttacaggttggtcgtagtccaatgtgttgctgtcatctggaactcctacctgtcctggagagaacatcggctctaagactgactcaatccatcgt

SEQ ID NO: 679923 - DNA, 837 bp, Homo sapiens
ctacttggctttggaactgccgccccacccccagagaggcccccccctttgttctatccctcagacccgaggagcccttccataaggattttccaaaaggggactcacaggaaaccaagtcttagtgcttgggagggaggccccctgcgtgctcaaactcacagcccacctggaaggtagacgagattgcgtccccccacgcccctccacaccccagacgtccgagttaacggccggtaggccggagtcacctcccctatgccagtggcccccgctgtactcccatcctcccgtccaggaagatcagctgtgaataaacgctgggctccccccagagcacctgtccgccccactgcccttgctgttctgggatcttcgctccccagttcacgggaaaccagcctgagtccgctcgcacccgcggctgctctcccggctcggcccggccgccctctgtctccggcccccgcggtggcgcttccgagccacgagcccccgcgtcccggcgctttcccggagcccccggcccgccgaggaggcgaagcccccaacgagccaaggtggaaaacaccgtgcctacgcctgtaaagaaatcctgttcccgagcatacctgttgtaccaaccgaccctggtcctaacgagaggagtgacgtattttcatccccctttttaatttgttttcttacgggtttacgattttgaatttttcttatttggttgaaagaattttgattctatccgcctgagtgagttccgcctgtaaaaaggatgttaagctgtgggtaaataatgccaaccaaaagaaatatattgtaccaattctatataataaggta

SEQ ID NO: 679924 - DNA, 156 bp, Homo sapiens
tggaccacacgcacgtattatactctcccttttgtactcatggaacatcagagtacgagcagaaaggcatttaagagaagaacaaaaaaaagggggggggggacaccgactcctgtgtaaagccacctgctgataacttgacggctggaaaatgcc

SEQ ID NO: 679925 - DNA, 272 bp, Homo sapiens
tctatctgtacatagattaacacacaaaaacgctgtaacagcaactataactacaatacacaaaaagataagcataaagatgtctctctgtgttcttggcaaccttcacatattttttgcctaccctctttggggactacattcacacatttatttgtctgtttgaaactgtgccagaactcctgatgctgtgttagttgtttccatcttttttgtttccatttttaatcagtttctgggatgacggtcaacacacagtaaggggtcaccgc

SEQ ID NO: 679926 - DNA, 223 bp, Homo sapiens
gaccacaccaggcgcaggccacccagcagccagacgatggccagcgtgatccagcgcgagaggctcgtgtccagcggccggtgctcaccgaaggcgatcagcgggccgacccaccagaccagggcggacaggaccagaaggaagaagatcccgagcgtgatcgggtggaacaagatggacaggaatttcttcatggtcagcggtcctgcaccatcagcgtgac

SEQ ID NO: 679927 - DNA, 378 bp, Homo sapiens
ctggagtgcaatggcacagtctcggcagcaattctcctgcctcagcctcctgaatagctgggattacaggcgcacaccaccataactggctaacttttgtatttttattagagacagggtttcaccatgttggtcaggctggtctcaaactcctgacctcatgatccgcctgcctcggcttggcctacagaagtgctgggattacaggcgtgagccactgtgcccggcccttatttttttttctctctctctctctctctctctctatctctctctctctctctctctctctctctctctctctctctctctctctctatctctctctctctctctctctctctcttcttctcctcaggccgaattcctgcgaaatgg

SEQ ID NO: 679928 - DNA, 783 bp, Homo sapiens
  misc_feature (7)..(7): n is a, c, g, or t
  misc_feature (117)..(117): n is a, c, g, or t
  misc_feature (225)..(225): n is a, c, g, or t
  misc_feature (441)..(441): n is a, c, g, or t
  misc_feature (473)..(473): n is a, c, g, or t
  misc_feature (496)..(496): n is a, c, g, or t
  misc_feature (511)..(511): n is a, c, g, or t
  misc_feature (560)..(560): n is a, c, g, or t
  misc_feature (590)..(590): n is a, c, g, or t
  misc_feature (660)..(660): n is a, c, g, or t
  misc_feature (676)..(676): n is a, c, g, or t
  misc_feature (722)..(722): n is a, c, g, or t
  misc_feature (767)..(767): n is a, c, g, or t
ctaaganttctccacattgtgtctttcttctgcagtcgtaaaaaggctggtccttgaattgtcctgcatggtaccctaaggcaggcccactggctctttttgatcaaggattctganaaaagctgcccttggaggcccttgaaataacatagggagcagaatgagttctcgagttgtggctgaaacagttcagctcacactgccatcacagaggctgagttagcngttacccagggagggggctcccagctcattccattcccatggggcaagttactagaaggtaagagcacccgagttagctagttccttcctgtatccacacccaggaataccttccagttgtccaagcagccgtagttgttaggattcctaaatactctgcccttggcctgtagccgacgtctcttcttcttgttgatgtgcctttcgatgctagtntcacctcgactgatgagaacagcatgccatanagttagggcacccagggcaagtnccaaagaactaaganaagaggggcgaagactgggtgggtagtttagagagggctggaggaagtntgttgcagttgtgatccatcttcagcacanacctgttgcagaagctgcagttgtgtgttcgggctggcttggggtaaatgcacttcttacagatggaganggtggcgatatcattnctgccctggggtgggtaccaggcggagtggtgatggcctggtagtngttgaagaaattaggatcagattcagttgctatagaagaaatgcnaccgagttgttgcact

SEQ ID NO: 679929 - DNA, 474 bp, Homo sapiens
tctgatagaagggtgtgcttccctttaaggaatcaagcttgacttgcagagccaaaaaaaaggagaaactggcctcataccttgtctacacagtccttgtacagggctcctaacctgtgatgagtaaagaatgtcactttctaacaggtccaggagccccaagttatcttgggacctcaagaagagaggaatttacccaactcataggtattggagggtacaaacccattgctgggcttgactttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttattaaa

SEQ ID NO: 679930 - DNA, 173 bp, Homo sapiens
gctggtacggccggaattttgggatgccaggccgggagcatggcgcctgccgcatatggcgaccatggggaacgtgttggctgccagtcgccgccctgaaggtctgccaccgtcgcctgcgccgtgccctcgtggggctgccgccgactccgccctcgccgccgggcttcact

SEQ ID NO: 679931 - DNA, 225 bp, Homo sapiens
aaaatgaatagtgagacgagttcagcggcaaggccttctggtttgcaagaagaaagtcaacatcatggatcagaacaacagcctgcaacttacgctcagggcttgcgctcccctcaggctgccatgactcccggaatccctatttttagtccaatgatgccttatggcacgggactgaccccacagcctattcagaacaacaatagtctgtctattttggcagag

SEQ ID NO: 679932 - DNA, 123 bp, Homo sapiens
attccaaacagccccgtaaaaaagtggaataaagaaaactcagagggcttcttctattctctcacaccagaacaatcaacacaagatttctgtgaccaaattgtatgggagttttctcctcca

SEQ ID NO: 679933 - DNA, 250 bp, Homo sapiens
ggtgtttttatggaatcacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtctatttattttga

SEQ ID NO: 679934 - DNA, 118 bp, Homo sapiens
gtgtgtgtgtgtgtccttctgcagccatcagacctgctgggactccatctttgtgaatatccattgctggggctctggtcctgtctttggccatgagagctggtcagcatccttatgg

SEQ ID NO: 679935 - DNA, 113 bp, Homo sapiens
gcaccttgtcgatctctttagctgaatctgctcattaactcctgtctagcctccaacttctcttctgtgcgggtggtcttgaactcggtggtacagagtaacaccctaggcta

SEQ ID NO: 679936 - DNA, 665 bp, Homo sapiens
aaagcagaagctggtatcgcacgaggggcatgcacttctgtcggagagagggactacccccactgctgccgccagcggatgtgtgttctcgcccatccgtttctgactcctgcctgagtaggggtattatagactataatttctgatgaccatagtgttgggactcttgaaaaggggcagaggaaatggcttgggtgctggggagttcccccctccgagccctccttccctgtccaacctgagggatgtggatttgggactagtctgggggcccctcctgcagcgagggatgggagggggtgctgagctgtgaatcccctgtggcagggggcgacaactccgtgtagcattaaagccccgtggcgcgggtccgctgctggtctaatttggacccctgcctctcagtgccccttgccctaggggtgtctgtctccagaggggagggacaaatcccctactggggccatttcaatggggtacgtttgggatttttttccccactcacttttattttctaatgataatggagatgtctggacccttccgtcaccccacctgtcggtcttgtcctggctctgcctgtcccccaccgtagtactcgtaggtgaaccccaggtcctcaagtccccccctttatgtgttgaaagttatggtttcagatgtta

SEQ ID NO: 679937 - DNA, 497 bp, Homo sapiens
gtgtcatcgagtagtacctctaggacgaaatagtgtactgcaatagcaaatctagatcagtgaataaatttatactatcaaacacattagattatatacgtgagtgagaatagcaggaacctttatatgcgtcttctcaaaatcatttctcactaaatattttcttggcatcttcaatttaaaagtaatatacaaacatataaaatcacttcaccattgacaagatctttcatgggtatctgctgtgatctcaacatcattaattctcaagtcaatcatttgcttaagtagcaattgttttcaaaataaacatgccatacagacattgttcatttcacaaacagtggattcatttcgatcaaatgcacgtggtaggaactattaacatagaggtttcaaaaagtgagtgagattgactgcaccccaaatcctcatactctggcttgaggagcagacagtgagctacatcatgggggactgcaagtgtgtcttacgac

SEQ ID NO: 679938 - DNA, 402 bp, Homo sapiens
taaacactgctgaataccaattggtacttggaatacctcttcctctaaaatacgtgatcctattccccaaagtggaacttccatgtggaagcatcctaagtgatcgtcctgggtggtgccatatttcactaaagtgggaaacagaagaggtgaaacttggctcttccaacaaggcttgcactttatacttggggcagtgcttgggaaaaggggggcccttggaggtgacgcaggatcactgtagctagaggagaggtctcactgaaacagaacgcatctgtgactgtagcttgcttggagagcctagacagccaaccattggattggccttaatgttggaatggaacacattctattccaatggggatagaaacctttacctatgtcatatctgtaaggaga

SEQ ID NO: 679939 - DNA, 486 bp, Homo sapiens
cacgaggtccagccttataggaaacagaggcaatgggcaccatggcaatttacttaatgctggtgtattagtccgttttcatgctgctgataaaggcatacctgagattgggcaatttacaaaagaaagagctttaatggacttatagttccacatggctagggaagcctcacaatcatggcagaagacaaggagaagcaagtcacatcttacatgaatggcagcaggcaaagagagagagcttgtgcagggaaactcccatttttaaaaccatcagatctcttgatagtgattgagttctcatgagacctgatggttttataaggggcttttcccctgcgtcactccacatttctccttgctgctgccaggtgaagaaggacttgtttgcttccccttccaacacgattgtaagtttcctgaggcctccctaaccatgctgaactgtgagtcaattaaacctctttcctttataaatcaaaaaaa

SEQ ID NO: 679940 - DNA, 1087 bp, Homo sapiens
tgaagaatgtctgatgacagacatcgtgtggaaacagaaggaatggcgagacatgatgctatctcagtatcccattacgtcccaagccagagcattgaaacgagtgcaggctgattcatccgtctagccggtcctcctcatcattgcactccatccagatgtctagatcaaggatactcagctcatcctgagcaggtcaggttctcggtctcattcagccgctcagatccaagcagagagatgtagcccaggcacgtactcatgccaaccctcgtggtagacccaagatgggctccagatcaacatcagagtccagatcaaggtcacgttcacattcacgttctcgttcagcatcaagcaacagcagagaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagctgagcgggggagcccaaagaagtgtgaagctgaagaggcaagagcaacagtggccacacagcccaaactcaggagatcagaactctcatctggcagaatcagaaagaattcatcacactgtgaggaaaaggaggaagtgacatggccccaagtgacaacaggcctgaaaatgatgtccagaagctacaagtccatggagacccatcaggacgatgacggcgaggacgctaaaatgaggcaagaaagagcgagccaaacatcagggacacacgggccaacacgaggacgccactagacaatgtgcacaaggtgccaacgtttgaaacaccgtgtgacacacggaccagtgagaaacattaggctacccacctaagagacacacacaacctggagagagagaacaaagacgatccacaagacaaagcagacacaacgacgaccagacgaagatgtaacatcatcctctttatcctcctcttcttcttgttgccttctatgtggagg

SEQ ID NO: 679941 - DNA, 1027 bp, Homo sapiens
  misc_feature (517)..(517): n is a, c, g, or t
agctgggaggactaggagccaagtgcaccactgccacgcctcccgtgactacctactactggacaaccagtgccccgcatgtagctgcaccctactgccacgcagcggctaggaggacaccacattatctgtagcacgtgccctgtacctgtcaccttacgacacaatgttcttgctatcccatatgctaccaagacaacatgcactcaaacacgcagggacgctatgtggagcaggtctaatatgtcacccagctgtaggtgcaacaaatgcccctactatgttgcggctacccaatagtaccccactgagagcactatacataagcatatgtgtgtgcaacataaggcaaaccctatacacgtatggccattgcgatgcaattgttcgcaaccacggttgacgacaccacacaacgcacatgcacgcaactgaaccgtaccgcgttcgacacctgatacgtaccgccgtcggctatatacacacggcaccaccagagacgctcagcacagagttntcgcaattatcaacccaccccgttctacacaccttattcacacatgacgaccccgttggcactactgccacaactatctggctacactctactttacactttacatttacctaccccccagttaaaataaagttaaattacacttaaccttaacactaacccccacaaaagcgaccaaccaacaaacgtggccgcccaacacaacacatcgcgcttcacacgcataacccagcttcactcccaaaccatacccaccgaccaccaccagcatatgtccgtcagcccttctgccacaaccgcattacaccacatcgtcatagtccatactgggcaacaatctactatcatgcttacgcagcaagcatctataggcgcagacgacccattataacagccgcactcgtttgatcggcgccatcatgccgttaacatcatcgcatatcaacgcagttacaaaactactactctaccctacatacagtcgactctcatcggcgcaacgaccgcgca

SEQ ID NO: 679942 - DNA, 876 bp, Homo sapiens
  misc_feature (349)..(349): n is a, c, g, or t
gccgcgcccgcggagttttcctgcccggcgctgacggctgctgcgcccgcggtcccagtgccccgagtgccccgcgtgccccgcgagcgggagtgggacccagccctaggcagaacccagtgcgccgctgcccgggacgccacgcaggagatgagccactcccgccacactgtcccatttcagacccatcgctgtcctgtgagttccccagtggccaagatctaaccatgagctacccatggcatatcccccgaccccaggtgtgcataaccaaccaagactgaaaccaaggatggtgagttcccattgaagcgacaggccgttgccttgcccttaaccacattcccanacacaggcaccctagacaattgacacacacaaccaagtacggggagctatggaactacaccaggtttgagaccaacccccttattttgccggcgcgcggacaaggttataaagagccaaagtggaccttaaatcatcaatacaggagaggaaactcgcaacagcgcacaagaacaattggtacaattgcgggaaccaaagtatctggcgaagggagaagaccacagaaatactattcgcacacaaacaaacagtttggtaaaccccgattggaggtgggaaccccaccactatggggcggagacaattggggactttaaacacgcaaaccacacaagagttgtggcaacagcacacacattaggagagcgcaggaccataatttgggggcgacaacggacacaccaacatcacgctcaataccaattagcatccacgcagtcgataaaggacacactaagtaataacacattcaccaacagtataaattagagagaacgtaacggataagttgccaggagcagcaac

SEQ ID NO: 679943 - DNA, 3781 bp, Homo sapiens
  misc_feature (3445)..(3445): n is a, c, g, or t
cggacgcgtgggtcgacccacgcgtcgcggacgcgtgggtcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679944 - DNA, 509 bp, Homo sapiens
agaagaagacagtgtgattcgcacaatggcagggtcatgatacaatccagatctctgaccccgtggaggtgaaggggctcgtacagcatgccaggctgaggactctcgggactgaggcatccagagtcgcagctataaatcataagggttccctgcccattacatcacacggtagcagcatccaaagagtggcgtagaagaaaatctcatcaccgtgggctcagtttagattgctagtcggctcagaaagctacctgcaatatgcgtttccaaggatgcaccacaaatactctccacatgagttgagaacatcagtggatgaaactcagcatgcttagtgcggggccaagtcctctaacaaaggacaacagcggttaacctgcatatcgaggacaggcactgtcaagccctcatcagggattcatccagagaactttggtaattcttggcaaatccctggtatcagacaatttccttccttactgtgatgcagtgtaatggacacatct

SEQ ID NO: 679945 - DNA, 3375 bp, Homo sapiens
  misc_feature (3039)..(3039): n is a, c, g, or t
ggagctcggcccttattcgtgtgcacatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagccaaaaaaacttagtgtggtgctggtgtgcatggtagccccagctactcagggggctgaggatgtggtggcatttacctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679946 - DNA, 2314 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagattttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttc

SEQ ID NO: 679947 - DNA, 341 bp, Homo sapiens
aaaaaatttacatcatgcaatggcacgtacaataggtctaatggagtggtggaccaagagccatatcagtgctagcaaaatggcagaattcatatagcatcaacagttcttggggcctttttccccccccccgcctctcttgcggcgggcccccccataacaccagcacccgcgcggcgcacacgggcccattattcccgcgacggcatgcgcttaacaccttggcaagctgagcttctctatcaaacactgcgcaccaagcaccaaagttcaagtttcggcaacaacacacactcgtttccaccgcccctattccccactggcctcccagggtcaccccg

SEQ ID NO: 679948 - DNA, 2300 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttcaatggtgtgctttgtgccggaatctgcacacatttcgttgtgtcagcattactccccggcgtggttttccttcaccgcatgagtattcaggatgggtacctggagctttcacgggggccctttttagctcctatctattccgggtttccccaccggtgtcagggcccccgggtgtttcccggatatctaaaccctcgtttactcggcccgtggcgcatctctctggcgcagcaatggggggccgcgtccgggagccttgtgaaccg

SEQ ID NO: 679949 - DNA, 163 bp, Homo sapiens
tctagaggatcccgtctctctctgatcaggtcctcagagatctagagagaattgactctttcatttatatatgaattcttcatatattgaacatgattggaatccaaccactattataataatttgagtatattttaactatttgccttaacaaattaatttt

SEQ ID NO: 679950 - DNA, 2229 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (2038)..(2038): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttgttgntttgtttttttttttcagatggagtttcgctcttcttgcccaggctggagtgcagtggtgcgatctcagctccctgcgacctcccccctcccgggttcaagctattctcctgcctcagcctcccaagtagctgagatttcaggcatacaccactacaccaggctaatttttttgtatttagtagagactgg

SEQ ID NO: 679951 - DNA, 1835 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgtgacaaagtgacatggggtaccga

SEQ ID NO: 679952 - DNA, 314 bp, Homo sapiens
ttctacttctgtttaacgagatagcatctcagttgtttaagctggaatgcagtagcatgatcatggcttactgcaaccttgacttcttaggctcaagcagtcctcctgtctcagcctctagagtagctgggatcacaaatgcatgccaccatacctggctaacttttcttttcttttcttttttatttttttgagatggagtctcacactgtcaccgggctggaatgcagtggcgtgatctcagctcactgcaacctctgcctcctgggttcaagtgattctcctgcctcaacctttcaagaagcaggaactgg

SEQ ID NO: 679953 - DNA, 618 bp, Homo sapiens
  misc_feature (555)..(556): n is a, c, g, or t
cttaggagacctgagtcctaaggcccttttctggaagtatcggctccttcagaccatttaatggaacccactattttaaaggccccaactgcaggaaaggcctgggaggcaaactacaatcatcctcctgaggcagattccgttggaactgcattcaacttagggccaactgttaaccaaactgagccaaatggggattccaccaccggggccactgacctgtcccccgagcccaaaggcttcaattacccatggttcagttggaaattcagttaacccagcagttacagtcctttatccccaacaccattgtgagagggctcatttctaaggttatccgaaccttgaagatggactgctctggggcccatgtgcaagtgacctgtgccaagctaatctccaggacaggccacctgatgaagcttctcagtggccagcaggaagtaaaggcatctgagatagaaggggatacggaccaatggaagactgagaactacattatggagagcacggaagcccagagtgaacaggaggagaggtcgctggagctcacannagaggttccaggatcacgctatactgacaaacttatcttggcatttgtgactgaattacttg

SEQ ID NO: 679954 - DNA, 355 bp, Homo sapiens
gcgtcgacatccattcagctaatctttatctatctaactatctaatctatttagaggcaggggattgctctgttgctcaagcaggagtgcagtgacatgatcatagctcagtgcagcctcaaactcctgggctgaagtgatcctcctgcctcagcctcccaagtagctgggactacaggcatgtgccaccacacccagctaattctttaattttttttacataagaggtctcaatatgttgtccaggctggtcttgaacttttggcatcaagcaatcttcctgtcttggcctcccaaagtgctgggattacaggtatgagccaccacagccagcttcgatctacatcttttaaat

SEQ ID NO: 679955 - DNA, 405 bp, Homo sapiens
tcaccgagcagcttggatgcccaggttgttgttgtggatggcctgctccgtccggcattaacacacagcaagggaccctgcagcagccgcagtttagatgcatggccaagtggaataactagctaacgacctcttcccgaagcgctgtgacctacaaaaggccagctgcttcactcagtttgttctgactccttctgtgtagctctcaggctctgggcgcccagctgctgcagagtacaggtatcctgtactgaaagttcgcactccacaccagaccctccttcccatgtttgagcgctgcgctttgccccaagtatatttctgtgggcctttcccttgagtcaagattttgtgttgcactttcaacccgagaggatttttataagacaatttgctgtaaaccag

SEQ ID NO: 679956 - DNA, 2666 bp, Homo sapiens
  misc_feature (2330)..(2330): n is a, c, g, or t
tcctgtcatcagagggctgtttccctttataaaaggggaaaacaattgctttttaaatttcttttcttcttggagtctaagattttaaaagttgcagcccacatgtgaatccaaatttcctttgaaccatcaaatttgaatccctctaattcggatttcccattcaaatcatgtcagggcagttacttgttgaactttgtcctgaaatcctgtggttctgtggttccggctactcaggaggctgaggtgggagaactgctcgagcctgggacatggaggctgtagcgagccacgatcgtgtcacggtattccagcctgggtgactgacagagcatgatcttgcctcaaaaaataaacacataaaacaagtagtacagcagaagagctgggaatggattggccaacgtttacatttcatggttatcttgaagttccaggtacagcagatgctgagcctctgggtggtttgaggcctggttggccatcagatatttagcttcatactttgccgctgtccttaagggggtgagtcctccatgaacaaagggaatagtgactttttccatttgacagtttaagaatttgacattttttaaagaacagcatctaaagaaagtttattctgtgatattagagacagaaggttttcatataaatgcaagtttgacaaagtcagcatctttctagctgtctaaggaagagtcacttgtaacacagccagccaggaggctgctttgttttttattataaagaacactaacacaaatgcagcatgattgctgtaaaataaatgtgaaatttgtacaaaagtcccagtccttccgcagttctaggtttacagtcaggctcaaccttacttgccccgctcctgcatgaaaacaagtgcgttttatacagcctctgccacccagtggcatagtttaaggctctatattatatttaaaattaaggtttttttcctatcatacacatcaatttggaacctgctggtgactcttctaccacagagggtaaataaaaagaccagtttttaaagtaagaggattcagctcatcttataaaagtataatagtttcggccagacgtccattaacatctgtttaaattagatacagacacaatgccaaatattagaatcataaatgtaattttggagataatgtttaccttgagtaggaagacacttggaccatattaaatttgaaagtcttctgttccagaccaaaatggggtaggctaattccctgtcatccaagcaactaaaaggtaaaaaccttataactttaaaataaaaaaggttatttttttcccctataaaagacaggcagtatgagttaatacattaaaattattttgtacatccctgctccaaacaaccacaaaaatggtactttttaaatgcctgcccatcctctcctggaagggggtttttccaagattcggggtgactgattcatcccacagccccaggcagcagtttatcctggaactgtcctctgttctcccatcactgctgagccctgagaattgtgaatggccctcagagcatctaggcctctgcaacaatcaggtctctggtgacttgaaatgcagcaatgagggagctcagctggatcttctcgttggtgccaacagaaagcctgtactcaatgtctgccattttggtcaataaatgtattcgaactgaagatggaaagtcaactctatgcacaaacaagtgtatctctgtcaggatatcatgcagtgccaaccccttcagagttttcaactctgtaatatttctgtaggctgtggtgaaatcttgattcaacatccagtccaggatgttggcaatgtctgacttgagcgggtgcccggtgcaggtgtagacagtctcctctgtcaccttcccaaaggccatattggtgctctgcaaaatgttcagagccctacgcatgtctccactggaaagagtgactagtgctttcattccatcttcacttatatcaactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679957 - DNA, 255 bp, Homo sapiens
ggggcaactcctcccccagcgccaaggacattcaagaagattttggaacagcgtgggtatcgaggcggacgacgacccgcttcaacaaggttatcagtgagctgaattggaaaaaacatttaagacgtcatttcccagggtattttgcaagctttccaagttgtaccctcttggtgggggctgtagccgttctttgcttgccccagggtttttcagcccctgcttctttggttcttccccttcttgcagcagagg

SEQ ID NO: 679958 - DNA, 1525 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtaaacagattcaagtgttatcgggccacctgcagtgggtttactgctgttccatctccccagactgcagcatgctgtgctctgcagctggagagaagtcggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccaccacacccaggttgaccccgccatggatgacagtgacgtccacattagctcactgagatctgtgtgcttctctccagaaggcttgtaccttgccacggtggcagatgacagactcctcaggatctgggccctggaactgaaaactcccattgcatttgctcctatgaccaatgggctttgctgcacattttttccacatggtggagtcattgccacagggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccaga

SEQ ID NO: 679959 - DNA, 1024 bp, Homo sapiens
  misc_feature (63)..(63): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (1004)..(1004): n is a, c, g, or t
  misc_feature (1006)..(1006): n is a, c, g, or t
  misc_feature (1010)..(1010): n is a, c, g, or t
agcgggtttcttaccgtaggtttctccctgttgaggcgaacgagctaaatgacctctccgggnggnggcggngnnctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttcatccctaaagggtttgaagccaaaagccgaagtagcaaaaatgagacgaaagggcggggcagcccaaaagagaagacgctggactgtggtcagattgtctgggggctggccttcagcccgtggccttccccaagtgcccgatgtctcttgcctggttcttgctacgggactcaacgatgggcagatcaagatctgggaggtgcagacagggctcctgcttttgaatctttccggccaccaagatgtcgtgagagatctgagcttcacacccagtggcagtttgattttggtctccgcgtcacgggataagactcttcgcatctgggacctgaataaacacggtatgggaagtgaaggaactactcggcaactccaaaaatactgtatttgctttctccactttaccagtgtcatttttatctaaaacagtgtttcttgatgtttttttctgtgattgccccttaaggagccttttagacagttttttcctaatcgcccctgcccgccccaaagataatactataccaaatagagtttaataccgaacatatactgtgtgtctatttaggctattttaatatcgaagatatattgtatatctacttatgtgctgaatgcatgtctatgctttgtatgtaaaaaaatgttaanantttnttggctaccaaaaa

SEQ ID NO: 679960 - DNA, 667 bp, Homo sapiens
  misc_feature (510)..(510): n is a, c, g, or t
accagcaccaatgtaagtctgccttatgatcctgcagccaattgcaaagggtctcaaaagtctatggacctgtgcacaccgtgtatttaggcctgaatcccataccggtgttgcatgcatacgaggcagcgaaagaagccctgattgataatgtataggagtcttctggaagaggcaattccccaatatctcaaagaactactaaaggacttggcaggtgcacatatttctgcgtcagcttgggctactgctgagactgcgatgcaaaacagagccctagcttgtcagcagagcttagtctatctgcatggctgtcgagcgttgcactactgtctatcttggctgtcaatgctcccagtttctgccactccatgctattaggagtcatatgcagcgatggatacagatggaacgagagccagcgatggtagctcacgacctttgcggaagtacgcaatggagcagaggagcattgatgaccgagatcattaggaagctcactgccttgtngaggagtttagaataacccaagaacgattcgagtattacgatatgaaactactagccctgtgaaagactcatgaacacttaggattctgaactcccatgcatccaggctgcaataatctcctgtactcagtgatagagccccagcctctgcttgctt

SEQ ID NO: 679961 - DNA, 793 bp, Homo sapiens
  misc_feature (457)..(457): n is a, c, g, or t
gtaggcactttgcaaagtcgttttccaacattcctttcctttacatacgaaccagccagtgatcccacaagcctgtttttactacactccatccccaaagggccgcaaaatactcactttctcttcttccacgacatgttccaggcggggaaccatgagttcaggagtcaggggaccgaaccgaaacctcgtgcagcgggactgcaaggcagggatgatctttgacagatagttacagatgaggcagaatctggtattttctgtgaatttctcaattactcttctcaaggcattctgggcgtcctgagtcatggcgtctgcttcatccaagatcactagcttaaagcctttcttaaatattgtccttgtgctagcaaagctcaggatcggtcctcgaatgatgtctattcctcggtcatctgaagcattcagctccaagaccatggagccaaattcnttgtctttatatagctgtttcgcacaggctaggataggtagagtgtcttgccgtgtgccctgggggaccgtagagaagcaagtgtggcagtcggtccttcagttgactaaagcttctgaatggtacctcagaagtgctcctagactgagcaaatagaagatcattgcagggtcatgtggccggtatcttttcaacccagggcaggtatcctgatctgtggtcggccgcgggcatgctcctgcatgcgttgagctgctgaggtctgccatggcggggagacgaaggtgaccagatccgctgagatcgtcgcgtcacaccaagcgcctgcacagtgac

SEQ ID NO: 679962 - DNA, 531 bp, Homo sapiens
ctttccgtgctagtcgtatcagttaatatgtatcaggagatctgatgggttatcagggagccgaactttgcttcttgctgattttctcttgctgctgcatgtaagaagtagcttttgcctcctgttatgattctgaggcctccctagccatgtggaactgtaagtccaattaaacctttattttctttctagtctcgggtatgtctttatcagcagtgtgacaacagactaatgcagattcccactgagagagtgtccacatgacagaataacaaagtcagaaagtatataccatgggccacatctatatacatcttgactggtgtgcgaaacttcaaaataagaccaaaactagactgggtgagcatgccaagaaaaaccagtaacaataaagttcaaaactaatttttacaaagagaacctattttttaacaccttactaatggccaggcatggtggctcaagccttgtaataccagcactttgggaggccgcgcggggcggatcacctgaggtccggagttcaagacc

SEQ ID NO: 679963 - DNA, 197 bp, Homo sapiens
ccatttgaatcctgttaaatagttttagaacatagtctgttaaaagttctggagctcctttccaatacaggcttctcctggtcagttacttaagatagaatataggcatttaggcatggccaggagtcctttggggaaggtgaggtgatggcacaatttaattatagacagatgcattagtttcctgttcgtgctgt

SEQ ID NO: 679964 - DNA, 903 bp, Homo sapiens
atgaatggacagtaccagcagcccacggacagtctcaacaatgacaacaatgtattccctggtttgcttgttgttaaccatcaatggtgaccttgtgagacgtggccactacaccatgctttatcctggcagcacaaagaccatgtggttcaatgtgtgacgatgccatcatcaccaaggccagcatcaatggactgtcctggacagctgaagggtacttgctgttctatcacaaacatgttcctggaatacgagtatgccttatctgcagctggtcagaaaaacaaatggcaatgcatttggcaagcctcacaaagtgatcctcacccttgggccataaaacatacaacacaatacaataaaaggcagaactcaaccaggaccatagatagaacatcgaaataccacaatgacacagatagatgtactaacaatcaagatacattgagtatacagtcgagatagcagaggagtgtcacaccacaaaggatatccgggtgtaggatgctacctaggaggaaatggcgaatagtaatacacttatttcctcatcgcccaggtcttgcatcatcagtgcgcacagtgagcaggctacgctagtataacagtcgatcccggctcaccttaccacccacccaacctactctgatcatcctctgacaattttgaaacttgatcacactactagaatacagtaaatctttatcaacgaagcacagcagagagtagcacccgtttgatgttattagttgcaattacgcgaccctaatccctacatcagtaatcatacgaaaacggcgacatacattgacacaaatctggattaagataattaattgccgataatacagcgaatatgatcaagtcccccagggttgcaactacacacagatgtgattgcca

SEQ ID NO: 679965 - DNA, 1047 bp, Homo sapiens
  misc_feature (7)..(7): n is a, c, g, or t
  misc_feature (77)..(77): n is a, c, g, or t
  misc_feature (94)..(94): n is a, c, g, or t
  misc_feature (136)..(136): n is a, c, g, or t
  misc_feature (141)..(141): n is a, c, g, or t
  misc_feature (153)..(153): n is a, c, g, or t
  misc_feature (168)..(168): n is a, c, g, or t
  misc_feature (193)..(193): n is a, c, g, or t
  misc_feature (199)..(199): n is a, c, g, or t
  misc_feature (206)..(206): n is a, c, g, or t
  misc_feature (219)..(219): n is a, c, g, or t
  misc_feature (223)..(223): n is a, c, g, or t
  misc_feature (225)..(225): n is a, c, g, or t
  misc_feature (227)..(227): n is a, c, g, or t
  misc_feature (234)..(234): n is a, c, g, or t
  misc_feature (258)..(258): n is a, c, g, or t
  misc_feature (268)..(268): n is a, c, g, or t
  misc_feature (271)..(271): n is a, c, g, or t
  misc_feature (301)..(301): n is a, c, g, or t
  misc_feature (318)..(318): n is a, c, g, or t
  misc_feature (333)..(333): n is a, c, g, or t
  misc_feature (355)..(355): n is a, c, g, or t
  misc_feature (365)..(365): n is a, c, g, or t
  misc_feature (370)..(370): n is a, c, g, or t
  misc_feature (377)..(377): n is a, c, g, or t
  misc_feature (382)..(382): n is a, c, g, or t
  misc_feature (387)..(387): n is a, c, g, or t
  misc_feature (394)..(394): n is a, c, g, or t
  misc_feature (400)..(400): n is a, c, g, or t
  misc_feature (421)..(421): n is a, c, g, or t
  misc_feature (428)..(428): n is a, c, g, or t
  misc_feature (430)..(430): n is a, c, g, or t
  misc_feature (432)..(432): n is a, c, g, or t
  misc_feature (451)..(451): n is a, c, g, or t
  misc_feature (474)..(474): n is a, c, g, or t
  misc_feature (492)..(492): n is a, c, g, or t
  misc_feature (496)..(496): n is a, c, g, or t
  misc_feature (518)..(518): n is a, c, g, or t
  misc_feature (523)..(523): n is a, c, g, or t
  misc_feature (533)..(533): n is a, c, g, or t
  misc_feature (547)..(547): n is a, c, g, or t
  misc_feature (568)..(568): n is a, c, g, or t
  misc_feature (580)..(580): n is a, c, g, or t
  misc_feature (593)..(593): n is a, c, g, or t
  misc_feature (600)..(600): n is a, c, g, or t
  misc_feature (608)..(608): n is a, c, g, or t
  misc_feature (613)..(613): n is a, c, g, or t
  misc_feature (633)..(633): n is a, c, g, or t
  misc_feature (658)..(658): n is a, c, g, or t
  misc_feature (694)..(694): n is a, c, g, or t
  misc_feature (721)..(721): n is a, c, g, or t
  misc_feature (731)..(731): n is a, c, g, or t
  misc_feature (748)..(748): n is a, c, g, or t
  misc_feature (758)..(758): n is a, c, g, or t
  misc_feature (818)..(818): n is a, c, g, or t
  misc_feature (837)..(837): n is a, c, g, or t
  misc_feature (845)..(845): n is a, c, g, or t
  misc_feature (875)..(876): n is a, c, g, or t
  misc_feature (881)..(882): n is a, c, g, or t
  misc_feature (905)..(905): n is a, c, g, or t
  misc_feature (907)..(907): n is a, c, g, or t
  misc_feature (914)..(915): n is a, c, g, or t
  misc_feature (934)..(934): n is a, c, g, or t
  misc_feature (937)..(937): n is a, c, g, or t
  misc_feature (950)..(950): n is a, c, g, or t
  misc_feature (961)..(961): n is a, c, g, or t
  misc_feature (965)..(965): n is a, c, g, or t
  misc_feature (971)..(971): n is a, c, g, or t
  misc_feature (976)..(976): n is a, c, g, or t
  misc_feature (998)..(998): n is a, c, g, or t
ggggacngagagaacaagggggacaaaaaagcaggcggggacgggccggaaggcccgggagggggcaggaaaagggngacgacaggaccagcgnggccgcggcgcaccccgagaagcgcaccgggggggcgacggnccggnccaccgaccacngggggggcaaggccncagcagcggggacaccgcaccacgncgcggngaagaancagagcgtggacncggngncngtggacngggcaccagcccggcggagcaccnggcccggcgnccnaaaggaggatggggtgccgctggccgagangaagacagcaaacaggnggcagagcagcccgnagcagcccacagagacccaagngacccgcagnggccngcgggcnggggnagccnacacggngcaggngcgagcagacacagcgtggcngaggggngncnggagccagacccagcgcgncagcagcgggcagggggcggagnggcgcagcggcggcgccncccnggggagcggccggagcagccgncgcgngggcggccgnggcgaccgtggccngaacagggccgcacggcaccngtgcccgccgcngcccacaccctgngccagcnccgccatngagtnccctggagggaaggagactnggcagtggatcaacccagtggactnccaggaagaggcatccctgcaggaggccctggtggnagagatgtcctgggacaaaggcgagangactgagccnctcgagaagacagagcnacctgagggngccctggagctgggcctgggatacagagttgtgcttgggaggatggagacagatgtgatngtggaggctcagagacggngagtgacncgcccgaggcgacgtagcacacacaggagnnacatnngggacccaaatgaaccagagctncnccaggcnncagtgcacctgcctgctgngcngccccgtgcctgngggcacccatnctgncggggnaaccnagatgctggcatgaaatggaantgctgcacccggctgggctggcatccgtggggcaggacagacctggcat

SEQ ID NO: 679966 - DNA, 673 bp, Homo sapiens
cgtcccgggctggcggtgctgggcgcggacgagcgcatcttctcgactgacgcgcaggctggcgcacggagaggagctgcggttcggggccatccacgtgcgttgcctcctgacgcccggccacaccgccggccacatgagctacttcctgatgggaggactgattgcccggacccacccagacccatgttctcgggcagacgcagctgtcaggtggccaggactgcggctcgtgcctggacgggcagcgcaccagcagatgtaccagagcctggcacgagacatgggtaccgctgacccccgagacaggtgtacatgcggaccacgagacacacgcattagcaacctggagttatgcccagaaagtggagcccatgcaacgaccacgtgagagccaagcatgtcactgggctaagagaggagccgagtgcgcaagttcacgggcaaggcggtccccgccgacgtcctggaggcgctatgcaaggagcgggcgacacttcgaacaggcgggcgaagccgcggaagcccaaaggcgcgaggacctcacttgcgctgacagtgaggggctcctgaagtgcaggcaccacacgactgaaccacccaaacctcacaggctggggactgcgtcctcctcgtgaactcggcagctggaccacatgagggccactctgaa

SEQ ID NO: 679967 - DNA, 274 bp, Homo sapiens
  misc_feature (8)..(8): n is a, c, g, or t
  misc_feature (13)..(14): n is a, c, g, or t
  misc_feature (18)..(18): n is a, c, g, or t
  misc_feature (21)..(23): n is a, c, g, or t
  misc_feature (165)..(165): n is a, c, g, or t
cacactgntcgcnntgangtnnncacacttcgatcgcggagaatttggcagtccgattgggggggggtcccttcagagacccacaggccggtggcatcggcgcggagtgcccaggttcacagtgcagcttgtggctcgtgtccatcttgcaggtggctcttcctncacatcacgatctggggtctcgaagaggatcgggggtaggaaatcctccaggatcttaggaaatttcactccgcttctcctgctacaatgctctgctttaggtcacgag

SEQ ID NO: 679968 - DNA, 148 bp, Homo sapiens
gtagaggaaagagggtcccattcctgccgaaccccgtaaggaggcaaggttgcgcttcaggcacacagccagctgcctccatgctgcccagtccactccagcccagcgtgatccatgtacctgtcaagcacctttcacaggggggtac

SEQ ID NO: 679969 - DNA, 192 bp, Homo sapiens
tttaaatttttttcccccccccccccaaaattgtaaagccaaaagttcccggaaatatttgggaggattaaatttgggggccctggttctcttccaaaaaatttttttccctaaaaacctggtaaaggggttttaaaagtttttccaaaatgtgaaaagggaaacccccgtcttttttatttaaggaattta

SEQ ID NO: 679970 - DNA, 157 bp, Homo sapiens
  misc_feature (8)..(8): n is a, c, g, or t
  misc_feature (13)..(14): n is a, c, g, or t
  misc_feature (18)..(18): n is a, c, g, or t
  misc_feature (21)..(23): n is a, c, g, or t
cacactgntcgcnntgangtnnncacacttcgatcgcggagaatttggcagtccgattgggggggggtcccttcagagacccacaggccggtggcatcggcgcggatgtgcccatgtgttcacacgtgcatgcttgttggctcagtgtccattcttg

SEQ ID NO: 679971 - DNA, 102 bp, Homo sapiens
cctccagccgttatgggtgggctgtggagatgatgacagaaaggctggaagtgaaagggggtgggtttgaagtgccagtgagcaagggtgtcctcatggtcc

SEQ ID NO: 679972 - DNA, 201 bp, Homo sapiens
gttaagctactatggaaaccacatgtcacttagtccagactataccttgtgtagcttcaagaactcgcagtacattaccagctgtgattctccactgaaatttaatttttaacgggagctcaaggtcacaagcaagcaactgcaacggaacaatcagcagccctgttcagcacaggtggtcatcagcgggtcaccgcagct

SEQ ID NO: 679973 - DNA, 112 bp, Homo sapiens
gttgccctggcggagagagacaggccctcggggtggaggtctttggtttcataagagcctgagagagatttttacgagatatgtgtaacacaccacgtactgtgacctagga

SEQ ID NO: 679974 - DNA, 370 bp, Homo sapiens
gcagtctggttaagggagaactagtggaaagggttaaatgacaggttaagttgcgtgcaaagctttcccagtgctgttgagattaagacaattgcggatgtgtatgactaggcttgaatctctgggctgcagattgcttttgccctggcagagaaagaggagtctttgcataggctagctgattcttgcagattacaggcatagaggcacatagaaactttgtattgcatgctgattcagttacaagtgctgctgacttaggccaggaattacgtgagagtacgttgctgccatcactggtttgaatgagactgtctcatcacggggcaagagttatgattgaagatctcattgtcccagcagctttggg

SEQ ID NO: 679975 - DNA, 570 bp, Homo sapiens
taatatcattatcgtcagctggccaagaacctgttctagcggcaaagacatcctcttcaataagatgtctggagggaaaactggatatctatgtgcacaagaatgaaactagccccccgactcttgccatatacaaaagtcacatcaaaatagattcaataattaaacctaaatcctctagctatgaaactactacaagaaaaaatcggggaaactctccaggacatgagtctgggcaaagatttcttaagtaataccccaaaagcccaaatagccaaagccaatcctgagcaaaaagaacaaagctggagggatcacactacttgagttcaaattatgctacaaagctgtggcaaccaaaacagcatagtactggcacaaaagcagacacatagagcaatgaaacataatagagaatccagaaataaatctactcatctacagtcatctcatttttgacagaggtaccaagaacatacagtgggggaaagaacagtctcttcaataaatggtgctgggaaaagtggattccatatgcagaagaatgaaccagacaccatctctcgcata

SEQ ID NO: 679976 - DNA, 133 bp, Homo sapiens
attcgcggccgcgtcgacctgttgatcagagctctcatgagtaccttacttgctcatgactgcgcatacctcattttagccttctgctccgacttcttagggtgacatctactattagcatctcatagtacgt

SEQ ID NO: 679977 - DNA, 332 bp, Homo sapiens
  misc_feature (19)..(19): n is a, c, g, or t
  misc_feature (40)..(40): n is a, c, g, or t
  misc_feature (69)..(69): n is a, c, g, or t
  misc_feature (73)..(73): n is a, c, g, or t
  misc_feature (145)..(145): n is a, c, g, or t
ggggagctttttttgtttntggggcctcccccaccatagntttgattcccaccccatataggaatagcntgantgagggggaaggggtgggagagaagatacagacatggaggaggggaggttgttttggtaaagtttttaaggnttttgggggttcaggcttggggtcaagaaggaaaatgtgtgtgagcatgtgtgtgagtgaggggtgtgtgtgagggtgtgtgtgagtaaggggtgtgtgtgtgtttttcttaggacccaccataccctgtgtatgtatgcatgtttttgtaaaaaggaagaaaatggaaaaaaatttgaacaataaa

SEQ ID NO: 679978 - DNA, 185 bp, Homo sapiens
ctcgttccgagatagcatccacgttggaaggaagaatataaatgaaaacctcatgagctcacgtgaggagaatgtgcttcttcaaataatgcttcgcagcgagacagctgtgcaattaagattgctatcgcttccagtaaagtggggcttttgaggggcatcctcgtagcagtctgacctgccag

SEQ ID NO: 679979 - DNA, 568 bp, Homo sapiens
  misc_feature (38)..(38): n is a, c, g, or t
  misc_feature (63)..(63): n is a, c, g, or t
  misc_feature (66)..(66): n is a, c, g, or t
  misc_feature (88)..(88): n is a, c, g, or t
  misc_feature (91)..(91): n is a, c, g, or t
  misc_feature (102)..(102): n is a, c, g, or t
  misc_feature (113)..(113): n is a, c, g, or t
  misc_feature (122)..(122): n is a, c, g, or t
  misc_feature (131)..(133): n is a, c, g, or t
  misc_feature (145)..(145): n is a, c, g, or t
  misc_feature (147)..(147): n is a, c, g, or t
  misc_feature (169)..(169): n is a, c, g, or t
  misc_feature (188)..(189): n is a, c, g, or t
  misc_feature (195)..(195): n is a, c, g, or t
  misc_feature (277)..(277): n is a, c, g, or t
  misc_feature (308)..(308): n is a, c, g, or t
  misc_feature (310)..(310): n is a, c, g, or t
  misc_feature (314)..(314): n is a, c, g, or t
  misc_feature (323)..(323): n is a, c, g, or t
  misc_feature (325)..(325): n is a, c, g, or t
  misc_feature (347)..(347): n is a, c, g, or t
  misc_feature (356)..(356): n is a, c, g, or t
  misc_feature (371)..(371): n is a, c, g, or t
  misc_feature (391)..(391): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (434)..(434): n is a, c, g, or t
  misc_feature (445)..(445): n is a, c, g, or t
  misc_feature (550)..(550): n is a, c, g, or t
aaacaggcacgaagaaacaaacgtgtgtatcctcttanttcctatatcacaaatatagcagangcngcaatctgtacagtaaaatgcngtnatggaaaaggnatctctctaangcatctganatacttaannntgtttaactttnanatgcatagtgatcaggaaaggnatacttgggggggggaggnngctganctcccacgttctcatgaggcatcccccatcgtttcttaaagcatatgttaagtaggacttatttgggtctcaaaccacaagnataatataccactggctaaggggctatgtgntnaatnatcaggggngnatctattcatgcactagtttgntacagctanattctttacagtacncaaaacccattaataatgtngtatagtgaccaaaatgttaagtgngntngnttacattactgntgtgtgggttnattccagttcaggcatctacttgtgttacagcacagctgtcaaaaggcgataatgagtaaatcataaaacgggtttgtttcttcccacattattctataaatggncaccggtgggtagtgaag

SEQ ID NO: 679980 - DNA, 159 bp, Homo sapiens
  misc_feature (137)..(137): n is a, c, g, or t
aggatccccctctctgcttgtctgcctctggagggtgactcatgagcagcagaggcactgccaacattaaatactgttgagtaagctgaacaaagactataccatttcacttatctggaaactagagttactacacnccttctcaactagtcacactaa

SEQ ID NO: 679981 - DNA, 134 bp, Homo sapiens
ctgtgctgatccttaaaccatctacacagtccattcacggcttgggaagatctggccccgtgctccggcaatccctctggagtcaccgattactctattcttatccttgggttttaccctcggggcctggttat

SEQ ID NO: 679982 - DNA, 367 bp, Homo sapiens
aattaatataattaatggttttaaccaacgagaaacccggattataaattggccaaaaaaagggtcatgttcctttgtttaaattttttttggtatggctgggcacgggtgctcacgcctgtaatcccagcactttgggaggctgagacgggcggatcacaaggtcaggagttcgagaccagcctggccaacatggtgaaaccccatctctacttaaaatacaaaaattagccaggtgtggtggtacatgcctgtaatcccagctactcaggaggctgaggcacgagaattgcatgaacccaggagccatgcattgagctgagatcacgccactgcactccagcctgggcaagagtgactcagtctc

SEQ ID NO: 679983 - DNA, 998 bp, Homo sapiens
atttaccatctcacttctaggactactagtatatcgctcacagctcatatcctccctactatgcctagaaggaataagttactatcgcgtgttcattatagctactactcataaccctcaacacccactccctcttagtcaatattgtgcctattgccatactagtctttgccgcctgcgaagcagcggtgggcctagccctattagtctcaatctccaacacatatggggctagaacattacgataaataacctaaacctactccaattgcaaaaactaatcgtcccaacaattatatataactaccatcctgacttgagctttccagaaaacacatcatttgaagtcaacacaaccacccactagactaatcataagcatcatcccccgtactatttataaaccaaaatcaacaaacaacctatttagctgttccccaatacttttccttcggaacccctaaaaaacccaccacactaaaagcgtcacgtggcaggggacgcagaagcccaggcagaacaatgaggcagacagacagaacggcaagtgattacgatacaacgcacagagacgaaagaaacacgtgcaagcgcacgaaaggaaggcgtacggaccaactagtcgtaaggacagagctgccagggacaggaacaaagaaattacatgatctcaaggcaaggaaaagagacgccgcacatgagtagacgggcccggggggcgagcaggaggagctgacacgagggacagcgtcgagaaagaggcaaggagggaccgcgcgcagagcgagagaagaacggcagagcacaagggcgagagcatgaaagcaagagcgcagagagagcaggaggcgagaagagtggggagacgggagggaagagagaagagcaagaaacaagcagaaccaggaaacagcgagcaaaagaggtcagaaaagcagcaagcgaaacggagagcgagagaaagacagcaaacacacagacaccaccactataggggg

SEQ ID NO: 679984 - DNA, 934 bp, Homo sapiens
taccccccgcatgcttaatcgtatcaatcaaaacgcccagcagaacagttatttggaaagaggcctcatgtagatgctgaacacatatcgtgactaccattgcgaagtagggacaccagaatgcacttgccgtctcattccttttccagccacgacttaatacggatacaccatggaagatgctgctctgtactaacctcaggatataccaggctgggacaagagaagaaaacgtcaggatgattacatgtccctttgcagatgggactgcaagcaagttggataggaggcttcacttaaactgcaaaggtcctcaggaccataatggcgtggatcaccctttagagaagaaaccattgaacaagttggaaaacataggcaagttcacaccctggggtgatggaaaacttcccggaaatcgtcacatgccttccaacctgtgttgcaaaactccccatcaggttggccgttgttcaagatgacgcacctccttttactggggattccctggaggcaccacatataacactaaattatcttggcgcataagatttaaccatgtatatatacgtttcgaaaggactaccttcctctgtcggggcagagaaaggtgacacagctcaagctgagatcgtgcctccaatgacttttatattggccttgcaaggggttatgcaatgggagaagaagcctaatgttacctggcaataaggaagggaaatgctgcatagtctcctaccataatgaagacagtgttgttcttccatggcaggatgtccaaattaaaaacccctggtgccagtgggtctgtattaaccgtaatttgggtggcacacacggagttaggcacgggacactcttgacaataaaatggaggatcatctaaaacattttaccactggcagtcatcgttacgaaaagcagaacacccggt

SEQ ID NO: 679985 - DNA, 515 bp, Homo sapiens
  misc_feature (49)..(49): n is a, c, g, or t
  misc_feature (101)..(101): n is a, c, g, or t
  misc_feature (108)..(108): n is a, c, g, or t
  misc_feature (160)..(161): n is a, c, g, or t
  misc_feature (196)..(196): n is a, c, g, or t
  misc_feature (249)..(249): n is a, c, g, or t
  misc_feature (256)..(256): n is a, c, g, or t
  misc_feature (386)..(386): n is a, c, g, or t
  misc_feature (442)..(442): n is a, c, g, or t
atgtttagtttttttttttacagttctaccacgagagatacagcaactnagaacttggccacaggtcttgcttagacacacattaatatgaaacaaaaaanatttatntaaataagttaattaaacttcacaaaaactaaagaaacacaagagaaaaatnnaacaaggaataaaaactgtacaatattggtcagtnttttatatttgaaaaatgtgtaacttaaaaaaaagttatttatggtataaaanaaaagtnttttatatttgtgttagctggagtgaaaacttgaagactcagactcagtggaaagagatgaatgtgcacgtcggtttggtttggagaggatcttgaggctggagcctctgctgagagaggtgagtgcgtnctgggcagaggttttaaatttggctccaaggaaagcatagaggatggggttcaganaacagtggaagaaagctagggcctcggtgatggaaatccacttgtgcacagtgttctcaaactcacacccttg

SEQ ID NO: 679986 - DNA, 251 bp, Homo sapiens
taggaattacagaaacctggttgataaagcagagccagggtgtgagagagttgacttcaattttgaaataagttccactggctgggtgtggtggctctcacctgcaatcccagtactttaggaggccgaggcaggcggatcaagaggtcaggcgttcaagaccagcccggccaacatagtgaaaccccgtctccaccaaaataaaaataaaaataattagctgggcatggtggcaggcacctgtaatccca

SEQ ID NO: 679987 - DNA, 80 bp, Homo sapiens
ggaacttggaagtgctgctcttcaccattcacagcaagatgagggccaacaaccagaaggtctacatgccccgggacgca

SEQ ID NO: 679988 - DNA, 282 bp, Homo sapiens
tagaggatccccctgaggttatccccaacacacctttcaaagcacttctcagaaaaaaaatttatgggttttggagcggcagaggcgggaatccttttaaaaacactggcaggaggccaagaatttttttttaacacctgtaaacatttttaagataggaggttagttaacagtaattaaactatcccagggatttaacagaagtgattctactggggaggattcaaggcaatttcccattatctgtgtgggccgataggggacccgggctcgaattcgaaa

SEQ ID NO: 679989 - DNA, 356 bp, Homo sapiens
ccataatgccatgtggcactctaggtccaaggtctccagagggtgacaagctggatgatctgtcactgtcctactgagacagcacagccaacctagctagcaacatttgttttacgtctgaacaaatttatacttatagcaattcagtcaacagatacacaagtctgaaacagcttcataggggtgtgactctaaccagtagtcgcaatgtaatagacatgagactatacttctctgctatctagatctgaactccttggcttcatttacttagtacaagccccagcctaggaaaagccagttacataaaagttggctcaggagtcttagagctttacctaaatatgagacccgca

SEQ ID NO: 679990 - DNA, 403 bp, Homo sapiens
atttttgctataacatttctgagccaaaggcagagggtatccattaacttcattgttgccttaattgaggggtgggtggcaatgccaagggtgggaacacaaggaagaaagaaatattaacgtcagctaagaaatcacatgttctcaggctatcatgcagtcggtcgcttatgtgtagctgtacatagggaatgctatggtgtcagatgttatattggtggtgaactatggagtctcccaattcttagcaatggtttaggcaaaaggtgtaggaaaagttgtatgctttgcgttttatatataatgggtatatgtcgcttatatggagattatagacgaaggttaatatggacttagctatatgggtggctatggtcaggcgttctgtacagggtcttcccta

SEQ ID NO: 679991 - DNA, 134 bp, Homo sapiens
ttggtcgatctctagcaggatcccccttctcccaaaggcaacattctgtggtgcagctccaccgtctccagtggctatagcggtgccgagtgcgtgtcggcagtggcttcgcgcctggtgtggagtgaacgcat

SEQ ID NO: 679992 - DNA, 1439 bp, Homo sapiens
  misc_feature (783)..(783): n is a, c, g, or t
  misc_feature (806)..(806): n is a, c, g, or t
  misc_feature (1168)..(1168): n is a, c, g, or t
ggtttgccgacagacatacaagtgtcgtgaaaattacccctaaaacccaaaatgggaaaggagagtgactcatatcgaacatgtgtcgtcattgagacatgtcaggattctgtggcaagctgcgatcgactactgggcccatcatggatctgagtaaaactgtcggctgtagcatgcgacgaccacagacaccatggtgaaataacttctgagaacggaggctgcttgatcatgggatcagggacttgctcttcagagatgactgccatggagtcttgcgactaccatctgatagaagcattgcaggcgagtgaaacagtagtgtatgcaccaagttatgccttatctttcctcttggtgtgtaacacttgatgcatgacaaccagacgtaacacgtctacttactcgtttgaattagtccatcttgtatcggcacccccatcgtagcgaccagggaggaatccttttaattccaaaaagagaaccatttgcactttcagcctccgggggaaccaaatccttcgatggggcgaatggagccgtgatggctttgtgccccatcgaacgtctggaactaggcgtcgacaggggtgcatgcgtataggggctcggaagacatgtggtcgcactcagaccacttggtgggataaatcgctgccacgcgagacgggtaaaactctcgtgttgtccgaaggtacccccgtagggaaagagataaggccgaagattgacatcccgtattgcaaatcgcgcacgtctttgatcatgacactacgcaatggngaaagtggtggagtttccgacgngagcaagacagccataaagtatatggtgctacagcgtgaggtgtgctaccatggagaccgggaacaccacgctgggggagacctctttctcaagtcaattggcaacgggacttcggaagggcagctatacagcagacggaacacccgatcgctagcaagtcacaggcacattgagttaggcccacggtgagacaccaaaaggtctcggcggtctctcagcagagagtggaaaacctcatacccatagcgcatgagactcgatgttataggccggcgtgttacgccctagtggtcagccacgagcaagctgctgagcagcggtttccggaagccaaaaacgtgcgcgcgcggggtatacgaanagcgcatatgtgcggtactgtgtctaactcctggcttaggttccgggccggcaggaactctcgtgctcctcttgggcgttacccagcgataagaagtaccgcggagtttggcagacccacaaccgcgcaatttcgccgtgtggggtgaatctgcgccccccacatgtgttctgttctggtgagcccgcgagttagaggtctctgacgggcgacttgtgtgcgacccattgcgcctgtccatccgggtgtaacccgtatgggttccccgcca

SEQ ID NO: 679993 - DNA, 264 bp, Homo sapiens
agctgccctcatccacagtagcaactcattttctccatttggatgtctggccccttaactctgagacacaataaccctgcttacctgaccagtcatctgaactgttccgttctgacagcagtttatgtgtataatttcctcccttatgtattctgcaaatcgtacagtagaaatagcaaatgaaagacattgcaacggcctagctctctcccaccccttctttccctggcctggtgtcttttgagctcagtgagtctctagaaa

SEQ ID NO: 679994 - DNA, 342 bp, Homo sapiens
cttgcaatccacgcatgcggttcatgaagagggcccgagagaacctagaagaatgagagggatatggaggagcatcagagaatagggcatggtgcgccctgcgtctagacagacccgggttgtgtcgatcctcccagttcttctggcgccttggggcttcacttcctcatctgttacattgatgcgaggtgatgtgtgagagagcatgcacagggcagggtccgcatcaccaccaccatcaccatcaccatcaccaccatcaccatctatcgtcatccatccatagttatcaccatcatctaccacttccactagccacccccttgcgtgaatcgccagggt

SEQ ID NO: 679995 - DNA, 368 bp, Homo sapiens
cgcgtcgacgatataaaggactgtatctaatgtaggtgacgacgattgagtatttgacatatgagtgcgaaccctcctaataagacacctggaaagataaatacccagggcgcagaatagaaataacttttaccgtcatgtaaaatggcgcctaattcaggaatagggggttttactcctaaaccaataaaggcgagaccggaaatacttaacattaacttaccaaaatctgcagtaacaagtgccataatgtcactgatgagatgtggcacaatgtgatgtattgtaacttggaacttcgacatcccactaagtggcgcaaatttaacgaacggttgtgtcatcgtgtcacgtgctaaagtcgacgc

SEQ ID NO: 679996 - DNA, 238 bp, Homo sapiens
tagggcatagctgtatccagaggatccccttcagcacatttagggtaataccagattcatagaggttatgtagaagatgccacatagaagacaagccatcacagactacccatatggtataggtggtgcatggcatggggcagaaaatggaccaaggaagaataatcacaaatacatctatgatgagagaagctgcaagaaaaatagaagaaaggcattttacacaaccatgcaacac

SEQ ID NO: 679997 - DNA, 233 bp, Homo sapiens
ctcaactcatgctacccattctaatttgagcaaagctaaatcatgggtcttagtctgtttagcaatatctcctcaagatgaattttagttgactaccccaaattgtacaatgtgttgtgtccaagtttagacacatcaaaatgttttataatcctagcacattagattcaactgaactttttcataaaaccaagtcatgtttgggcttataagtttgcattatgttgtagagt

SEQ ID NO: 679998 - DNA, 436 bp, Homo sapiens
acgatcctggtcctccagctgctccaggacacgaaagtgggaattccagcactaagccaggcaccgggcataagctgggccttccggctcccttggatggggtcaagactgcaggcctggcacacttaggagtgtgctggctaacagctctcacctagacccacgacacgcgcccacacactatgagtctctcaagaatgtaatttattgggggcgcccccagactgtgtttcctcacctgtgcctgtcctaccttatagccccagccttggacttctttccaaatagcaaaagtgtggtataataattgataatctttatttatagcgcaagaaatgggtatagaacatgcagagaagctggaatttcttaacaaagctaagtgttaacaaagctgagggaagaggtaaatctgaatggaagaaagaagaatgtc

SEQ ID NO: 679999 - DNA, 127 bp, Homo sapiens
  misc_feature (107)..(107): n is a, c, g, or t
cagatagcatgtgagtgaatttatgaatggaatgaatgacatgtgagaaaactcttgctagacatgacggttcctatacagaagaaaagatataaacttgattgctncagtaaaaacacttttagag

SEQ ID NO: 680000 - DNA, 674 bp, Homo sapiens
  misc_feature (16)..(16): n is a, c, g, or t
  misc_feature (23)..(23): n is a, c, g, or t
ccaggctggtccgcancgggtantgggattgccttctgcccttaggctccggtagattgcacctgaccttgtttctttctgttcccgggcggcatcggacccgtcggagagtaaatcccaagtaaggtacctgccgttggcagatttgagctttcttcttggacacctaatacccacagtcctccaggctccggtagattgcaaatgacctgctttctttctgttcccgggtggcatctgacccgtcggagagtaaatcccaagtaaggtacctgccgttggcagatttgagctttcttcttggacacctaatacccacagtcctccagtaaatcccaagcaaggtacctgccgtcagcagatttgagctttcttcttggacacctaatacccacagtcctccaggctccggtagattgcaaatgacctgctttctttctgttcccgggctgcgttcggacccctgtgggatagtaactcccaagtaaggtacctgccgtcggcagataggagctttcttcttggagacctaatacccacagtcctccaggctccggtagattgcaaatgacctgctttctttctgttcccgggctgcgttcggacccctgtcggagagtaaatccgaaaaaaacagaaaagacatggatttactgtgcatattagcagatcca

SEQ ID NO: 680001 - DNA, 151 bp, Homo sapiens
tgtgtggtgatctagagatcccttcacacaggaggggacgccccatacctcaccaagggccctagatgcagctgctgtcgctgtgcctccctcagtatggtcttcaaaccaggcctggccatgctgtagcagctccagtaccctgccacag

SEQ ID NO: 680002 - DNA, 429 bp, Homo sapiens
  misc_feature (409)..(409): n is a, c, g, or t
  misc_feature (420)..(420): n is a, c, g, or t
gagggcatcccgttggacagcgagcgcgtcttcctgcagaacaaccgcatcggcctcctccagcccggccacttcagccccgccatggtcaccctgtggatctactcgaacaacatcacctacatccaccccagcaccttcgagggcttcgtgcacctggaggagctggacctcggcgacaaccggcagctgcggacgctgggcacccgagaccttccagggcctgggtgaagcttcacgccctctacctcttacaagtgtggggctcagcgccttgccggccggcgtttttgggcggccttgcacagccttgcagttacctcttaccttgcagggacaaccacattcggagttacctccagggacggacattttttcgtgggaactggggtcaaactttaaggccacntgttttttttncacggggca

SEQ ID NO: 680003 - DNA, 484 bp, Homo sapiens
tccataaggtgtgccagtactattttttcaatttttttattttttttggagactaagtttcactctggtggccaggctggagtgcagcggcgcaatctcggctcaccgcaacctccacctcctaggctcaagcaactccctggcctcagccccccaagcagccgggatcacaggcatccgccaccacgcccggccaatcttctgtattttcagtagagatggggcctcgccatgtgggccaggctggtcttgaactcctgacctcaggtgatccacccgcctcggtctcccaaagtgctgggattacaggcataagccatcacgctcggccgcccatcctttaatctatgatggcagtgaccctgttttggcttctgctagagaacatggtaacgctgtagaggagggggtggcggagacaaacagagacactgggctcagttcagcctcttctaagacaagcagttgggcacacattatggag

SEQ ID NO: 680004 - DNA, 1859 bp, Homo sapiens
  misc_feature (618)..(618): n is a, c, g, or t
  misc_feature (1310)..(1310): n is a, c, g, or t
  misc_feature (1322)..(1322): n is a, c, g, or t
  misc_feature (1423)..(1423): n is a, c, g, or t
gctgttgttcagggattcccagtcgtaatttagacggcgaacacgtttcagccgacattgtccggagagccctctgcatgctccctgcataagtgaacggaggcaggcatgtccagttaagcttccttatgcagtcatggaatcgccacattaggctggcacacaagtcttctgacatatccagaatgggaacacatgcatacatctcgtacataaaaacgcgcacagaacggtgcaatgcggcactcctcactacttcgagtaacaagctcatccaccgcagcgcaccccctgcgcgcaaggcacagccatccccatgtcctgcggcaggcccctccgattcgcccaaacgactctctgaataattgtcaccgacgatgctgtgaacaacagacaactgcacccattgtaccactctggcatccattcgccttcccacgtgggctgtggcttctctaattaaattaccaccatttcaccaacagcggcaaaaacgttagccatttggtgcccccacaacggcaacggtggtgcccactgtgactcggtccttggaaaacggcttgtcttggcctttgaccatttggcagcaaagcagctttgaggcaacgagccccntagacgttccacacacacactattcgaccatacgaggcgccctggccacatttgaccaataccgcatacaccgcttagggccaacaacccccatttattccatatcggttaagcatcgcgaacaattcagaatcatccccctatagcgggaccataggcccctattttgtctccacccgtgatgtgagcaacatgcgtccacgcaacgacgtgaggatgcggcgcttcatattaccgcatctctagggctattcaggcgagtatgcctaaagcccgattttgacaactatgccgtccgcgcgaatctggcgtgacacccattttgagaatcaccccgagcgactccaaatgtgagccaccttatatccgagttccgaataccatcggcgcaccgcgcggcgccacaatattcacctattcataaacacatcgagcatctgctaaacaacaccggccccttttaatagcatcccaatttaatcaccacgcaaaagagtacaggtggcgcatggcccctcttcgtggcagagggcttaagaaccgcacaatactccaagcagccgaaatcattattcccccttgtccccccactttctccacatttgagacgcatcagcgccccatacaagactattgtggtttgtacggatcgcgacacgcgcaacacacttacgcgcggcagacacgaaaanatgtctgctccnctccgatgaactatgtgcgcgctcactcaacactcgcacacctacgcagccatacctacacgtggcgatcggaacacagaggccccgtgcctgacacagcnactattccctaaaaacagtcgcatagtggacgcagcagaccatcacatacaaacaacactttagggacgtcaggccaccgcactggggcagagccgacacctatggcccgctcgatgagcgaccacactctcaacacaactgaaggacgcagcaaacggtgcatcttacaccaactgatcgtccacgcgaccccaaaactttggcacaccgaccatagtgaggcacaacagcaccgacccaaaccacatggataataacacccacagccgctggctgtgtcgcaacacacgccaacaccaccgcccccacaccatggacgccggcacaacaagcagcgggactacccaacgcatgaccgccgcccacgtagcacaacataccaccacgaggatacaaaacccaatttcatacccattaacaaccacatgagacaac

SEQ ID NO: 680005 - DNA, 405 bp, Homo sapiens
ctctgaccagacgtcattcttgcatggatgaatggacagatggacatggatggatgaatggatggatggatggatgaatggatggatagatggatggatggagggatggttgaatggatggatggatggatgaatggatggatggatggacaggtggatgtatggattgatgcatggatggatggatggacaggtagatgcatgatggaagggtggtggacagatggatgcatgatggatggctggacaggtgcatgcatgatggatgaatggacaggtggacgcatggctggatggctggatggatggacagctggatgtatggattgatacatggatggaaggatggatggctggatggatggctggatggatggatggacaggtggacgcatggatggatgg

SEQ ID NO: 680006 - DNA, 888 bp, Homo sapiens
tcatagcgtctgccgagaaagaatttactgctatgggtgttcgctacaacaggatatgtgacgtcagacagccccagaaaccccttccagatctgagtatgggactattaatcttcatgctgtgtacttggtattcattcaggcaattgcagttgaatggggaaggctccactgcattctttggctaaggccctgagactgcttgtctcattctgtaatatctatactcgaggtgtgttttccttttaaaatttctttatggagagagggactggttctgccggggtgctgaaagtatgattcaatgtgcaacatacaggtaggtcttcatcataacgtctgagaaatatatgcttgtaaaaactctgacatcttctgtttaattatccacttgcttcttaactttacttctctttgtgtcccgcctcactcctagtcttactagcaagttgaggccaattggatgaagtggtaggcaccggaagacacatggaagattgctctgtgctttcaaagccaaggtgtacccccacaagcccaaattgagtctaatgcactggccatgctgttgtggacattgttttctacaaacacaatgctgggtgtttcttcttcttttgaacatagagggtacccacccacaaggggaatgccctacttctctcgcagctcttttgaaagcatttctgtttgaggggaaacggtctcttggggcacgcaagtggtaattgggatagcttggctccccttttttccagctgggaccttgtaatccttacacataccgtaattccaacctcaaaacttattattgcctagcccagtgaatcagcaaagtacctttctgcccccggtggcacttatcaggcgcggggtcgcacctgcaaa

SEQ ID NO: 680007 - DNA, 228 bp, Homo sapiens
tttatcatcaagtgattttcaaagagggtaccaggactattcagtggggaaaggagtagtctccattcaacgaatggtgctgggaaaaggatatctgcatgcaaaagaatgaggctgggcacctagggcacaccaggcacaagaagaggctgggcacctatttcacaccatgcacaaaagttaagtccaggtggttcaacaggcgtgttagtgcggaagaaaaaaaaa

SEQ ID NO: 680008 - DNA, 250 bp, Homo sapiens
acgaggtacggatcgtgcacccattgtctgagaggatgtgccagcttcacgctgaggtgacatgactcgtggaacggtgggaataagctggtctcagtgggactccccggcggtctaggagcagctgggcggatagcaccgggcatattttggaatggatgaggtctggcaccctgagcagtccagcgaggacttggtcttagttgagcaatttggctaggaggatagtatgcagcacgatcctaactct

SEQ ID NO: 680009 - DNA, 426 bp, Homo sapiens
acggctatatgaatgacgggtcgagggttacacgatctacctatctagcgcgactctattaatgtagtcgtggctaaaggcatccaattgtgtgactatgattcacccgccgaatcccgcgcaactaagttaaacaactcaaagtctaactgtgctcagggctgtttactctacgcgacttctcccgccgcgggccaacgcgtagcaaagaaatttaatttctgacggtaaccccaggaccgctcctgaacattgacggtagcatggcgccggccgtggcgtggcgtccgtgcgtggtcccgtcaattcaagcggacccgtcaatccaagttgccgttaacagctgttatacctactcttcaggcggccgcacgttgcctagcaacatgtgggcccttaacgtcccatatgagtgacgataatctt

SEQ ID NO: 680010 - DNA, 2061 bp, Homo sapiens
  misc_feature (10)..(10): n is a, c, g, or t
ccccgctccnccatctatttctgagatccaaacggggaaattgaaagcccactgaaacctatgccagcatttccagttttccatttaaacaccttagttccagaaacccttaaaggatttggaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttctccatgggactggggtcgggcagcctctttattctgcagttgctcttgtggggctgtgcctgtggaggaagaaaatgggaagaaagagaaaaaggtacacaaaggaaagaaaactatcatctatctgtggtggaggaacagtccagtgacccaagtgccctccagcaggcgaggttttgaatctgttctctggtgcctggtattccttcagtgtgtaaaggtgcttagtgcgtgctttgctttcttggcttttctgtccccatctgtctgaaagcagacttgccatctctcattctgttgattgttctgtgcagtactctcctttttggaaaaactccagggtatgcttgggaaggaaaaaaatttttttccttaccaaccaacgctgtgttgttgagtaaacactgatctctacccacacagacaacaggaatccagctttctgcagccccacagcctagacagcagcaacctggggagttgtttgttagcaaccattgcacagaaggacgcagcacacgttcctgagtgcaggggtgttactcttagaaaagcgtcttgtagtcgaaagagaggaacttccccactggttaataagtaaagcctgttgaaatttacatgtcaattacctttcatagtcatggtccgaaaacagctagaacagctgtaaatctggtacattttccttccctcctcatctacacgcacccacatcttcacacacactcatgcccctctttcacacgcagtttgctgcacacagtgggatttagcagatagaatgcattctcttgtcctgtgtagtccaataagacatttactgaacacctggtactatctatgctaaatgctctgaatagctctctaggtgcaaagagaagagtaaggcatggtcccagatcagtggaacttaggttttaagaatgttcacttactatacattctgtgacgaagcctaaaataaacttagcctaccatctctataggttttataaaatttgcaaaagtaatcctttctcagtaaattcaagtaatggaaatgtatatgaaaaaagtaaacttctttgttcttcaccagtcccactgcgtggagctaactgccataaacagtttgctttatatggtcccaggtttttccattcctggatgatgatgtagctatataaatagatttagaagaacaaagacaggatggtactgacataggattttgtaacgtgcttctccaaacgaacaaaatggatctctttgcatttcagcacttacagatttgcctcattctatttagaggcagaatattgcattggatgcatgtcatcatggactcggtacttctatttatggacaggaggtttttttttcccagtttgctgctattacaaacaatgccacaatgaatgatctgaaacataaaactttgcgttgtgtggtagcattttggggaatagattcctggaagtgcaatttcaagatccaatagtgggaatatttttaaaatttgaataaatatagccacatttccttttgtaaaaaaaaa

SEQ ID NO: 680011 - DNA, 410 bp, Homo sapiens
  misc_feature (10)..(10): n is a, c, g, or t
ccccgctccnccatctatttctgagatccaaacggggaaattgaaagcccactgaaacctatgccagcatttccagttttccatttaaacaccttagttccagaaacccttaaaggatttggaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagta

SEQ ID NO: 680012 - DNA, 1107 bp, Homo sapiens
  misc_feature (434)..(434): n is a, c, g, or t
  misc_feature (674)..(674): n is a, c, g, or t
  misc_feature (684)..(684): n is a, c, g, or t
  misc_feature (731)..(731): n is a, c, g, or t
  misc_feature (1107)..(1107): n is a, c, g, or t
gccagcagaacacaaaaggcgactgttacaggaggcagaaagaaatgatttaggtagacggggtaaagccagtccccagcagaaaatttgccttttaacaaaaagcagctcaaaaatagctccctttctaacctcggggttcaaaatcacttctcacgacaagcagccagaaagagcagactgtgaatcacagatgagacagctcgggcacaggagtgcggggggtgtctcctgggtgatcaccaaacttcacacttccacaatgggccccagtaaaacagtggaccctaataagcacattcccgtccccttaggtgcactaagggaagctaaaagcagactgaggggtgcctgtaaccccaagaagatgtctgggagcagacccagagaccctcgcagaaaagtgtcacagagcagcacagactgagtctganagaaactctctatacaaatagcacaccttgtcccagctaaaaccctgggccctgggaggacaagacatccctcctctaacccctcgtcactagcccatttgtaaaaaccttgacaggccgggcacggtggctcacacctgtaatcccagcactttagggaggctgaggcaggcgcatcacctgaggtcaggagatcgagaccatcctggccaacatggtgaaaccccatctctactaaanatacaaaacntagctgagcgtggtggcgtgtgcctggagtcccaatactcaagaggntgaggcaggagaatcacttgcccgggaggtggaggttgcagtgggccaagatcagcccactgcactgagctgggacagagaaaatgaaacttgacactttactacagattgaaaccggttaggcccgtttgaaggaaaggctttcttcatataggaattaacattaggacagaagaaagaagtagacgaagacaaacaagaaataagagagagaaataaagaaaaaaaaaagaagagaaataaaagaaaacaataaataaaaaaaaggagatgacatgagaaagaaaagaaagagtccgaatacaggagaaaagagtatgaaatgaggtccattattttgtagatataggagggcagaactgaaagaagagcgagn

SEQ ID NO: 680013 - DNA, 625 bp, Homo sapiens
  misc_feature (10)..(10): n is a, c, g, or t
ccccgctccnccatctatttctgagatccaaacggggaaattgaaagcccactgaaacctatgccagcatttccagttttccatttaaacaccttagttccagaaacccttaaaggatttggaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttctccatgggactggggtcgggcagcctctttttctgcagtgtactgggggctggctagaaaaataataaatttaaaaacatctgagaaaatatcacattaac

SEQ ID NO: 680014 - DNA, 623 bp, Homo sapiens
  misc_feature (51)..(51): n is a, c, g, or t
  misc_feature (281)..(281): n is a, c, g, or t
  misc_feature (457)..(457): n is a, c, g, or t
  misc_feature (470)..(470): n is a, c, g, or t
  misc_feature (490)..(490): n is a, c, g, or t
  misc_feature (497)..(497): n is a, c, g, or t
  misc_feature (608)..(609): n is a, c, g, or t
cttgtgggcaaggggcggggcctcaggggactgcccaaaagaagaggattncagttcaggaacccgtggaggggggatggggttgaagccctctctgccaagccgttccttcgctggtcaggcaggaagtagcatgctccgagttgggttatgggggtggaccgggatacccctcttttgagcatctatgcggcaccggaggtttcccctacatccgtcccagcacctcttatggaagtcccagcacaggatcctggaatgcacacggacgctggggctgnccctgtgtgtgtgaggagtgtggggcagtgcccttggacaggagcctgtgagagccacctacacgagatcagagcccccagccagggcaggccataggagacctcccgcagcacttccccggcggggcaacgtgggaggcaggagctgacccttgcttgcagagatatatgacatnctatcgtactccncctgatgaagcctgtaactnaagcatntaatcccccacaggattctatgcagtgattccaggagttgacattgtatgatgtgtaacaaaagaatctatttgctatcgacaaacacgtatgtagagagagacatgccgnncccgaaaaaaaaaa

SEQ ID NO: 680015 - DNA, 553 bp, Homo sapiens
ggtatttagatcggtacttaagcgcggaccggtgtgtccttggtacttgagaggagtggggacgtcctggctgtcgtgaggcagggagtgtgcgtcgtgcgcagtgaggtaaccatagtagatagttagatcatgggtagatagttgagagaaaggctaagagagatttctctagttgatgaatgtgtgctccagttggctatagactgttgaaactggcgaggtcaagctaccaagactaggagccaaatcgtccaagtggtctacgtttcgggctggattgacttggtcaaggccctcatggaatattgctatacaactagcctgcactagtaatgcaacagataggcagtcaatcatgggcggatgaggataacatgtagactggatgtatgtaggaggagatcccattagaagtatcggtcctgctggaggcaatacaatgactacgtgtggtcgcgcattgaaggaagcaaggaatgaacaggagtagagcttaagtatgcgttatctctgtaatagaggtacttacatgacgtaactacattgtgac

SEQ ID NO: 680016 - DNA, 478 bp, Homo sapiens
  misc_feature (7)..(7): n is a, c, g, or t
  misc_feature (35)..(37): n is a, c, g, or t
  misc_feature (40)..(40): n is a, c, g, or t
  misc_feature (56)..(56): n is a, c, g, or t
  misc_feature (399)..(399): n is a, c, g, or t
  misc_feature (442)..(442): n is a, c, g, or t
aagaacnaggttgttctttgcttgtagtgaggggnnnggnctttctccaactggcnagtgctcagcaaactgaccatgagttctgaatcctcaagtataggcatccaggtcaattagagaaaagaggggactaaggaggaagcagaatatggcttctttctctgctgtcagaatcatgaatatttctctactttataatgacatattattattggttcagaatatttctttctttctacccttatcttttctaagcactacaactccctaaatcatatttctctttgagaattgtgggagaactcagaatgagagtgacattttcttttggtcttattgggccaaagatgaaacctttacctcggagttgatttgtcctatgccacttccagaggatgnccattggtaactggtaaaaatccaagtattttttaatttaatnaatcctccaaaaggccctcccttccttgggtggttc

SEQ ID NO: 680017 - DNA, 448 bp, Homo sapiens
atacgcggcctgggctctggtgtctcccagtacttgaccttaataaacaggccccgtacatgggcccaattccaatccaagtgggaacttcccaagctagtcggccccccccggggggggcaaaggaaccggggagcgggggcgtggccatccctcgctcccgaggaggcaaaccgttgaaaccgcagggagcgccctcacggcagactgagccctgggagaccatcgaccatcaaacacaggaaccccccggtttaacctttagtccccaacttgggaaacacgggaagaagccccaaatccccatggggggggttccttaccccctttaattggcacacatggggccataagaagcgttcctggcgccccgtgggaaaccaaccccttgttccaagcaaaagccacagtggaagggggtgcacgtcctaaccctgggggccaacta

SEQ ID NO: 680018 - DNA, 133 bp, Homo sapiens
gcgtacaactcgaagagtgtgaactgttatcccatagacacgaccgagcggtatgtatgtctggatacataaaatgcacgcaaggccattatctctccatgggcaagctaagttataacaataggtgcttggt

SEQ ID NO: 680019 - DNA, 897 bp, Homo sapiens
  misc_feature (557)..(557): n is a, c, g, or t
acatagaaattaaacaatatggtcccaaataaccagtggtcaatgaagaaattaaggaaatcaaaaaaatttttgaacacatgataataaaaacacaacataccaaaacctgtaggatacagaaaaagaaaaactaagagagaagttttgctataagcacttacatcaaaaaagaggaaaaatttcaaataaacaatctaatagtgcatcttaaagaattagaaaagcaagagtaaaccaaatccaaaattagtagaagaaaagaaataataaagattagaacagaaataaatgaatttaacatgacaaaaatcacaaaagatcaataaaacaaaaagttgattttttgaaaataaacaaaattgacaaacctttggccagaataactaagaaaaaaaagaaagaagatacaaaaaaatacaatcagaactgaaaagggagacactacaactgatactgcagaaattcaaaggatcattaatggctactatgagcaaatatattccgataaactggaaattctagaagaaatggacaaattcctagaaacatacaanctaccaagattgaaccatgaagaaatccgaaagccaaatagaccaataacaagtaatgggatcaaaaacatactaaaaagtcttccaggaaagaaaagcccaggacccaatggttcacttctgaattctactaaattttgaagaagagtaataccatttattcaaactattctggaaaattagaggagggaatacttccaaactcattctatggagggccagtattacctggtgaccaaaaccggacaagaccatttagaaagtaacctcaggcatatctctgatgcacattgggcaaaatcctacgaaaaataggaaccaattcacaaggcttacagaa

SEQ ID NO: 680020 - DNA, 131 bp, Homo sapiens
  misc_feature (40)..(40): n is a, c, g, or t
ggcgatctagaggtcccagttctggtccccactcacccanacaatcccagcttttttatacaaaaattctcggttctcttcactcaaggatttttaaagaaaaataaaagaatgtctttctgtctctctat

SEQ ID NO: 680021 - DNA, 707 bp, Homo sapiens
tgtgatggtactcgggtgtagcttccatctcttgggagcagcctgagcgtgggaggatcgcttgagcccaggagttcaagaccagcctgggcaacatggcgaaaccttgtctctactaaaaatacaaaaattagccaggcatggtggctcatgcctgtaatcccagctactaggggggctgaggcaggaagatcgcttgaacctgggaggcggaggttgtagtgagctgagatcgtaccactgcactccagcctgggcaacagagcgagactccctctcagagaataataaaattcggccggtgtgttggccgacaccaagtatgtcccagatacacaacgaggtctgaggagggaggatcatctgagccaggaggatggagattcggtctgaggcgtagattctgagcgattccatttggactggaggggtagggaaaatgaggcggggactttgctggggctgctttcccatgaaggtcaggcatgttgtagcctctagaatgtcaagggttaagggaacagattggatcatgttgattgaaagagacccggacttaggagtggtccggattagccccgtgtctggagaaccgagaagcattcttgaattgggcttaccattatattaaatatcgattctggcaaacatataggggattagggaaaatggtggaatcaaaaagcctgttgggagagcatattccc

SEQ ID NO: 680022 - DNA, 314 bp, Homo sapiens
agttgcgtgggacacatcttttttgaggccaccattcaacccactacaaaatccaactgaagcccagcgaagtggctcatgcctgaaatccccgcactgtgcgaggccaaggcaggagggtcacctgaggccaggagttcgagagtagcctgggcagcgtagggagatcctcatctcttttttttttcgagatggagtttcgttcttgttactcaggctggagtgcaatggcgcaatcttggctcactataacttcctcctcctgggttcaagcgattctcctgcctcagcaatcccgagtagctgggattaca

SEQ ID NO: 680023 - DNA, 100 bp, Homo sapiens
tctagaggatccggcacgaggctgggcgaggggcggtatggctggggcgtacacgactgtagctgtgctcgagcgctggggaactccgaaagagtgagcg

SEQ ID NO: 680024 - DNA, 224 bp, Homo sapiens
  misc_feature (215)..(215): n is a, c, g, or t
ttgaatgggcacagaaattgataggaaatgctaacagttttaaaaagacagttgatgcctctcttggtaatatcgggagctctggattaaagcttcccatgccaccctattgtcttcctctatcttatctcctagtcttatgctatattagcagagcttatatggcatttactcgtcttcggaaaaggcttacttgtacattgctattactattncaacattac

SEQ ID NO: 680025 - DNA, 1629 bp, Homo sapiens
  misc_feature (217)..(217): n is a, c, g, or t
  misc_feature (340)..(340): n is a, c, g, or t
  misc_feature (349)..(349): n is a, c, g, or t
  misc_feature (354)..(354): n is a, c, g, or t
  misc_feature (374)..(374): n is a, c, g, or t
  misc_feature (465)..(465): n is a, c, g, or t
atggtgacccttggaccttgttggatccgatgatgttgaccgctgctctagatgaggtcgctaaatgagagcggtgtagctggtgttccttctcaccttcactatgaatcatcccattattttgaatttcacattgttgttgtgacgcccataggtcgcttctcgattctgcgtagctagtctcggccacaagcctcacacaaggctcgcttcacantggtcagagacatatcgattccgcacatggtgattttcccaaacacacttagggatgtgagtacttttgtgcacatattccatgtagagacatgggcatatcattcgataatctcaattctantccgtatgnattcnatcttcgttgtcacatggcnacatgtgtgctagctctaactgcttggtgcgagtatgtgtgcacgtgtgcagatctcgtaggtggtcgttcaagatagcgtgcgcatggangagcgacaggtttaggcgtgaggcttcacgttgtaagtatccgaaggttaattgtcccttgtaagtctgattgtcccttccattttgtaagggcgtggcaccttgtcgcgtgcagtgagacacctcgagaacttctatctttcctttgtgacatatggcgcacagagagctcccccgatctttaacctatgagaacagatcatctattctagggatttcggcatcgatctatataacagattggacagttgcccgcatttttcgttttgacatgcgctttaacttggccattggctcgaaaaacgctcgaacatggggcatttcacattggcccaacgtttgtgtttgctttgaagccaaattgaagccattacaccggaacaggccaatacgggtctccaagagggtggctagttgtggccacgggttaaaccttggaggatctctgcctgaaaatggcgttgagttgggggtatacccacttgtggtcccactctagccaatattgtgtgggacacacaaggggatatctttcctatatggggcaacaccgtcagcgtttcggttcccttggcggggaccccagaagcgtatgcggagaattggccctccggtaccccgtgtgtaacacagtttggcgtcccgttgtgggcggttaaaccaacttctgttttattgccatcttgaaccttggggttgtgtggattgtgcgcggggattccttgggccacgtttgccttttttcgacctccgggacacgctttttggtctagcctttgcctttgggcgccacaaatctacgcgtcttcggcccgggtctgtgcgcgcctttcatgatttccccgatttgttccccggggtgggcgcgtttgatgtggttcaacccggagctttgttttgcccccatgcttaagcgacaccgttgtttcaacgcaagaccaagacacacatatggcggcgcgggcgccgcctacaatagaaaagtaatacgtgccaccgaggagagtggtggcgcaccacatcttacatgtgcgtatttcacccgcagtattgtctgtggttcacacagtggcgcgccgccaacaaagtaggccacctgcgcttcataatgatcagaacacagcgcacgcgaccgtattacaacaaacacttgtgtaatgtgag

SEQ ID NO: 680026 - DNA, 279 bp, Homo sapiens
  misc_feature (128)..(128): n is a, c, g, or t
  misc_feature (236)..(236): n is a, c, g, or t
  misc_feature (273)..(273): n is a, c, g, or t
atgaagccagtgccagagtgggtggtgggatgatggggctctccctaggctgctcccagctggctgtgaatgttggaatttctgctcctcctgcctgctcccctccccatagagagatggaagagagngagagagagctgaggtggcacgctggcgtgggctcagagggaggtgatgtcattgagtgcgttgtcagttctcgctaatggcttgtactcatcttctgggcatagctnatcttctaggcatcgtggtttctccactttgcacagnctctcg

SEQ ID NO: 680027 - DNA, 842 bp, Homo sapiens
atcgcacccacctggggaaagggtgcaacatatatatagcttgtgaggccccccaacaggagcgcatatgtatatggctggttaaatatatatgtgtagaaaatgtgtgagagagggagtcttcactctggaggcggccccgccacttatagaagagtttttggttctttacacaacacgtttagtcctcttttgaggaaatgtgttatagggtgaattttttgtgggagagattataaaaaagagatgatccacggggggtcttttttgtgaagtactttgtttctgttgtaaaaattttggtagagatgcgccgtgtctgcaaaatgtttatgagattatcacatatataataaatgtagagaggcgccatttctacataacttatggggacacacaaccacacacaggggtatacatggtgaacacgtcttgccccaccttttttttgtgtgtgttccacaaatttttgtggtttgtgttttggaggcccacgcagatggagatgtagaagaggttaacacataaagcacatttgagaatgcttttataataataagaggcgtaaatgagattttcttggttaagtgtgtttgagaatatattttctacattctctctctctccaaattctacataccacgcgttcttattttaaacctggaattaaataaccacatattggaaaaattttttgggtgttccccccttttaacaccacgagtaaattattttttgtcacataacacctttttaaatgtgtttttcaatacaataaggggcccttgctgagaacataccacaaaaaggggtcacccaatttaaatttgatgtggatgata

SEQ ID NO: 680028 - DNA, 929 bp, Homo sapiens
gagaagagagggcgacacgagccgacacaaaaaaccaaggccaggctccggctcgaaaaacaaaccctccccggccgccgagaccctgggctgaaaccacaggtagaacctctcgcaggacgggcgtctagtgttgtccccgtgaggcggcgattaacacccggatgcttggagcacgtgttgttcgagaatgcacgtcggttcgacaaaaaaccacacaaaggcaacactcgggatgcggcctagtaccccttcaatccccggccggggagaacttggatgacatccaaggagccttctgaatcttggggaccccaggttgggctccccggaagagacaagctgaggaagactccggcctcgcacttccgggggggcttgccaagagagggttccctaaccacaacagcccagcccgggacgccgggggcaggtaccccaacggaggagcgggccaagtgacggcaaggcaaggaaccggaggagccgggggcaacagcacgttggcagaggaaaggccagcagcacgggcgcttgaaacgatgtctggaggatgcggggccacttccgcagggcaaccttccccccttgagggcaagttcgaaccccggggggcgggaggctggccgaccccatgtgccgggaagcccaagagcggagaagcggggtgcgccaaaaggtttgtgtgcgttgcgcctgacgcacgatggagacaacgctggtgtgaaacaactctttgtaacaaaggaacagtgggccgaagccagaaacaggaagcacgccgggacaatccaagagctgctacatcggacaaagggtgggtgggagaacaaaacccttcagtgatgagaacggcgagcacaataacacgcaggagacacagcagcacacacacacagagagagggaggtcaacgccacaaggagcac

SEQ ID NO: 680029 - DNA, 418 bp, Homo sapiens
  misc_feature (132)..(132): n is a, c, g, or t
  misc_feature (143)..(143): n is a, c, g, or t
  misc_feature (146)..(146): n is a, c, g, or t
  misc_feature (177)..(177): n is a, c, g, or t
  misc_feature (186)..(187): n is a, c, g, or t
  misc_feature (189)..(189): n is a, c, g, or t
  misc_feature (193)..(193): n is a, c, g, or t
  misc_feature (199)..(199): n is a, c, g, or t
  misc_feature (210)..(210): n is a, c, g, or t
  misc_feature (214)..(214): n is a, c, g, or t
  misc_feature (216)..(216): n is a, c, g, or t
  misc_feature (218)..(219): n is a, c, g, or t
  misc_feature (253)..(254): n is a, c, g, or t
  misc_feature (257)..(257): n is a, c, g, or t
  misc_feature (265)..(265): n is a, c, g, or t
  misc_feature (268)..(268): n is a, c, g, or t
  misc_feature (301)..(301): n is a, c, g, or t
ggcacgttctaagatccacactgatgcaagcacagaatagtaaagaagtccgtggtagaatgtgatcctgggaggtttactcaagcccatagttccagaaagtgcaataccagatattggtttatgatcagnctttcaatcancantttgatgattagggatctctacattcgtatntcaggtcannanaagnacaccntttcttgaganaagncnannaaccctagtctaccaccagcatagttttatcatnnatnggtcctgngtnagccatgattttcttcccttcatacatcaccantctaatgaaacccgtctttggcctgtggctgaaacgccatctgttggcagtgaactctttccagcctatgtgaagagggtcatagccacagagtgcagcaacctggtcagtgcaggt

SEQ ID NO: 680030 - DNA, 465 bp, Homo sapiens
tatgagcatgccaaagcccaaattgaggtgaagtgcgttctatcttgttaaaacaatcgtccaaaaatgcacctaataaggatgctttgaaaacatctctgggagagaatttggggatgacggatttttcatcatgacacaaaaaattagatgaggtcttctaaagggccacacttgaccatattcataatcgaagtgagttggggttagtaaaaaaatgcttaccttgctctaacccagggtttggtgtgcatgtccaaaccacttccccagttgccatgtttttctgaagctggtggcaaaaagcccttttctggggccagctcctgtgcaatggccctgatgtggtagggctaaaatccacagcacccgccagtgtacctgacccccaggttgtaggcctctgtggcgtatttttgaatatcccatctgggggcaactatgggttccagtccaaatgggaat

SEQ ID NO: 680031 - DNA, 480 bp, Homo sapiens
tgcccccggttttgtaccccaaaaggtgcgcgccccccccggtttcaacctggaggagttcagggtggccggctttcccaaaaaggtggcccggcccctcggcttttttttggttccaaggagggggaacaagtccccggagtccctccaggccaacgtgcagggggtgaaggaggcccgctccaaatttttccttttccccaggaagccctcggccccccaaaagggagacatttttttttaaaaatttaaattggcccccccattgcccgggccggttttgcccgtccggaaagttttttaaaaggaaaaagctccggttttcccctggggaaaaaaaaaattttaaaccctttgtttttttccgtttggcccggccccccccccggttttttggcataggggcaaaaaaaccccaggaaccccccaacccggttttttaaaaaaaaaaaaaaaccccccctgggggtttgggttcca

SEQ ID NO: 680032 - DNA, 107 bp, Homo sapiens
gtcaatctgatcttatgccagactggcagcagatagttggcttgtgttgaatgatgcctgacacggcatagtgcaaaattcttctagatgtggaaccacttgagtgt

SEQ ID NO: 680033 - DNA, 115 bp, Homo sapiens
gcattcggcacgaggttgtcatgattttcaggtttacttttttaggacttacttttcaattcaggaggtcaaaattgtatatacttataggtgtacaacatgggtatattggaca

SEQ ID NO: 680034 - DNA, 341 bp, Homo sapiens
gatcgacggtgactttgcacactgaaaccaatattttatttaaatttttaaaaattgggaccgtgcgtggtggttcacgcctatattcccagcactttgggaggccgaggcaggtggatcacaaggtcaagaatttgaggccaacctggctaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcacgccactgcactccagcctgggtgacagaacaagactccatctcag

SEQ ID NO: 680035 - DNA, 802 bp, Homo sapiens
cctgcttcaccagtgcttggacggaacccggcgctcgattccccatccccggtcaggccgtcccatatgccacgccctcctgctcatccctcttcaccgctaccctcggcatcctgtccccaatggcccccgccgccgttccagcgccgcgcatgcacaccaagcaagcgctgcactgcccgcctctccttaggctctgccgccactgaccgacgcttgcgatccaccgtcagcagagtagcgccgataactctactcatcctaggacctcacgagagcctgctcatcaatccagccaaggatacaaccctaggaagcctcttaccagcctctctacggtataagccctgttcccatgctctataactaactatttgacccgcggatagatagttaggcgtgttaataagcacactgttgccaaaatcactattacttcaccaaatctcaattgagtgagcaagggaacaatcgctcgacgcaacactggatcgaatgcttgctaggaacctaaccgatggtaggcccgaatcttccttcaggatatcaagaaaccaggactgtgcattgactagggagagcgtggctgtacatgcaatatggaagtgtgctattacatttgggaaagaaaaatgctgagatcagctcacttactgtgaaactgcacgaaactggcgcactgcaccaataaatgacccccccattggtgtgacttcattgagacaccattacctgaatgagcaggtgaaagccatcgactgaattggggtgacaacgtgacaattgcgcccagggcacgcca

SEQ ID NO: 680036 - DNA, 112 bp, Homo sapiens
  misc_feature (3)..(3): n is a, c, g, or t
tantgagtgtatcaccactgcggtgcttgctcctgtacagttcatcacacgtgagcacgtgctgacctccaaatatcgttaagctggagcctggtcgactctttaggatcct

SEQ ID NO: 680037 - DNA, 373 bp, Homo sapiens
  misc_feature (179)..(179): n is a, c, g, or t
aaaaattggggggggggggggggggggggggtttaatttttaaaaagttttttttgggaacccagccaaacccaaaaggctttcccccttttaaaggggcccattcagggggggggggaaattcataaaatttaacctggggggttatttataagatttatatccggcattttcataanaggggccctttccccggggggttctttataaaaattcccgacattttttttcccccccaaaggggacccctggaaccccttggggggttttcccctttccccccccccattttttccctaatccctagaaaccccccatttgggggggttttttttttttgccccccttttaaataaaggggctccccccatta

SEQ ID NO: 680038 - DNA, 575 bp, Homo sapiens
gtaacttcataatagcaattattgcccgaagctatagtggcatatgaacaaaagttcttatgactgggcggactgataacatataaaaaataattgtgtttgaccccaaaatgacattgatccgcccaattctacgatagatacatatagaagatctatctttgttcgttacgctttcagcatgttctacttaaataactcagctctttgaagcagcaagtttcccagggcatccacacagtatcatgttgtgtatgaagtatctcaaactggaacataaatttagtgatcaaactgccattcacagtgtaaggcagcacttaaatttcgaacctaaagtttagatgcattgtataaaaaaacctaaaagcagtatctggttatttagctgtaaaccaagttggaagctattcggataaatttcttaaatattgatgaacctttgggagtactgtttctttccttcaaactgaatgtacttaattcatgattaaattgcacccttatatgtttaaaccaatctttgtatacttttggggatttggggcttatatgctaaatcacattcagcatgt

SEQ ID NO: 680039 - DNA, 243 bp, Homo sapiens
cgaagtggagacatcaggaacgcattttacactacccaccagcaatgtatgaacattcctttttctccacaaccttgctgacatctattcatcttttaacttttaattaatggccattctgactggtgtgagcacagtcatcttgtggtttgatttcacattactagtgatgatgcacattttttcatatatttgttggctgcacgtttgtaatttgagaagtgtctgttcatgtcctttgcc

SEQ ID NO: 680040 - DNA, 208 bp, Homo sapiens
gtgatggttaatacctgagtcctcaacattgattgaatagaaggttgcaaagtgtttgccgggtacactctgtgagggtgctgccaaaggagatttaacatttgagtacagtggagtgggaaaggcagtccatcctcaatttgggtgggcaccatctaatcagctgccagcactgccagaataaaagcaggcaaaacatttgcggccg

SEQ ID NO: 680041 - DNA, 899 bp, Homo sapiens
gtccatttgcgatccgtcatctgcggtggagccgcaccaaaagtgcagatgtgcgtgaaaacccttacggggaagatcatcacgcctcgatgttgaaccctcgagtatactgatacacactgtataatggccaatgatccagagataaggaacggaattcctccgtgaatcagcagagactgatctttgcttggcaatccgtctggcatgatggatcggtactttgtcctgactacagatattctagacacaggagtgctattcttgcatgctggtgtctgaagactgtcgtcggtgtgtcgctctcgaacatgggatagaacgaagtcttagaccagtcccaagacgaatacgcacataccagtatagaagtgtctacatcgtggctgttctgaacctattatccggtggatgagaatggcccaattagatcgccttcgtcgagtagttgcccttctgagtgactgtgagtaggctcggggtagttaatgggcgagggtcactgttggacatagattattgctgacatctgtcgtctgacgttacagtatcaacaaactggatagacccgtacctgtactgcattcagtagcagacctgaagcagttggaaaggactggaacagtacgggaacattgggtcacaagctgtctggtacactctcatcttgccaaaccaggatggggcagtggctcagttaccgagatgaccactctagcaaacttattggccaagcagatggttcccagcgctcattgcagtgaaccttccactttagaaagaaacccgggaggtgaacgacctttttgtgtaactgccgaacatacgagatcttgatgacacgctcaacagggccaaggcaaagatgtggtccaaagcagcgacataattaaaaaccg

SEQ ID NO: 680042 - DNA, 288 bp, Homo sapiens
atcgaagactatcagagactaatcgccaaggtcgacagaagcaaaaggacctaatccatctgagagcccagagaaggatgaaaaacaagattacaaggcgtccgtcttcaacaggcctttatcaaagtatccccagttagggaagagaagagagatcaatccttcactcctcccacccgaatttccttcgtttcaagaagctccgattcaagctaaaacagagagatgaatctggcctttgagacgcctatacgcttgctgagcacacagtaggatacagaagggaga

SEQ ID NO: 680043 - DNA, 229 bp, Homo sapiens
  misc_feature (23)..(23): n is a, c, g, or t
  misc_feature (33)..(33): n is a, c, g, or t
  misc_feature (46)..(46): n is a, c, g, or t
  misc_feature (62)..(62): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (92)..(92): n is a, c, g, or t
  misc_feature (96)..(96): n is a, c, g, or t
  misc_feature (100)..(100): n is a, c, g, or t
  misc_feature (109)..(109): n is a, c, g, or t
  misc_feature (111)..(111): n is a, c, g, or t
  misc_feature (115)..(115): n is a, c, g, or t
  misc_feature (128)..(128): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (151)..(151): n is a, c, g, or t
  misc_feature (155)..(155): n is a, c, g, or t
  misc_feature (159)..(159): n is a, c, g, or t
  misc_feature (196)..(196): n is a, c, g, or t
tggagaagaaaggggccctaagntctggccccnctttctttggggntccctgtccctggggnacccnggcccngggnggctttgcgggtctnctcncccncggtgagcnanagtntcagccattcaancaggananaanggtgactgggtncccntggngagctgtgtatttcctaggaggtagaaaactgtgggnaactgtggctaataaaaactaagtgtgagcgtc

SEQ ID NO: 680044 - DNA, 263 bp, Homo sapiens
ggcacgaggccaagaacccttaccctaccatggactaacagtttgacatgagggaaacgacttaacttctcaaatatttccttttctggataacatggccaatgacaccagaactggtgggaagacaaaaagaaatatgtgtaaagcatcatgtatagaacctagctcacaaggagtacacaatgaatgctagccctctactttctttctttcctgtggaagatgccctctgagacttcatatatattttttataggagaaaa

SEQ ID NO: 680045 - DNA, 107 bp, Homo sapiens
acaccggctatattagtattgttagtagagacggggttctacacgttggtcaggctgctcacgaactcctgaccatacaggtagatccgcctgcctcagcctaccca

SEQ ID NO: 680046 - DNA, 1157 bp, Homo sapiens
acaaacaggagagacagagccttggagagtctccgaggactttgtctcctactccatcagacagaagggtaccaggatgattcgggatcggatgatccatcggtccacgagccagggctccatcaaaatccccatgtgtacagacgccacagactacactccaaccacgtcccgctcatcccacagcaatttccacagaactgatcaaggaatcaacatttaccgaaagccaaccatctacaaacagaatgctgactatggcagaaccagagcaagtcctcagaacgatatcatacaagtaaatccaagattcccaagcaagaccaaggcaccagaacaccagcgagacaaccaaacgatagagacggaccacatggcctggtacccacccatcatatatgctgtcagtagagacctgcacatgaaaacgacaagatctagtggcaagagaagggcaagatgatgaggacactaactgaggacagtcgagcagaatacaagacaagcagcacaaaaagaagcccaacactcacgggcctgggaccagaggaacctagcacaagaagcagatggagcacaagagaaccgggcaaaggacaaaacagaaacgccagacgcaacgcaactacccatacaaaacagaacaaaatacatccacccacctacaaactgcaacatcgcccctgacaaatgaagcacaaggggagaacaccgggccaggaaaccaccgacaatacgaacacgaacaacaagcaaaggaggcagaccaaagagagagcgcacgcagacaacgaacaaaccagcacggcaaatgacagcagaacaaggaaccaaaaagggaaatgacccagacgagaggacaccaagacaaccccacgcaaagaccccgttgggacgacaaagagacgaaaagaagacaaaagaaagaaggacgacaccaaagcgaggacgaaagcgcagaaaagtgggaacactaagaaagagacgaagacaacagaacacagcagaaagcacgaaaaaatagaaaacaaaggcggtcagaagaaactccgaagcgacaaacaaagaaaagtagacagaagcgacaagaagaaaaaaaaaaagcaacagaacgcaaaacgacgactcatatgacaaacacgaagagaaacaaaaga

SEQ ID NO: 680047 - DNA, 532 bp, Homo sapiens
tgtagagactgggtcttgccatgttgcccaagttggtctcaaactcctgggctcaagcaatcctcctgccttggcctccctaactactgggattacaggtatgagtgaccatgctcagtccttatttctttttcatgaaacaatctgagtctaaaggatccagggcggacatggtgccatcacagtactgaggacctaggtgctttttatcttgctactctgtcatcctcagcatgcagctttaatctcaggatctgaaatggcaggtccagcccataccattgtatttattttccagccagaagaaagaagagaagaaaagaaggaaggcatgctcttttccttttaaagtcatggcccaaaacatcacataaagttctgctcccatcccagtagacagaacctagtcatatgactatcccttaaatgtatagtctttacttctgttatagaaatttctattactatgaaaaaggatggatattgaggagacaattagccatctctgtcacagtaactaaacgtattgtag

SEQ ID NO: 680048 - DNA, 287 bp, Homo sapiens
catctgtccggcattaagcacgccacgggcgaggccgtctactgtgatgacatgcctgccgtggaccgggaactgttcctgaccttcgtaacaagttcaagagctcatgctaagattgtgtaagccatagtttttttcccaatggacagcactggttgcctttttggttaagtcgtacgagtgaaaagtaacagtatgaaagagataagctatttgttggcaaatgtccaacgtagacttgacgtgacacgggacggagacgtcggacttactataggagtttgtcc

SEQ ID NO: 680049 - DNA, 185 bp, Homo sapiens
cactctagaggacccctgaggggtgtgtgatcgacgctgatgtgacgtgtgcatgtgtgtggggtgtgtgagtgcgttgggaagagggggtgactccttgggggttgggaagatgtgtgacctcagtctgggcctggccattggcctaactctgggagacaccggtgctaaccaatggagttagg

SEQ ID NO: 680050 - DNA, 201 bp, Homo sapiens
ttgtttctgtcacgccctggcgcagattctgttgttcatccgtgccgttgatcgtattccagaccactaacagtgtgtcgtgggccgggctggcgttttttgtcgagtccttgccgcgctacctgtcgttcccggtgtgcggggcattgtgcgacaagtatcccgccgtgcgcatcctgcatatcagccaggtttatcggg

SEQ ID NO: 680051 - DNA, 429 bp, Homo sapiens
agaggatcccgcgtccccgcaagacggtgctttgctaaagcggataagttgtagttcaaagtcctggttggacgtgttgcgtgagaaaggtgcaatcattgtagcacagagagtggatcttgttgttcttggtccctgatatcacagggtcacactggcctggacaccatatggctggtgggctttcagaattgtgttatggggggcaggacgctgcatgttcctgtaatctcggtcaattatagttatccagcatgacaagatgtgccaggaagagcccacatcagaggcttctagcggcacagggacggccttaggacgccacgccattcatgacattggtcacatttatcgagtagatcttggcaacgtcattggtgtacttcctgcttgcctcatgataagtgctcctcttcaaggcccaggtga

SEQ ID NO: 680052 - DNA, 343 bp, Homo sapiens
agcaatctccggtataggctcctgagtagctgagactacaggcgccaccaccacacccagctaattttgtatttttagtagagacagggtttggccatgttggccaggcgggtctcaaactcctgacctcaggtgatccacccacctcggcctcccaaagtgctgggattacaggcatgagccactgtgcccagctcttactggcccttttaatccacttggaccctccttcaggtcaacctcatccttctctctaaacacagatctgaatgcctcttttcttgtaaaccctttcgtagctctccttcacttcccaggaaggtcctgttgcagtgtgcttccg

SEQ ID NO: 680053 - DNA, 166 bp, Homo sapiens
ctccttgaggtagcccaacatgcgaacggactgatcttgtccccgagctgccctgttggctcatgcccttgtgctgttggcttgtgcccttgcatggtgcttggccacttggcccttcttggagcagacactttgtgccccccatccacagccctcgaatctcagc

SEQ ID NO: 680054 - DNA, 409 bp, Homo sapiens
agtgctcatgtagggcttcatgctataaatggctttgcatttccgcatatgaacgaagtctcttcaccacagagctactgcagatcatagccgtatggtcaggctggctgtgtcaatctgctagttcagggtcagtgcaaagtacatccgctacacgtcaatcacacatacacagatggtgatgattccgatatacaggcacttggaatgcaaccacagtcttgctttcgcatagcatccctccgctattcgatctgaggggcaagatgctggtgggccgctggtccaatcactcgtgccatttataccacaactctgcagaaatgactggatggagtcccacactgccttggtgctattgtctgagtggtaacggtgcatgctgtcggtcagacccttaccctcatac

SEQ ID NO: 680055 - DNA, 987 bp, Homo sapiens
  misc_feature (119)..(119): n is a, c, g, or t
gagctgctggaggggaatcgaggcgcggctccgtgggactttcggctcgggccgctggctctgctctgctggggagggagcgggcccggccgcggtggccctgagcccgtcctgtgatncttgtcccgctcgcctgctggtcaccgccgccctctgtgagactccgtctgtgcttgctctagagggttcagcggtggcctgtggacccgcgggtccggggctgcctattgctgggcatcgcctgcgttgcttggtcggtgcattgcggaccgcatgggccctgtgtgccctgtgtggcagtcgtccccgtgtgggtctttcggcgcgcatgaggctcttgcgtcaagaccgcttcaacctcgggggctggaagggaagcccgtgcccgtgtgcccatggtccccagggccccaagagcctggtaggaactcttgaggccttgcccggccatgctgccgggcctacaccaggcacacagccggtgcctgagcggcccctgtagcaccccaacagttttcgagcgtttgacagaggccccctgtgaatggctgggggaattcagcctgaacgagagtgcccccctgtggtgggcccctgcaggttgaaaacagcgtcagcccctgtgcgcgggcatggaccatttgcggaggaatgtcctgtctgagacgagtacttcatgggaccagtaagcgcaggctccgtttggcaagatcaagttatgcccccctgttggctcaaagtggcgacataggatgcctacaaaacactaggatggcccggcttccgagggagtaatcccctccggtgtcttgccatcgtccaatggccatatcggggggacggctatcagggggcgcgacatttccatgtggcaccaagatcagtgcacttgcgcttgtggtagttgcggtgcctggtgcagtctctttgataggccgtcccttcaaggaacctgatccgaacatttggcccgcgaccagccttgta

SEQ ID NO: 680056 - DNA, 1086 bp, Homo sapiens
tggacggcatgcacgtgactataagcacgagttacgaccatggctgtcaaattcgctggtttcgcctgaaagattctcaaggggtgcactagctccgtgggacccgtgtcgccgagctcttcaagcgtctaccagcagtgtgtcagaacgcaataaaggacaaatagattccctcattgaaaggactgggatgtactatggtggcacactggcgaaaaagaattcaggtcgctggaatagagttcttctatacgcttgacagctcgaccttgagaggagtttcggcacggtgtctcatgcaaccttgaggtgctcttgggatcttatgtcctgagcgtaactgctgctgaacaatagccatcatgtatttgcatgcaggcacatcttaggtccagagagcacttcgagtttgcctccttccgactggttcttcctctcactgtgttacacagcagttggacagcataccttgtgaatgactcgaatgtctcggcagcctgtttgttggtacatcttgcaatgagcaagtcggtgttgctatcaaatctgcaccattgcatctggaggattccttggtgtgcataagtgacttggggcctggcatgtcagcttcactctaactgtattctctggtatagcgaccttcatggttccctacttcacgatgaagtagaagttgcctgcgctcttgatattttgctacgaatgaactttttgcgtgtgcatgaagtcaagtaatgaatgaggacagcaatggggcttaggagctttctttccctctcagtgtaatcgtatctgctgctggaacaaaggcatctggggcccccccaaagttatccagttcaggatgctatttgagcacaacgtcgagtttatcctgtagtaactaggcgggtaaaattggagggtgccggactaagcaagaggaagaacggtttaccacagtcctggcgtacaagaagtgttgcgttaaatgttaactgaactgttcctgtacccataaacccatgtgtacgaataactttgaagcgagaaccaatgagatgtgcacctcgagtagcaataagaagaataatgaggacaaca

SEQ ID NO: 680057 - DNA, 747 bp, Homo sapiens
gcgaggaggaggagtggggagcagtgacgaacccacagaacgcaacccggcagcagacagctggagtgggatgactccaccctcagctactgacccgtgcccccgtgccacctcggtttctgctttcgaagactctgctgcacatcgcgttctcccagtcccaagggatccacgatgtacaaagatcattatcaggacagataggttgtgcagacccactccaccgcacacgatcagatcgcatgtgacttggtagtgtaggaccctaggcacaacaagaagcaaaaactcgtggacatgaggtcgacagcatccatcaaaatcacacaccgaagagaagactgaaccacgatcactcctacgtggaacccgcacagtcgcaggaatacgcagacaaggagagaccgtaacaaaggagaacaaaaagcggcacaagaagattatgaaggaatggaaggtagaaccagcccaagagaggaaaaaacggaacaaaacagaaacacccatagcaaaacaccacaacacaagagaagacccaacgcaccaggcgcagggaaacctccaaaaagagaaaacaacaaggagccaaaaacagcaaaaggacaaccaaaacaaaacccgaaggaaacaaaaaaaaaaaaacacgacacaaaccaacaaaacaaaaaacacgaaaccacaaaaacaagaaccaacacgcacaagacccaaacataaaactacacggaaaaggcatacaaaggcagc

SEQ ID NO: 680058 - DNA, 569 bp, Homo sapiens
caccagcaacactgcaccttcactgaatgcccttgtagaaagcgttgtgaggatacagagctgatacagacctcgcttccgggtgcaggcgatggattggaagctgagttacgtgtgatacagtctatggtcatagctcttgttctcagtgatgcctcctgatctatctatatgctctggaagatagctactgggatgacgatgagcagaatggtcactaggatgcccagaatctgggctcatatttttatgcacttggcgttgtagtcatagtcctgggccccggtcacgtcgccatccatcttcttgtctctatacttcactgagtaggcgaatgctatgaagcccagtctgtagggtttcatgtagagggttttgaacagggaccagacgacatggtcgggcactgaggtctcgctgcggatgtggatctacggtggacgtcgggggtgcagggttgtgtggcgcccccacacagccacctcgtgccctccttgagcatctcatagttggggggctggccactgttgacaggagagttgaatgtttggtcagttgtgattcttggt

SEQ ID NO: 680059 - DNA, 662 bp, Homo sapiens
cactgttgttctatgtcttccgtgccgattcttttaatactccgattcgactccatctaccataccgtaacgatgcgtatccagctcagaccgtatgtaatattgcaatgtgagatgggcatctatgaagtccacctctcgcagaggcccccaagaaaacgttaatcttgtctcagagggtagatagaacatatatgggtcgtaacgagaagatataatcatttttgcagtgttgtgttaaatagtaaagcacaacattgcatgacaacgctaactgttattgcatattttacagtaacccagtgtgctacatcttgaagtggcgactcgagatgtcgagatggtatgcagtttgtcgcatttgtgcgctgacgatactggtagtcattcaatgatcaagaccacgcgacacgagtacaattatccccttgggcaaacgtggagcaataagtgttacttgtgcagtgcagcagaggtcttcctttatgagaggagatgtataggatataacacctatgcacagtggtcattacacgcattactatgttgattctaaggtccatatttatgaattgacgcatttaaattatgtaacaatggtgtctaaatagtcatattactcctgtaacaataatacggggaatgcggacccaattccctga

SEQ ID NO: 680060 - DNA, 384 bp, Homo sapiens
gcatgagagtgcacacggcattccgggtgtatctgtgtgtgtgctgggttagctgtgtgtgctgggtgtgatctgtgtgtggtgggtgtgatctgtgcgtgtgctggctgtgatctgtgtttgttgaggtgtgaacttgtgtgtgctgggtgttatctgtgtgtgtgctgggtgtgctctgtgtgtgctaactgtgagctgtgtgtgtgctgggtgtgatctgtgtgtgctgactgtgatctgtgcatgtgctgggtgtgatctgtgggtgtgctgggtgtgatctgtgtgtgatctctgcatgtgctgcgtgtgatctgtgtgtgtgctgagtgtgagctgtgtgtgctgagtgtgatctgtgtgtggtgggtgtgatctgtg

SEQ ID NO: 680061 - DNA, 221 bp, Homo sapiens
ggaaggtttttttaaacggaggcggaatttatgaatccaaattaatttccaccaggttggaatcagatttaatgtgagttcatgataaccaagcccccagaggaggtatgtttttttttttgttggcccacagtttttttttaatgttttgtgaaaaattattttaagggttttaaaaaagggggcttttatggtttttaaaaattgtaaatggtttccca

SEQ ID NO: 680062 - DNA, 149 bp, Homo sapiens
tagtggagctgtctctggaatgttggggcaacacagctacgcctgaggctacaattgctagcacacgtggactgtccatccccatagcgtgggccgcctgcctgacccttcagtctgttgccgaaactcactcacatacccaggcctgg

SEQ ID NO: 680063 - DNA, 377 bp, Homo sapiens
agtgcgacggaaacgcgggcgttttcgcgccagctaagcacctgtcagagagggggttttttgggtgacttgtatgctcccaaaaactctggagggacagcaaacggtggaccggtgagcaaattcgcagactactgtcggaatttggtgtctgatattcccaatcttgcaaaccataagatgccaccagctgctgctgaagagactcctccgtacggtaattataacacacttccctgtaggaaatctcactgtctctctgaaggtgccaccaacccacaaattagccatagcaacagcatgcaaggcagaagagctaaaacaactcaggatgttaatgcaggcgaggtcagtgaggttgcagacagtgggattga

SEQ ID NO: 680064 - DNA, 745 bp, Homo sapiens
ctactctgcgcgctctgcccgcgcgccgcgcctcagcctcggcctgcgctgcgcgcgcggccgtgctgccatggctgccgtccggaagcccgcgagcctcgagccgctgcgacggtgacgccagcccgccgttcccccgcgacgatggggcctgcgacggaaagcgcagacgtcgagggaatggctgctaggagggccccgagagactgccgaagaagggcaaaagcaccgggtgtgcccgaagcgaaaaccccgaaggagtttttaaccaacttccgtgaagcggccctataaaaaaccccgcgtttccccaaaaattgcccttctggaaacgggcgcccaaggttgccacagcttgacacagaacaacatgaacacatggacgcgaccccagaagatttaacaccaaaaggcaaatctgtgcgcaccgtaatttttacaacgcggaaaacctccctcaatcaaatggattttggcacagaagagaaaacaattcatcaatccagcaaactcgagattccaaaagggagtcatatgtctaagtgggccgggctggacttttggagcaccagattgaaaccgtgcccaaaatggaggacaccagaaagcagatcaaatgaatggaaaagaacacgatgtcgctaacgaaccggtaattattaaagagaaactcccaaagaaccctttcggaccgacctggggtttcaatcccaagagacccttaataacatttaaaaaagaatag

SEQ ID NO: 680065 - DNA, 1189 bp, Homo sapiens
  misc_feature (472)..(472): n is a, c, g, or t
  misc_feature (531)..(531): n is a, c, g, or t
  misc_feature (779)..(779): n is a, c, g, or t
ggctatctatgagctcgtagtaagattacacatgcaagcattcgccgttccagtagagttgcaccctgctaagatcgacgcgagcgatcaacaagggacgatagctagtcaagcagcgcagcgaatgcgacgctcgaaatagcgcttatggcctgatgccgaggacccgcgcacgggcaatagcgagcatgtgatttaaggcttgtagcagatataaccgacaatgtttaaagcatagaggctacgatactgagacctccgagggatgtggtgcgaagttgtacgtagtccaagcacacgccgaaggtcgagcatcgattgatactccaagatcacatacgaaggccgggcagtaaacgagttgtctgtgagaatcgactccgccttgcacccgagagtatatatgctcaaacacgtgcacgcgtggaggtctgtgagaaagaagcgtcctaagtatgaccagccgaaacantacgacgtgacgaacaacgctaggccttgtagagcgatcaattcctggaaagcgagcgnacaagagtcaggcctcatagaaccgcgaatgacctagggaaagtttagcactgacccgccgacggtagtggcgtctaagccccccgtaagagccgtgcagacaaggttgagaagtcaaagcgagaaagccatgctcgaccaagaataccagagtaccgagacccacttagcatgtcaagacactgtcaacagcatgcaccctggcgccaggatgcgtgtcaatatacactccgttcttaaagcagagnaagccttgggttgctagctagatccgcataacaactccggccgaatcgaaacctttcgaaacaacgcatctttgcgtctagaccgtaatattacactgcgcattgcttctagcacaaccactggatcgcaagaggctaccaaaaggtgaaagccgcaaaggatacctcgacagtaagaagaacgttcagaggtcaagagggtgtaagcaccgatagacaggtggacacagcaacatgggtgcttacgatgtttcctaagcacgcagagaaaaacgtacagatgagacccgtctatgcaagaacgttacagaggtcagaaagagtgagactatgaggcgaagaaaaaccttgagcaagttaggaggtggctataaggattcgaagcaatggacccctggaacgccgcgtaa

SEQ ID NO: 680066 - DNA, 184 bp, Homo sapiens
ccacctcgctcgacgggcacacactccgaccgagagccacctgtataagatactgacacgcagatgtacggaagaggagatagtgtagagcgagtagacgagacagacagacacagtagatcccagtctacgcacaccaggatctgcagcacctacctactagtgtgtgtgcacgactcctagt

SEQ ID NO: 680067 - DNA, 331 bp, Homo sapiens
taattatgtattcttagtgtagacagggttttgccatgttggccaggctgttctcaaactcctgacctcaggagatctgccttccttggcctcccaaagtattgggattacgggcatgagccactgcgcccggcctctatttagatttctttagttcttacttaatattcttgtattagtctgttttcatgctgctaataaagatagacttgagaccgggcaatctataaaggaaagaggttgaattgactcacagttccatagggctggggaggcctcaggaaacttacaattgttgcggaaggggaagttaacacatccttcttcatat

SEQ ID NO: 680068 - DNA, 215 bp, Homo sapiens
atctttggggtagtccagtacgtctggggcattcggataggccgagacagtgttgtgggacgaaagttagatttactgccgatgaatatgatagtgacaatggatcttgtgcgtaggtttggtctagggtgtagcctgagaataggggacatccgtgaatgaagcctcctatgatgtgccaatacagctcctattgcataggacatagtggaagt

SEQ ID NO: 680069 - DNA, 371 bp, Homo sapiens
cccccctttgtgggggacctttttttttttccaaaaaaaaaaaaaaaaatttctttcccccctaaaaaggaaaattttccccctggacctttttttccccggggggcaaaaaggccctttgttttttttgggggggggaaaaattggggcccaaaacccggggttgccccctttcccccctaaatctggggttggcatttttttcaaaatggggggggggtaaccctttttcccaaataaaatgttttctggcccaaattccccggggacccctttttttaacaattaaaaaccccccttaaatttttttggcccaaccccccctttgggttttttttaacccaaaaaaattttttttttgggcccccaca

SEQ ID NO: 680070 - DNA, 118 bp, Homo sapiens
caccagctgctggcatccattctacctcgtctctatgaatttgactataatagttacctcgttataagtggaatcatacttgtcatttgacatctaggtatagtttcacattgtggcg

SEQ ID NO: 680071 - DNA, 209 bp, Homo sapiens
tccctgtgctgctcaggtctggacaagcagactaatagacatctacagaactctccaccccaaatcaacagaatatacattcttttcaacaccacattgcacttactctaaaattgaccacataattggaagtaaaacactcctcagcaaaagaatggaagtcataacaatctctcagaccgagcaacaggagacctgagcaagccagt

SEQ ID NO: 680072 - DNA, 963 bp, Homo sapiens
ttcgcttttattgtgacgtattaaagagtggaggactcatggtagttcctgttcatctacaggcaatatggaggcatcatccagtgatgaagcctgtgggtccgcccgtgtgagctctgaacgatggaagctgcactagttggtttgtgagactgataagtgacctcgatcgaagagcacatggagactggcgatactccctgttgcgatgtacttcagaatgtctatctaggtggtagatcctttggatatttgaggataggttggacgccgcattagacacgcttcccgagagatatgctcgcctcataacgtgctcatactatgggcattgcgtcgcggacgttgcccatgggacatcctcgactcttgccgctgatacttccgctgtaagcagacttgtatcgatgctagcatgaaaacctaaggggatatgcgccatagtctcgatgcccttacgaagctagggctataggtacgcctttggcctaagtatgcgcacctttcacgtggacgtcgcaccttggtccataggagccaagcccgatcatgtcacgacgcccttggcaatcaatcgaggagcaagaactacgtcggctgacgcagaggtgcccatctaaacccaccaaactatacggataactctcacttactgtgccagccgcgcgatagcactctgtatggagtccttctccagcccaaggttacgctccagaagccgtagtatacgttttcgccagaacgcaccagcttcatgaatttgccgcacctgcagtaataggccctccaattggttcgttattcgcctgcacagggcatctagagctcgccttaacttggaatcagggcccctgcgtggcggccttggtgctgggaagtgggcttctgatattaccccgttgcgccagagcgtagtctaggcactttaggcactcggggctgacgcgctggtggacggccttt

SEQ ID NO: 680073 - DNA, 428 bp, Homo sapiens
ctagaggagctgacagcatcctaacagctccatccctgtcccaggcatcgtgtcccagcaacttctctttggctctgggtggacttctcgagcgtgtgctgtgttactttccacttaccagataatatggtaaatccagctattagctgtggcgagaaagtttgaagactgtgttaaggtgtgacagcctcctccagacctgattgatactcagtgactgggagctggcgtctccgtgcacccacaaatgtgtctgaagccagccctcctctcctcccttagactctcacagtgaagcagcaggaccacccaggtacagcgcacctcgagctctgcccctcaaagggagtggcctctcctggctattggcaaagctaccagaaacttggcttcagaccattcacatctaaacaggtggtccagatatt

SEQ ID NO: 680074 - DNA, 424 bp, Homo sapiens
catattgtataatcagaatgaatcttcagtggtcatttctgaaaaacaaatactaactttagttaaaaagttaaacttttacttctctttttcaaagtattttcaaaacttcactattcaaattaaataggatattttaataatttacttcaaagatattatataattctgatcccaagagatcttcttgtggtgtttataaataaatctactaacagaaaagagttagaaaagcccatctaggaaagaaaatcgttgaattaagtgagagtcaaaagggctatttaaacctattggggtttttccttcccatcaattttttttacgttggcttttgggaacagagaaaatttgaggccgctcgccctggactccaatttctttttttaaaacctctttgggggggaaaaagtaccagggaact

SEQ ID NO: 680075 - DNA, 299 bp, Homo sapiens
gcggcctatccgtatcttcctcccaccaacattctactcttccttcccacacctctatttaaggatcctctactctctatatccattattccaattattttgatttatacatcccacaaataactcaaaacatttcatatttctctttctatacctattgtacttcacttcacaaaatgatctccacttccatcccttttattccaaattacaggatctcattctttttataactttatagtacttcttactttatatataccgcatctcttttatccattaatcttttactaaacact

SEQ ID NO: 680076 - DNA, 551 bp, Homo sapiens
cttgaatcgtgcagacgataccggctgttgcgagccacaggtagccgatcatgagcagggtgccaatgtaagcggcctggccgccgcgtctcaggccgccacgggcaacgtcatggcggcataaccacaccgccagtccgatgagtaccacaccgagtactcgccatccgatcgccgggctgaccaccgagacgagtagggctgctaccaccgccaggcacaaagctgacaaggcgcgattacgcgccatcgtcagtcgtgacagctccagcctctccccgcagatcgtcaggatcatgtagcaggccagccatccgacgatctgggagacgtgtgccccggttgtcaggagggcagcggccccggcggcgcataaggctccagcgccctggatgacgacggcgtcgtcgtgactgcgccgtcatagggggacgtatatggtcagcagccccaattgggcaagagtgagcagagcaagcccggcccgggcggagtcgaaaggcataggcgccagcaggacgatgacgccaaacccggacatggccgggacg

SEQ ID NO: 680077 - DNA, 155 bp, Homo sapiens
cacgaggccgcatatgcttttttttatattgagatatatttgatataacatacactttaccatcttatagtgtacatgtcagtgcattccagtacattcacagagttgtgccatcatcatcagcgtctaattccagaatgttttcatcactccca

SEQ ID NO: 680078 - DNA, 510 bp, Homo sapiens
taactggattccaagtccccaggagggcttaattttttcttttacaaaatccggtctgggggtatcctgggctctatttggcccggtatgccgaagacgaccggggcgttgggcagcgggccatagcggagaactagccgaaggtcttgtgaaattcttctcttcctcaggtgatgactcgagctttctccttcttatagaacgttccggaaggggcatgtgcaccggctccggctcagacgtgtggtgtggccagttttcagttctctttcagcaagaaactgggtcttccctttcttgtggggggccgaaggggctttccgtgggcgaaagaaggattagagttggggaagcgtgaacatccttttagagacgcggagtgaacacgtttggggccgtgggagaggggaacctcgcgggggacacgtgtgggaccccgcacctccttgcggaatcccacagagaaaaagtgccgaagtggactcgcggggccaacctatatcgtggggg

SEQ ID NO: 680079 - DNA, 234 bp, Homo sapiens
gccagcgtctcgtaggtgtcagccagctgcggcaggatcagtctctccccctcccgaagcacctttactatcccggtagaacaccttcacacaagacaggctgctgttcgatgacggtctgattgttttccagggctggcgccaagcccttgcccatggggaatccctggcgggccacctttgtatgctgggctggtctaggccatgccagggcagctgcccatgtcgttggcc

SEQ ID NO: 680080 - DNA, 277 bp, Homo sapiens
gctaaaatggctgaggagagagtcgcgacggttagcgccgagattctctttagttgcccggccgcaggcaaagggcaagctggcgggtggcttttgtcccatgcagcggttcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagcactt

SEQ ID NO: 680081 - DNA, 479 bp, Homo sapiens
atcatttgatatggtacgaagtagagtaagagtaaatatgccatggaagacataatctagtttgtcctccatctctcatatttccccacattctacacagaccacacatgtacatcagtcaaccagtcctttatattccacatttttaaatatgcgtgctcagacagtcaccaattacagttctttctccattaacatatggtggcagtgaatgctaacaggtatcaatttctttgatcaggaacaaagaactccttcaggaaactcactttcctggtccttgtgatcctatcatgtaaattctttaaattggtacacctgtttactaattataattgattgctatttatgccaaggagagcatttcccaggcatgcctcatctatttgctaacaacaaagtatgcttactttatttacatagtgccacgggtttctcttttttcttctcttttttattggcgggtcttcgggtcgttt

SEQ ID NO: 680082 - DNA, 1527 bp, Homo sapiens
  misc_feature (1326)..(1326): n is a, c, g, or t
tatccagcccacccaacgcgcccaccaagggtgttaaactcagttttttaactctctcccagggggcaaacacagggggggcacgagggggggccgaggagggggggccccgaggggccacatagaggggaagatagggccctcacctccacaagacagccggggacggggggaaaagagagggtgtctcggggcacaaacacacgagccccaaacctttggccccattatcaaataagagggggtgtcagaggcacgacggggggggtgtggcgcccgcgggaggacgaatcatcctcgcgcggggggcgcgcgcgtggagagcgacacgaggggatacccaaaagagagagcttctccgcgcgcgagagccacacgaagacactcacccacgcgatgtgacagcgggagcgcccaagagacgattcacgcgcgggaccacattctcacacgagagtggaaaagagcgaccaaagagagagcccgcgaggaacaccgcgcgagcccctctctctatctctgatgcgagagaacacaagagagggagagaagaagagaggaagtgacacgcacactcatgtggggggagagaggcacacagagagacctgggaccaagagaggcatacaaccaccacccgcacacccatcccacacgagagacacaagagagccacagagggagaggtgacacaaaagacaccagagcaccacacaaacaaatatggggatatccaccccacgcgacgggacaaccacccagatgggggcccacaatgacacacaagaaaaagagaaaggatagggggagcaacacaagaagggagaggcacaaacggagggagcaggagaaaacaatacgaggagaccagcaggagagcacagacacgaaggagagagatcacccaccacaaagcagaggagaacatcaaggcgctaccatacacgaagaaagaaagaaacaacaagagagagagagagaaacaaggaggacaaggaggcgaaaaaagcacacagccagtcacgaccacccggagccgcaagagagaggcaagacaaaagagggtgagaccgcacgctaacaaaaaaacaaaccaaagaaggcgacacagacgatagaaacatcaagatgcagaggaagagagaagcccacacaacaacagaagcaagacggagagacagcacgcgaaactagactgcttaaaaggacacgaaggagttagacgagcgcaaacgcgactccatacataaaagatagtactaagacacaagtcacgcagaaaagctaacaagatggtagagccacacaaccgaataaaagccagtnacaaacagccgaatctgtaaggagccgtacgtcactacaagccgaaaagcaagcgtagataggagagggacacacaactagaaaatacaacagaggagaaagtaaagaagaagcaccgaagaagggccagtgagagtcgaacacacggagggcacgctcccttttcctgtataggacaaaaataagcggagaaccaacagg

SEQ ID NO: 680083 - DNA, 189 bp, Homo sapiens
gtcatgtcaaatgctccccccacaggccacaggccacctgcctgactgcgctttgaagtactgcctccccacaaactccttctccaggaactgtcacacaggaaacccaggtgtcttcacccagcctctgcttagcaagaaatcacagaatcacagaaaactaggactatcccatattctctccctgct

SEQ ID NO: 680084 - DNA, 389 bp, Homo sapiens
  misc_feature (318)..(318): n is a, c, g, or t
  misc_feature (382)..(382): n is a, c, g, or t
tttgaagacagggtctggctctgttgcccaggcaggagtacagtggcattatctcagctcactgcaaccactgcctcccaggctcaagtgatctgccctcctcagcctcctaagtagctgagaccacagggacacaccattacacctggctaattgttgtattttagtagagatgggatctttctatgttgcctaggctggcctcaagtgatcctcctgccttggcctcccaaagtgctgtgattacaggtgtgaaccaccatgcccagccagagatgctaaattcctgggtgagtgcagctgaggggctagggcctncttcttaccaagcccctacccatttagatggcaggctctacctcaagttacagcaggccacaantattggt

SEQ ID NO: 680085 - DNA, 465 bp, Homo sapiens
aaattgggatgatgaccataagctggaagaagagtttgctccattatagatttatatatggaggactgagtatcactctatgtagcccaggctggagtgcaatggcacgagatcggctcactgcaaactgcgcctcccgggttcaagcgattctcccgcctcagcctcccaagtagctgggattacaggcacatgacaccacgccctgttaattttgtatttttagtacagacggggtttctccatgtaggtcaggctggtctcgaactcctgacctcaggtgatctacccagctcagcctcccaaagtgctgggattacaggcatgagctaccgtgcctggccaaatctgcttgatttaaagagaaaattagggcctttagtttaattagatcccatttgtcaatttcgtctttggtagccattgcttttggtgtcttggacatgaagtccttgcccatgccta

SEQ ID NO: 680086 - DNA, 1436 bp, Homo sapiens
tgagtatgcgctcgtaagacgtgtggtggtctcgatatttattgtgactgcgctgtgggtgtgtttcagtgtgtttgtttgtgtgttgggcgtgccgcatcgtgctcttgggtgtgttgttctcggtatgggggggtttctgtgtacagggtgctcatagtatcttggttgggggcccccgtatgtgtcacgcccgcacacagtggtggtggttcgtacacccggagtggtggtgagatgtggctggcgtttgtgggctcggcgtgtcctctgtgcggtgagcgcgtttccctattggtcggtgttgcggggctggttgggggccgtccccctgcacttgttcctggtagcagccctcgtgagggccccgtgtgggagacgtccctttttccgtggtcatacacgggagttatcttgcacgagcgttggggcctacttccttccgccgctaagggggccgcccctgcgcgttccccctgtgatagggtgagggtttcctggtctagacgcgctcctggcataaatatttgggggataatgcctttcctcttaggaggcatttttttcccacagattcgaagctccgcccctggggctgccttgggctcaccccgagtttagaaaagtccagttgaggtggtggacaaaagaaggttgcggaaaattgaaggtcttttttctgggcccctgaagggccacggttctggccaccctgggaaaagggttagccccacaagtggggctctgagaaccacgtcgttaaagggataagatacctccggggagaagcacctttgggagcctccactatatatgcccctcgagtgctctcattggagggagcccctgcactgggggcccctcggtttatagacgacttgcgcgtcatagacacgtctgaaaatagttcttatcaaaggggaggcacattatgaggatccctgttgtaaaataacaccggacctcgaggttgcccacggcttattctctggtgagttgccgcgctttcccacgagaccacggcttatggattctcctgaggagaaggcccccggagtcttccgggccctcggaatgatggcacggattcctggaggcacatgtttagtagaaggcttaatttgtgggtgcccactaacgcgcaccctggtgggtggaagtggtacaaagaaagactttgcactttcacacacttacactgtatagtgtggcacatttcttgttagaagatgagaaaaggagttgagagaaggataaactgggatcctggtaaaaaagcctttattgccacgcccgagcaccctgctgtgaattggggtgcacatgagctaatggatgtcacgatagttcgttgggagggggaggacacagaagtctattgtttggactgtgtttgtctcaccatcaccgccccatctaaagtgtagtaaaatgca

SEQ ID NO: 680087 - DNA, 520 bp, Homo sapiens
tcttctccccgacacaagaaagtaccatctctgcagacttaagactaaaaatggatggattttatcttgcagcaaaatggtggggaaaggaagtttggcaaggtcttcctggcagaattcaagaaaaccaatcaattttgcgcaataaaggccttaaagaaagatgtggtcttgatggacgatgatgttgagtgcacgatggtagagaagagagttctttccttggcctgggagcatccgtttctgacgcacatgttttgtacataccagaccaaggaaaacctcttttttgtgatggagtacctcaacggaggggacttattgtaccacatccaaagctgccacaagttcgagctttccagagcgacgttttatgctgctgaaatcattcttggtctgcagttccttcattccaaaggaatagtctacagggagctgaagctagattacatcctgttagacaaagatggacatatcaagatcgcggatgtcggaatgtgcaaggagaacatgtcagggg

SEQ ID NO: 680088 - DNA, 882 bp, Homo sapiens
  misc_feature (1)..(1): n is a, c, g, or t
ncctgtgtggcgaaaaaaatattgtgctgtgggggccaaaaacaacaaatggggcaggggggtgcagcccccccccaccggttggcgcgtaaaaacaatggggccgcgtatattggacaagacggcggtctcgcagacattgtcgtgccaaaggttttgtgaaggccccctactaaagctggcggccatatgcggcccacaggctgactacacgccggtctttaaaaaaggagtttgttcaaaccaccgctcttgtaagccatgatgctcagactctacttgtgttcacataaactaacccccccgtcccacatcagcggttataataaagccaaaagatacccaccttgcccaaaaatatcttcgtgcaacccccccccattcttcccagccaagttcttctccacacacagaccttgccacaacccttgcgtttcttcaccaaaaggcctatcccataaatatcgtcttgttacgctcgcaccatatcccccagtttattactctatttgtgttacaaccacaccccccgccgcacgctcttgtggtctgctttatactacaccccaaggcgtttttggcgttgcatctgttcaccctcacacacttgctccccatcatatatagcctactatatgatgaaacacaacagtgctcttcattcccccccccggaaggtaaagcttctcctcccccaaagactgaactacgccccgctcttggtaaatacggctattctgtagacactagatcctgtttcgacgcaccacaattttccaggctgtcagtctccccggcccaacattactactttagcctcctgtgagaagagcacccaaagaaaaaaatcgacccacatacaaaaatcaccgaacatataaa

SEQ ID NO: 680089 - DNA, 166 bp, Homo sapiens
ccttccctgctcagttttaattttcccagttttaatttttagccttttttggttaccaaaataaccccgctcccggccgttcatttgaaaatatttccagttaacgtgtgtgaagtgggttttttgaaatgtaatttccaagcaataaaatgctcctgtttttgca

SEQ ID NO: 680090 - DNA, 106 bp, Homo sapiens
taattaggagcgtgctgagcacgtcgagaaacacaacttcagagtgtaacgggtatggaccatttggcgtttttcatcttggctatatggttccatggaagcccac

SEQ ID NO: 680091 - DNA, 144 bp, Homo sapiens
ttggtgctgctctaatgacatacttgaggctaggtaatttataacaatagaaattatttctagcagttgttaggctgggagtccaagatcaagccacctgcagatttgatgtttgttgaggaccggtctctgcttccaagatgt

SEQ ID NO: 680092 - DNA, 228 bp, Homo sapiens
  misc_feature (213)..(213): n is a, c, g, or t
gccggactggtgaacaacgaactttaatagcggctgcacatcgggatgtctgatccaacatcgaggtcgtaaaccctatggttgatatggactctagaataggattgcgcgttatccctagggtaacttgtcccgtgggtcaagttatgggatcaattgagtatagtagttcgcttagactggtgaagtcttagcatgtactgctcggaggtngggttctgctccgag

SEQ ID NO: 680093 - DNA, 172 bp, Homo sapiens
ggagagtatgttccccagcggtggaggtgggactaacaggagggttggagtcatgggggcagatcccttaagaaggacttggtgccgtcctggggagatgagtgagtgtcttgttctgttggtttctgtgagcatctggcacctcccctcgctcctcctttccctcgtgccg

SEQ ID NO: 680094 - DNA, 555 bp, Homo sapiens
ctgtgagtgaactatccatgccctatcatccatgtacacacggaccaggaacatcccgaccacccgaccacacggcccaggaacatcccgaacataccttgctgggcaaaggcccagctgaaggaacatcctgatcatattctgccgggaacaaggacccaactgcctcatcatgggaacatctctcaacatcttcccaggcagaagccctactgcccaaacccctcccgtccaggcctgtaagtaccccagactgtaagcggcggtgggctctggcattaagctggtcccccctctgtaggttactgcaccatacctctgttgctgtagagacgccctctctctctgtctttctttaaccctcgccttccctttaaaaaacctaacaccaggctcaagccatcctcctatctcagcctcctgagtagcttggactacagccccatgccattatccatggctatatagagcatttaatgtagagatggggtacaccacgttggccaggctggtcttgaactgtagcctcataaccacccgctcacctccaaggtg

SEQ ID NO: 680095 - DNA, 193 bp, Homo sapiens
  misc_feature (25)..(25): n is a, c, g, or t
  misc_feature (44)..(44): n is a, c, g, or t
  misc_feature (60)..(60): n is a, c, g, or t
aggattgcttgagctcaggagtttnagaccagcctgggtaatanagggagacctcatctntacttaaaaaaaaaaaaaaaaattgggtaggcctggtggcgtgtgcctgtagtctcagcctgggagatcaaggctgcaaagctgcagtgacctatgattttgccactgcactccaacatgagacccagtctca

SEQ ID NO: 680096 - DNA, 126 bp, Homo sapiens
ccccccccccccccccccctttggggggcccggggacgttaaattttacccaaaaagggggggggcgccccccccccagggggggtccagccccccccccggggccccagggtttttcccggggga

SEQ ID NO: 680097 - DNA, 835 bp, Homo sapiens
tggaaactttaaaaccccccaaaaactgttttattatacaagtgagtttggagtcccgagtgggctatatcggaaggattcctggtagcgagcgcgggcaccagggcctccaaacttttgggtgactcgcggcgacgaaggtggtcacgtctaccagcggggcccctggtcatactgggatagagggatcgtctatgagatctccttctgggaacgcctcatccacatatttctgggtaatgaggccacccaggggcttggagaagatagagactggacgggatacgaattaaacttcctgggcgcccacggtgaccaccgaccctttatacacgaggaccacgggtttgtcttaccacgcagcaaattcgctctcctttgccggaaaaacgccaagatctgtgcctccaagcacgcctttgatccttggtacgctgtgcggcgtgcctcaatcaactcctcctaggggggccctgaccgcgttgtacacctctgtggatggcagaacctatggtgaccggtcgttttgtgcgagtggtcgcccccactagtgtggtcgcggctgtctctcatctgaggcgtcgcgaagaagacctgtgccaggacgtgcagctggcgcccctgtggacccgagctgtgtggtcccgcagtctggtgggtactaggacgacctcaacgcgcgcgagggttcatctccctcggtacccctgaatccagaaatcttgtgggggccctgcacccatccggtctattttactctccccttcggggccagggaccccccgggaagcacttgttgacgccctggggttgtcacttgtttgaacaacgggtc

SEQ ID NO: 680098 - DNA, 286 bp, Homo sapiens
gctctagaggaccccggggagctgagcagtacctcgggaggtgtcttgaggctcaggtagcttatcacgcttatactatgttgttgagttggatggaggtggctggtggcccatcctgttttttaaatgtttcagctgctgaggtagggccagtagggcaatcctgaagaatgacgatgctccgctgccgccattctgacccagttgctcagagcccttcttgctgaaggggggattttgcactttgtggtagtcctctgcccgccgccgtcagctcttgcgcacg

SEQ ID NO: 680099 - DNA, 125 bp, Homo sapiens
  misc_feature (70)..(70): n is a, c, g, or t
  misc_feature (109)..(109): n is a, c, g, or t
ttaggtttccccgaaggcacactgaaacatctctgtctcattcctaagatgtcaaacgctggtaagggtntcctcgcgttgcgtcagaattaaacccacatgctccacncgcttgtcgcgggtcc

SEQ ID NO: 680100 - DNA, 450 bp, Homo sapiens
gtatcccccgttctccccgtggggtcgggatgtaagggttattgtattagtccattctcactctgctaataaagacatacctgagactgggtaatttgtaaagaaaaagaggtttaatggactcacagatccacgtgactggggaggcctcatgattatagcagaaggtgtaggaggagcaaagtcacatcttacatggcagcaggcaagagagcttgtgcaggggagctcccctttataaaaccattagatcaggcagggcacagtggctcacacctctaatcacagcactttgggaagccggggcgggtggatcgcctgagatcaggagtttgagactagcctggccaacgtgttgaggacccgtctctaactaaaaatacaaaaattagccgcggcgtgactggctcatgccctgttgtaccagatactcgggagactgacgcacga

SEQ ID NO: 680101 - DNA, 307 bp, Homo sapiens
tttttttttctaaagacagggtattgctctggagtgctgtgcttagatcatagctttctgtagcctccaactcctgggctcaagtgatccttctgcctcagcctcccaagtgagctaggaatacaggcatgcagtaccacatccagctagtttttaaattttttgtagagacagggtcctgctatgttgcccaggctggtctcaaactcctggcatcaagcaaccctcatgcctccacctccaaaggtgctgagattacaggagtgagccatcatgcctggtccaggttaaatactttctgtcggac

SEQ ID NO: 680102 - DNA, 383 bp, Homo sapiens
tccgtagttacaccgtcgctagcggttttcggtcgatgcgaccggaatcctttgacaaccgtagtcccacggttgacagactgcacgcggcctcctcattctgcacccgctgcaaaagacagtgggcattgctaaatttctccgcaatgttccccaataacagggtttgatttttacgttgcttgcacctgaggcattcacttcgattgcgccgacggtgatgtttggaggctgaggaaatgtcgaaagcgcccaaccctgttgacaaatatgtcggcagccgcgtgcgcatgcgccgcatcatgttgggcatgagccaggaaaagctcggtgaagctttgggcctgactttccagcagatccagaagtacgagaagggcacg

SEQ ID NO: 680103 - DNA, 136 bp, Homo sapiens
  misc_feature (80)..(80): n is a, c, g, or t
  misc_feature (83)..(83): n is a, c, g, or t
  misc_feature (86)..(87): n is a, c, g, or t
gagcggagtatagttgggcgccagctccaacaccagattgccccgcgcatcacacagtcgctttcgggaggtacagaatncgnccnnaggttgacgtgggaattctctgggctagagtttgactgtaacaggatat

SEQ ID NO: 680104 - DNA, 858 bp, Homo sapiens
  misc_feature (1)..(1): n is a, c, g, or t
  misc_feature (75)..(77): n is a, c, g, or t
  misc_feature (80)..(82): n is a, c, g, or t
  misc_feature (209)..(209): n is a, c, g, or t
  misc_feature (211)..(211): n is a, c, g, or t
  misc_feature (253)..(253): n is a, c, g, or t
  misc_feature (257)..(257): n is a, c, g, or t
  misc_feature (261)..(262): n is a, c, g, or t
  misc_feature (265)..(265): n is a, c, g, or t
  misc_feature (268)..(268): n is a, c, g, or t
  misc_feature (271)..(271): n is a, c, g, or t
  misc_feature (274)..(274): n is a, c, g, or t
  misc_feature (316)..(316): n is a, c, g, or t
  misc_feature (333)..(334): n is a, c, g, or t
  misc_feature (344)..(349): n is a, c, g, or t
  misc_feature (351)..(351): n is a, c, g, or t
  misc_feature (353)..(354): n is a, c, g, or t
  misc_feature (361)..(361): n is a, c, g, or t
  misc_feature (363)..(363): n is a, c, g, or t
  misc_feature (365)..(366): n is a, c, g, or t
  misc_feature (369)..(369): n is a, c, g, or t
  misc_feature (389)..(389): n is a, c, g, or t
  misc_feature (393)..(393): n is a, c, g, or t
  misc_feature (435)..(435): n is a, c, g, or t
  misc_feature (438)..(438): n is a, c, g, or t
  misc_feature (440)..(440): n is a, c, g, or t
  misc_feature (464)..(464): n is a, c, g, or t
  misc_feature (480)..(480): n is a, c, g, or t
  misc_feature (635)..(635): n is a, c, g, or t
  misc_feature (711)..(711): n is a, c, g, or t
ntttattaacttgccaaggccctgaggtacatcactcccttaatacttcagttttatgttatttatttttttctnnnttnnnttttttgtgtgacggagtctcactctgttgcccagactggaacgcagggcggcgatctcggctcactgcactccagcaggcaaaacagagcaagaccctgtctcaaaaaaaaaaaaaaaaaaaacgngngagaataggtcatagaataaaaacatttcagctcaaattttntttngttnnttnctnttnttnttcttttttgtagcatcggggtcttgctatgtcactctagcnggcctcaaactcctggnngggggggggnnnnnngngnnggtttgngngnnggngggattacagacatcaccangccnggccacaacccaaacttgaaaaagaaaatctaagtggccttngangngtttgcaagtcagctgaccaatgnggtacctccttaaggngggcctctggggcgccggtgaaaaaggcttatataaaaggctcatgaccagctctgccagtgatgaacatgtgtcaagtcgttctgctgtccccaactcccggacccaggtggctctgaattagcttcagctaataaagaacaaagacggggggnagaaaggctccccaaacttgtgcaaatccagtgagaaaacactttgcacatcatctgtctcagctgttctgcaggngaggcacactcagaactgcaccaccccaggcaagcagtttgccaggactcgggggcctcagggtttcatctcggggcctccgcctgcaccagcgagtgggcctggctcagggcgagcctgtccttcttctccttctgcaaaacctgc

SEQ ID NO: 680105 - DNA, 817 bp, Homo sapiens
  misc_feature (482)..(482): n is a, c, g, or t
  misc_feature (550)..(550): n is a, c, g, or t
  misc_feature (600)..(600): n is a, c, g, or t
gccgggacctggcggccaggagactgcatgctgaatgacgaacatgtccgctgtgtgtggtcggatctctcgtgcgctctccatgaagcatctacgatggggactactaccgctcgaggggacgtatcggccaagatgccagtcaagtggattgcgcgatgcgaagagtctagctgtacgcggtgtcctacatctatcaacgaagcagactcgtaggtggtcacttccgcgtggttgcacgaatcgttggagatgatttgtcagcagtgagtggccataaccccaatatcgcgtggccgtcgagacgaacagctgaagcatcttattgacttatctcgctgcccacgggacaatcagcctgagaacagactagcggtgacttggtctcggaattggacctgtatcttgcctatgagtcgctctcgctagggtagctattgcgtgagcgctaacagatcctctccatgagaacctggaccaancgatttctataacactaagcgtttgcgaggcgataagagattctatgcgatgagatcatcaacgtganacgagctcgattgtcgcgtcgcttagcccacacgtgaaggccttcgactngaaacactctccgtctaattgtcaactagtgggatcgatcgcggttgggaagggtgtaatccttcggaaactcgggttgcgaatctctcgcacggatgtgccgcattgacctctctcactggacctcgaggtctatggacccttcatcgaatttagcttgttaggataggcctacgacattgttattcggtagactcgtccaatacgttgcctggga

SEQ ID NO: 680106 - DNA, 920 bp, Homo sapiens
  misc_feature (367)..(367): n is a, c, g, or t
ccagacgttgggagagtgctcgtaatcgccaagaatcggagccattctgaccaatggcgttatcaccgcgttctggtgcagaaccgtggcagctaacaccctgaacatcactacgaatttccatacgcacggctgagcactggtatacctggcagtcggtatggttcggtacgtgaccacaaattccgggcgaatgccggcatgttcaataatgtactgccagcacagaccgtcgcagtctctcttcctgcaccgtaccggtaaccagcagggtatattcatctctccagaccgaggctctttaatgattttaccggcaataaaccatagaggccatgccacctatcctggtcggaagtaccgcgancaagcaagtcagttcagtcagtctacccatgccttcgtacggatcgaagtcccagatcctgatgttcgccaatgccgacggtatcgatatgacgcgtacattgcccaccagacgcgggccgtggccgatataaccgagaacgtctgcccatcggcatcgctttcaactttatcccaagccgactcatcaaccatctcttctactctcatcccatgtcactcacgcgtttcctcgtcgccagccactccactgccgcaataccccaccatgacggcacaaggcaagccggacaccatcaatccgcctggcataacctcacagctccacgtacaaaccagccacgaatggcatatccctaccaacatcccctccacacaacagcacaccccgcctctgccggcgacagcccacaggggcaacagcgcacacggcgtcgcccccccaaacacgggagacaccagcaggcgcccccccggcgccccaccacgccacaggtcaccctccccccgctcgcccagggacacccgtcggaacccacgaggcacaccgcaaa

SEQ ID NO: 680107 - DNA, 194 bp, Homo sapiens
ggatttgctggtgcagtacaactaggcttaatagggaaagttagatgggtgtggtggcgcgcgcctgtaatcccagctactcgggaggctgaggcaggagaatcgcttgaacctgcgaggcggaggtggcagtgggcggaggtctcgccattgcactccagcctggacaacaagaaccatgctccgcctcaaaa

SEQ ID NO: 680108 - DNA, 1057 bp, Homo sapiens
tgggcactaacaaaacatgcttatttgataaaaatgtgagtggtaaagggggtgacaacaaggggggcagggcaaaagggtgcagtgttggcaggtgggacgcgggggtctacatagctgggaccgggcccgggggggtgcgacgtctcatcagagcacggatggaaccacgaggtcaaaattcccgaaggtgggcagtccttggtaaaacaagatcattggttttcccaggtgtagacaaagaggagccccagagacctgatgtagagatcggggggcagctgtccagtgacatctagggaagcccagcccccagcatgaagcaggaactctgggggacagtctagccttgtggcaaatgccagcacaagcaagcagcctccgaataagtcccatagcttgatgggcttctaaaaatgggcatgtcaagatccagaatctcaaaggcatcccctcttgggctccatcatccaggggtcgacaaacacagcaagaagcctaagtgaacagtctagattcacacaccttggctaacagtttgcaattgattttacaatatcctcagttcaagaagaaaacatagcgggaggcagaactccaagggtaacgaacctatcccagaagttgtggggcactgccactttcgggaatggcttctagcgccagtggagccccaattctcttccaggtcaacacgtaaatctgaggaaaggtcaccagaagggcccccgaaaaaaagtgcaggggccaaactgtagagtaagcgggccatggtacagctgctggggccctgtggaaaccccccccgagagggccagtgtacacacagagaaatcctcaaacccaagaaagcaaaagggcctgaagcgcgaccagacccaaagataaagggaaagcccccacatccacgagaaggggcctacaacacacaaggggtcaacaaaatcacggaataaagatatgtgcggcacacgacacagggagtaaatcggtcaaccccgtgcagacaagacaacaccaagagtgtgacgacaagggacagaaaaccctacctaac

SEQ ID NO: 680109 - DNA, 1269 bp, Homo sapiens
gtgggcggacgcgtgggctgtgacgcgctgggcagctccggaggctgcgcgctgcagaagctaccgcctgcgcgagtaactagcaaacatgctacgtcctgtgcgcgtatgctagcgcgcccgtggtcctgcgcccttcctcgcgcgaggccggactaggtactaccaccacaatgcttctggcgttccatacttatcacttgcctcgccaaggcacacttccactggccatcgtacaccacctcactccttcacaacagcacctggcgcacctgcctgagcatgctccatcctactccgtctgcacacgcagaccgtaattccttgcgcacgcctgcatacctactagcttcagatcctatcgcaacacgaacactatggggacgtagtacttcacagtcatttgcgtcagcatacgcgtaatatagcccgctgccgcttaccataggggacttcgacggcgaactcgtttccgaactgcaaagcacacgacacacttgcgtcacgaaccggtctatctcttacccgagcagaccatctccacacacgggcgctcaattgcctccccctttgccgacaactatcgcgccacaccccgtggccaccaacagccgctactcgcgctcagcatcccgctcaccgcatcaatctttaccgtagcacaccacttggcacttgccacacccccaacagctcctacacgcggcacaacccgcacgacaccctacctacgcattggcacaaccgcaaggccgcaaccacggagcaacccccccaacactctgaccctgcgcaccccgggaaatgtaccccacagacatcctggactcgacgacggcaagacactgcctcacagcgcgacacggcatggctaccgactcatcggcactatgccgccccaatatggggaccacaacattggccgctaacatatccgagtcggcggcacaaacggcgcggatcccccaacaacttgcggcgactttctcccacaacgcaaaccggacgagcataagccgagcccgcaacagtactggcggattccgttggcaaaaaacggtcgcccgccccgaggcacaacttcaactgtcccccttcccgccagccactatcctccacagcatcgacccggcgggagcacaaaccccgacaacttgggcgccaccggaacgctagggaccacaattcacaacaagaggaccctcgacagccgaacacatacgccactctcggaagtgttgcccacagcattcgaggcaccgcagtaca

SEQ ID NO: 680110 - DNA, 358 bp, Homo sapiens
gctgcggggctccgtcagctccgggagcgcactggcgccgcggcgctcgacgctccgctttcccaccgcccgcagctgaagccatcccgcagcccggcgcgacctccgatcgccgcagttgccctctggcgccatgtccagaacggagcgccgggatgcaggaggagagcctcagggtcctgggtagaactgccctcacgaataatgggaacgggggcagcgttcagcctcggtttctatttataatggagacatggaaaaaatactgctggacgcacagcatgagtctggacggagtagctccaagagctctcactgtgacagccgagctggctcgcagacactgtaagatacgaac

SEQ ID NO: 680111 - DNA, 252 bp, Homo sapiens
tctagagatccctaaatgctgtctcatgtatagtaacaaacaatgtaagggatatggtttggggaaaacttttaaaaatggcttatctctataatacagagttataatataaaacatggtttaaaagggtatatttttcaagcatggtaggtagctacactggaattctggttgaaaaaacttttctatttaagcttataggatggaaatatataattaaagtcttctgatccatagcttgagacagcatat

SEQ ID NO: 680112 - DNA, 719 bp, Homo sapiens
ttgtcctcccgagcgcggtacccgctgtgccccaggcctcgcgctgcccggccggagtcctcgggtcccactccctgggcgctggccctctccgcgagtcccggtgcctcgctcccgcgcgcgcctcttctcggcagtcggcgcgcgagagatggcgccctctcgccaggtcctcgccagtagggctgctgctttgccgaggatgaacggagactttagcgcggtagacgtgcaggaagaatgtgtctggtagaaaactaacgaagctggccgttagactagctataggatggaatcacataatccgtcgaatgccagtgtactatcagctaggtagcgacacaaaatgactgtcgatcttcgcttccaagcctggtctgcccaaaatgttcttggtggatgcaaggacagcacacatcgcacaatggctacgaaacacgttgggcgcaagaagcagccacaaaccttgaaggggccctccagagacaatagattgggcttatgatgcatcctgcactggcgatgcagagccgggctctttaaggccaagcagtgtcaacggcacctccatgtgctggatgtgtgaacactgctggggtcagaagaacagacaaggacactgacaataacctgctctgagcgagtgagaacctactggatcatcatgtgaactaaaacacagaagcaagagaaaaacgcttatgatagtaaaagttgcg

SEQ ID NO: 680113 - DNA, 787 bp, Homo sapiens
agcagcacgtgtctggctgtgccccagctgctgaatgacaccaaaagccctcctcatcgtctctgagctgctggacatcgtaggtgggggcaaatagacttgggggcagctaagaatgtgtggagacctggttctgttcctcagttctgtcccatgccattccagaggctctggtgatcctcccagagtctctgtgtagccacctgcgcaacaggagtgcaccacactccaggataacggggcggcaggctcctgtgccctggtccccctgggttcacacaggagtgccaggaggtagcctgctctagcagttcagggaagatcggtctctgcagagtgtggagagagttcctgcccatccatacagctgtttttcaaaagccacctccccaagaaaggtttgggggctcctactggaagcagagccatgaagaatcggtttctggtgctgggcctggtggctgtggttctggtatttgtcatcatcggctctgtatctggttgccctacacctctgggaagcccgacacgtgtacctccagggcggggtggcacgacgccaagcgctgctcagagatggcacgggatatcctacaggaaggtggttccgtggtggatgcaagccatcgcaagcctgctgtgtatggggctcatgaatgccaccagtatgggcatcggggcggcttgttcttcaccattacagcaagcactacaggaacggtgaggttatccatgcccgtgagttacctccaggtggcataccacttgtcacaactccagacctgag

SEQ ID NO: 680114 - DNA, 317 bp, Homo sapiens
cactagtcatctggatagatgcggacggcacgtgacttcactgagcgtagatgatggacaaggacctctcccactgtgagaccagaacctatgagttcacactgcagagcttaagcccacctctgagcctgggccagtgggctcctgggggggccctgccttgaagggggccactgtggcacaggaaaccttccttttgccataactgcatttggactggcccgtggccttgggccaagcaatccccccgggattcaggggccccttgtgggtacttggcgtgtaaacccaattttggtgtaccccaatttgcccca

SEQ ID NO: 680115 - DNA, 149 bp, Homo sapiens
ccgccgccctggcagtacttatatttttgtaaacatgcctgcctacttacttcatctttccctgccccacaccataggccctttgacgccaggcactgtagctgtctaccactctatcctcaccccacacaatagtgccgcatccaaag

SEQ ID NO: 680116 - DNA, 187 bp, Homo sapiens
gtatgcagaagaacgtggaagtgacatgactggctgagtcttctggtcttcatctttctcctgtgctggatgcttcctgccttcaaacatctggactccaatgtttttcatgctatttggactcttgtgacttaatgtgattttgccatgtgtactctgtgccttatgtgccacatgacttgaagac

SEQ ID NO: 680117 - DNA, 236 bp, Homo sapiens
ttggctgggttacagctgattttatatcattttatacgaatcatgaagttacaagacgacagaaacccacagcatgtaatgtatactttggtttggctagcaaggctggcacatctcgaatgctgtgtgtgtccaggatgtgaaggacggggtgacttctatgtcctaggtttattcctgttttaacagattgacaatcggttcaaagaattaagctttgcctgaagtgtcaacgt

SEQ ID NO: 680118 - DNA, 774 bp, Homo sapiens
cttggaggctgagatgtggttctgcgcgtgtgcggacggctgtctgttaactccgcggtcagttcccggactggtggctggtctgcagggttgacctgcgcaatgcagagtgctgcaggtagtgctgggccacctgaggggtccggccgattccggctggatgcctgcatggcctgcgccttgcctgagctgtgtgcccctgcatggcctcgtgccgctggactgtggttggtggttgcacgtggcggctgcactggccatcttgcctgtggcgggcctgcggctgtgcttcaatggacaccacccccgacgagcttctctctgtggcagtcatgaccgcaggttctcaaggcacgtgaatctgagagccggaacagctgggggacatctgtgtcgtgacatcccggagactgtgcctttgtccactgtcaatagacagtgtacgtacggggctacaaggcagatggccagcatagacagggttggagtccatgtccctggctagacagagggaaccctggaaatattaccttcgcgcttgatggagaaggagaacggccagagatttgcctgattcctatgggggataacctctgagaatgtgggatgagaaggtatggacatttacacgggagaagcaaggatacattagccctggtatccaagagaagtgagtgctgataggggaggaatgtaaaaagggactgaagagtgagagaaagaggttatataagataggtatgaaaataggacaataacaaggttactgatggg

SEQ ID NO: 680119 - DNA, 181 bp, Homo sapiens
  misc_feature (37)..(37): n is a, c, g, or t
ggttaaaacttggaaatcacagagcacaaatgtgggnctgccttaccggaagtccatctgaagccgtaactagggtcacaaacaactttcgttacctatgtagtaaatatacgggacggacccttcaaaattcttacgttatcttttcttcaaaaactggtaagagtcgtggtcccaaaaa

SEQ ID NO: 680120 - DNA, 952 bp, Homo sapiens
ggaggcattgaggcagacagcgcaggggcttctgctgaggtgggcatgcggagcattgaggaaatcctgcagtataagcttttttgtctctttgtaaagatagactatttaatacggaactacttaaaataatatacgctcaataggttactaagatattgcttagcgttaagatttattaacagtcagattttatatagctataagattgtaagaagaaaatatgtaagagttagaagagtagccatgagcgagaggaataagcatgagataagtgtttcttaaaacaattgacggagcgttgagaatgatagcttcttcatggagttaataaaatgtcatttgaaaagaaaatcgggagaaaaggacttagaggagcccctgaattgaattacccaatgaagaagggcaatgcttatgtagattaaaatgtaaggtgacttaaactagggttaaagtattagtttacacaagttgtaggtgatttcaaataactttgaacgcgcgatcttttaaaaaaagagattatatcgatggtgattttcaagaccttgagatccatgatgcaggcagatttgcgtcatttaagatgcctatttatcgcatttacataaatggcagacgaaaatggcacatgattaatagtgaagtggttgtgatgaacaccatttggggaagattgatagtttgaagtgccaaaagtgggtagaagcagtacgggaaggcgaagaaagagcattgatgaaagaataggagattgaagattagagtcttgtgaggatacgggttagttttacctgaagttgcataggataaaggataggagaactgacgttagggagatgttaactggaaaaagtggcagtagaggataaaattacatgtgggcctgtgcatagaagaaaaagtgtgcgcaaaaataacgtgtagaaataattggtttaaaatgtca

SEQ ID NO: 680121 - DNA, 826 bp, Homo sapiens
gatccgcttccggttcccagactgaatggtcagtgagcggagtctgaggtcgctgtggactgcccactgattgtgaacacaaatgaggtcctctttcatagagtacctgacaggtggctgtggatccagaagatgtatagctaaggcttgtgccgtgagatggacagccggatccttatgatgactacccggtgttttctgtgcctgcctatgagaatcctccagcatgtattcctcctcatgagaggggtacaccagccgggattacaaacaatgagttgacccagtttctggcccgaaaccatcacactgaagaagcctcctgagctcagttgggattaaccatcggaggaggaaaggcctcccagtaggcatcttcatctccaaggtgatgcctgatctgatgcacatagagcaggactgcagaaggggccccaagttctagctgtgacatgactgtgcattccacgatatgtgagcacagcaaggttgtggagatctctggcagacagttcgtgaaactcagcatttgcgtgtggggctttttgccctaacaaattatcattcgccaaaaagagaggcctggtgccattaagaaagtggacgcccaacagcctttcatgttggattctggtcattgacttgctaactagacttcatggggcgccacttctgtttcacggcctccctggaatagtggtggacgatgggacacagtaacaatgttaccaacatttggtttagtcctagtctcagtggctcatcctaaggggaggtgcactaggtacaacgttgggctgtgaacaccgattggattggaacctaa

SEQ ID NO: 680122 - DNA, 409 bp, Homo sapiens
ctctaatgaacagtgacagtgtattaatgatgtgcgtagccagcattggctggcatattcttgctcgtatgtctgtgtaggctgaccctctatatgttcacacacgaacctgtatagatacacgtacaaactatatatccttacaaccatagatttgtatgacatgaccacaatacagatgatcgttctgactgcaacactgatttaactactacagatcttgagatatcgctaatactgctactcatgttctttaccgacaatgagcatccctgatcatgtactgcatcgctgccatgtgactcaagtctgctctactcaggataattccttagtgcatggcactatgcctaatgtgattccgtagactcagactcatgaatgcttatgagcatctacgtcatgcctc

SEQ ID NO: 680123 - DNA, 324 bp, Homo sapiens
gtaccgcttacccttactgggtgcatgtacagagaaaaggcagttagcatgatccaagggtggagtttttgagcctctggcctcaaaaggtgaagcagaggacatgaaaagcctcactgcgcatcctctgtagactggccagaaccactccgtggttggtggtctcctattaggaaggaatgctggttggtggttgtgaggaaaccacaagagggaggggcaatgtcaggaggttggtttatattagcagtggagcaagtaaaaaggctggtttctgtttaacccttaggaaagaagcctaatgctgggcagtaaggggtaagg

SEQ ID NO: 680124 - DNA, 251 bp, Homo sapiens
ccttcggcgcgagcacttacattctctgaaagaaaaaaaatatttttttaagtgtcataagcatttaattaggattctaacttcaaaataaaatgctctttgttttccaagaattgaatcttagtaaagttcacccattctgacatttaattcaaaatgttacactttacacacagtcggcatccaagaaaacaatgatcatactactgacaatcccttttcaaaagtcaagttaacaaaggaggcagaga

SEQ ID NO: 680125 - DNA, 776 bp, Homo sapiens
ctaataaatgtcaaccaacattgacattgtaattgggtgattacaataaaaggtgagcagttggtgtttattaataattagctttgcaggtaatgaaatagcagggaagtaacatgctgctttaggactaaaaaaaaaaaaaaaaaaaaaggaatggaaggtttaataccttaatggacccagaagacctagatttataaaggccatataggaataaaaattggtaatttcctgggttttcttccccagaattatattttaatggactccataaattactttccaaattattcaggagattctgaagaacagggattcttaacaagttggtttaaaacttaacatttctttggggtggtgataacactttaattttataaacgtggcgagaacaggcttctctaaaggggcttatatgatatttttttaaacaggacaaggtagtgtatcaagggtgggtacaggtttctttaaaataccgggttttttgggaggaccaaagatttcccccttacgaggggaaataaatatttcacggccggtttttaacccattctttaaatttttaactgggggcttatagagacatatatgtgatggggcggggcgtatctctcaatgggggaaaatacccgtgggataaatccagtgtgttctaaaaagtaaaaaagggggggttaggagatccattagggggagagaaaagcttttttttcccgtgttaactggaagtggagaaggtaaaatttgggaaaatgtctttacactttttaagc

SEQ ID NO: 680126 - DNA, 465 bp, Homo sapiens
ccgcggccatgcagacaggcatgtcttcatatatatattacttaaattaatatatttacataatttttttttttggagacagagtctggctctgtcgcccaagctggagtgcagtggcacgatctcggctcactacaacctccgcctcctgggttcaagcgattctcctgcctcagcctcctgagtagctgggattacaggcacccgacatcatgcctggctaattttggtatttcggtatagatgggaggttcaccatgttggccagcccggttcttgaactcctgatctcaagtgatacgcctgccttggcctcccagagtgctgagattataggggtgagccaccacgcctggctattaacatattttgaaactagagccctttaccatattacacttttcaggtatggaatctcctaatgtatgcacccctgccagtctagatcgtaagggggatcctcta

SEQ ID NO: 680127 - DNA, 434 bp, Homo sapiens
acaccgccgaatgtcatacgtgtctaagcagatgcttaggcatgatcagaatgaagaggagacttgaggtgttgctagctgaagcacatccttgcaatgtgggagtgcacaggagtccacctaaaaaaataatccttgtatactggggcctgtttttaaagtcaccccgtaacaagggcacacatccaggactgtgtcttgcctttcagatcttaacagagcagcagggcttaacttgttgagtatggggattcggcgtgtgcatgcacacgccgagacaccaaacaagtcacgatggacgaagttgttgcaaatctcagtggacgaagttgttgctgcacacgccgaaggcccagaccgccgcaggtctgaatggacgaagttgttgcgcaacaacttcgtccatccagacttgcggcggtatgggccctcgg

SEQ ID NO: 680128 - DNA, 182 bp, Homo sapiens
cttcccaggctgcagtgatctcccacctcagcttctgagtagctgggatataggcatgcacgccacgcccggctaattttgtctttgtttttttagacagagtttctctcttgtagcctaggctggagcacaatggtgcaatcttagctccctgcaagctccgcctcccaggttcaagtgat

SEQ ID NO: 680129 - DNA, 513 bp, Homo sapiens
ggtcagcatgcgttgaaaaataacaacaaaagtgtaaaacgtgtgctcgcatttcgagggccaaagagctacagtaatctatgcccccagagggcacggaagcttttttaaaaattgagtgtaaaatctataacgcatggagtgcatgggcttaaagtatatgaggttacggtaaatgtgcaattccatgtgaccaccaccccagtgaagacacatttctatcacgccaaaaaagttcccttccaattcttaacaatcattccctccatcccaccctgacaaccaatgtgtggattttgacaagagagattagtatggcttctccttgcagtttgtgtcacgggaacataaagtatgtcaactgttgtgtctggcttctgtgggctcaacatattttcttaaagattcagccacgttattgtgtgcgacgtagatcattctgttttgatcgctcagaagtagtccgaattgtctgaatatgccatagtctgtttagccattctcctctagatg

SEQ ID NO: 680130 - DNA, 220 bp, Homo sapiens
ccccccccctttaagggggggggtttttggggggcccccccccccccgggcccccccccccccccttttttttagggggggcccccccccgggggggagggggggggggcccggctttttttttttccccccccggggggggggggggggttttttttttttttttccccccccccccttgggggcccccccctttttcccctttttttgggggggggga

SEQ ID NO: 680131 - DNA, 298 bp, Homo sapiens
ggactgaccggaggcttcgccctatatgagccctcgcccatgatgatggggctgacggagaagcacagggccttcacccacttcctgacaggcgtgcgcaccatcattgggagcatgtacacagagactgcactcatcgatacactcatctaccactcagcacgagccatacagagaaaaatcgatctaggcaggacatcgtagccaccctcggagctacctctgactactgtatctccctggcctgcagctgtaccgcagcctatgccaccctccaccttctaggacagccacagcc

SEQ ID NO: 680132 - DNA, 142 bp, Homo sapiens
gaacgacacttatccccacctgggctatcatcagcccgatgaggcaaccagccagaacgcctgaacgcaggcgcatacttcctatgctacaccctgagtaggctcccttcccctactcatcgcacggatttacagtcagaag

SEQ ID NO: 680133 - DNA, 862 bp, Homo sapiens
cctgcctgaattttcctggactcgtttttcccggatttaaagggaattttccccggatattttacggaactttttgccggattttcaagattggctcccttctgtaatcacatatggtaataggagttttagtctccaactggtgctcattagaagttatcctgaataagctgtttatcacaggcatagattaaaatttttgtttcaaagaacatctccatacccttaggggtgtattgtttcccacctattaagtcagggtggataaattagttattataacttaacatagtatagtcccacattcgttgatccccataccggccaaccacctggtcaaccctttgaagtagaagaaatgaaaattacttgaccagatttaaagttaaaccatttaaatgttttactgaaagtttatatagtatagtctaagtagattaaaagtaccccttgtcttttctgtgaattatgactattccatttgttaaaaatacctaagagccaattatagtgggacaatctaaggtcctcctgtaaaccagtgaattacgccaacctccagcctatgtgtttctaccccgatttttttcttttcatgggtatctgaagcctctaagattttttccaaaaatgggagtatccaccaaattggagtgaaaccaccaataacttaatgtattgtactagattgcccaattcactaaaatgttaatggaagctttttgatgtgagttataatggcactattctggtcacttatcctattttgattttatttaattttttaaagttgaagaattaaatattttaatggttctaatcttttgcattccatgttgcattaaacctgtttatatgagta

SEQ ID NO: 680134 - DNA, 473 bp, Homo sapiens
tttcatggtagatccagctccagctctgtggccctgtggttggagaccgctgctcaagtgcatttgaaaggaaccatcccacgccattcttcagagtcatctttactgctgcagtggtcaacttgtagcacccctaagcttgcaggacatatgcttcaactggcatttcacaatcaacagtatgtggcagcttgagtcattgtgagctcacttcctgtagtcccagctactgggaaggctggcatggtaggattgcttgagcctgggagtttgaggctataatgagccatgataggaccactgaactctatcctgagtgacagggcaaggtcctgtttctgaataacatgttgcccagtcagtttctcttcttggattcagaagtctttcatggtaggtccagctggactatgggtgctgagtgggatttacttgtccatccattttctatattccagcactgggaaactagg

SEQ ID NO: 680135 - DNA, 150 bp, Homo sapiens
cacgccgtaaagtctacatgacagggtctttcttatcaagccaagtacgggcaaaaagaagtgagttcatgctatgtgtccataaacagacgaggacaacggtgatctctaatccatatacaatatagagagagattttcagaaatgagc

SEQ ID NO: 680136 - DNA, 226 bp, Homo sapiens
gtgtgagcaccgtactggccaaaattacataagttatatattgtgttagtcttttgtgttgctatgaagaaatacctgaggctagatgtttaaagaaaagaagtttatttggctcacagttctgcaggctgtacagatagtatagggctgacatttgcttctggggagtcctcaggaagcttatcatggcggaaggccaaaggaagccagtctgtcacatggcaag

SEQ ID NO: 680137 - DNA, 117 bp, Homo sapiens
atggcggcatacacaagaaggtggccaggaccatcggcatattctagtggatacgaggaggcggaacaagtacacggagctcctgcaggccaactgtgcagcggcctgaacggagta

SEQ ID NO: 680138 - DNA, 181 bp, Homo sapiens
cttacaggtgttgtgggtagggcgattgggtagtcagccagctcagactggagtctctaggacacagtgtcaggctggcagctggcctggaatgggggggcctgggaagctgagagcactagccttagtgcctcgtgccagccgtggccctctgctggaggtcctggcctgttcagcaggg

SEQ ID NO: 680139 - DNA, 940 bp, Homo sapiens
agcggggcttccggtgctaggtggagggaaggaaggagggagccggggagtgggccagtgacagcagccgggctgaagtcggcttggggagccagagggagcggagcggaacctgctggggcagaggcaggcggactgcagctggctgcagctgatagcaggaacaggatcaagtcttccataccagtggaccagtgccaaaacgagactgccagtgcacctacattgtggccccactgtccccagacatgcagctgctgtgatcatggcgcaatatctttggaagacttctcaagagcctgattgggaagaaggagatgcgcatgctgatggtgggcctggatgccgatggaaaagagcaccatcctatacaagctgaaactggagggagaatcgataacaagatacgactaacatatgaggtacaaatgatggagaacagatggagtactaagaaacatcagacttaacagtgtgggatgtggagtggcaggaaaacgattcgaacgacatctggagaccagctagtacacaggaacacaccaaaggcgttgagtattagatcggtcgaccacgcaacagaatcgggggacggcgacggtacacaatgacgagcaccggagacagaagccgggcatgcagacaatgcatcagcggcagggaccgaagcctccgggggatgcagtgtaacgaccctagcgcctaagcaagagaaaaaaaggggaattctagacgtacaagtgcgaatgaccgagcaggcatgaagagtccacgcgaacacagaattggagccaatgggaagttacccacaacaggacacacgagacagcattgggtaagctcacaggggccaagcaatgtggcacacaacggagtggcacgagagcatgtcaagaagcgcaatgagagaggaaggagcacaaaaacagacaagcacacc

SEQ ID NO: 680140 - DNA, 223 bp, Homo sapiens
tgcctcgaccggcttgcagtattcacttggtcgatgggttgtacccgtgcgagaataatgctgtatgctttgtttctgttgcgtgtgggttcgtacctggggtttgtggggttttcttctaagccttctcctatttatgggggtttcagtattgcattgttcagcaggtgtggtgcggatggacacgccgcgggttcaacgccagcttgggtaccggagctcg

SEQ ID NO: 680141 - DNA, 348 bp, Homo sapiens
gcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagcaccatgtccagccagccaagtatttggttttaaacatttgtatttccttgtacagggattgtattcctctgtacagaccttgaagcacctctgagaaatgaggtcttgtgtagcgcaacctactgcatatattgtccta

SEQ ID NO: 680142 - DNA, 208 bp, Homo sapiens
caacggtgttacatgatcaaaccgtgtacagcttcttgtgtgacctgtggattaccaacatttacccaatacctaaatctcttttaaaaaagccattttaaatatagccaagcagtgtcttcttgcacaacaaagtgaagaaagttctacagagaaatagaagttttacatttgtacaatctttttcacattctaatcctctagctta

SEQ ID NO: 680143 - DNA, 256 bp, Homo sapiens
aaagaagagaaagagtcggaagacaaacctgaatttgaagatgttggttctgatgaggagaggaaaagaaggatggtacaagaggaggaggaggagattagggaaagtacatcgatcagaggagctcacaaacaagccatctggaccagaatccgacgttatactatgaggagtacgagatcttatagagctaccatgactgggagatcactggcattagcattttcagttgaggacagtggattcagagccttct

SEQ ID NO: 680144 - DNA, 335 bp, Homo sapiens
  misc_feature (6)..(6): n is a, c, g, or t
gtttgntacgccaaaaattttggccccacgggtattgggtttggagcccttccccaccaagtggaaaagaaagaatgaagaggtgcgccgtttttcagattttttgcgagcctaaaacccttgccaagtaatcctgcacagatggatccctttccccaaaaagcctctcctttgtagtggtacattatgtgtttctcctcaaaagtgatcaggtctttactgaatgttaaaagagccctttggaagaaaattatgtaaagtttaatctataccaaatgctttattatttataaggcttggaatgggagaggcaataaataaatgttttcgggcta

SEQ ID NO: 680145 - DNA, 129 bp, Homo sapiens
gtgcacttatgctgtagtgactctttaggatccccgagtctgggtctgcattgaacagaaagaacaaaacaaggaggagaagacaagctaaaaatgattcggagaatatcggcataatggttgagacat

SEQ ID NO: 680146 - DNA, 1089 bp, Homo sapiens
cgcccaaaggctggaggccacgtccggggtgtgtgccttctcccgcccggtgccctcggctctcaccttcgtggcctccggggaagcgtccccgctaggggtggggtcttgtggactccctgtgtggcttcctggagctgacccgtggggggtctgctgccctcagttcctgctgaccgaaagtcctgcctggatctggcgcctactgatggaccgtggccgggtgtgatgctcagaccggtgggctcggtttcaaccttgcggcattgggaggcctgaaggggtcccctgtggacccgtctgctgagtggacccgggtgtaagtctaacagccagttacctgccatgttgcctcttgggagctcggaacttgctgatgcccacggtgctgctgagctgcctgttgcggcaagaattggaaacagtgggccctggatcatcaggattagaggtttcatcaagggtgcggacacatgtggcagggcttatgccaccagtatgagttgtaagcatgtcaatggactatagacggcgtgtgatgggagtgtacgctaggggctactaggagggctgggtggagggcttggatacaggaagcagtatttcaaagcaagagacacggatcaagggcaagggggcgcagtgagccgccgtgacgcttactgaacagggcgaggacaggggacccagattgaggagctccagggcagcacctagcgtcgtaccgtctacccaagaacgaaggcgcactatgtcccaactccgtcatgcgaacgttgagggcgtcccgctcacgtttgggagcacctcagacgggacccagcacgccggcagcaaagctgggcagtggaccacaccctttcgccccaagtcccagtgggcacgggcaagctgacaggccaggcgggccgttcagcggcccacataggccaacagcacagcagttcacgcccaccgaacggcaggaaaccgaccacaacgaacggcccacccgcagacatacgggcaccgcacggtgcacaatgatgggagcacaacaccaacaccatgggacacatcaacacgacacaacggcgattacaacacgca

SEQ ID NO: 680147 - DNA, 413 bp, Homo sapiens
ctcccagttacatccacacggggatctacaggtttcatgtggacatactgacagttgaactcacaccatatatggaacatccagctatctacaggctcggtaggtctctcgcctctccctatatgtcctcccactcatggacaccatacacgggtgcgctcctctagctgttcataggtagatgctctggtatcgggggtctaagctatggctacccgcgcaaagtgtgatctcgctatttccttatacacaaggcctcggggtcagtccctgtgacatgacgctcggatataacggccgatcgccaccgtgcggcactgatatatagtgccccaggcttcagtacctatcgcggacacggcatgtgggtcaatggcctcgctaagcgcgcatagtattaccctcgagtggct

SEQ ID NO: 680148 - DNA, 691 bp, Homo sapiens
atttctatcatgatgagcttcaatctccgaggcctgtctcagcgagaggtacgtggctccgtttgattaatttgttaccgagcttagacttattgtgataaaatattgcatgttgtattttacacgtcttaagtcttaagcacagtcagaattatcttaatgttagagtgataattgtggtcttttaggaaaaaaagaaacaagagatctgatatttatttcaacaccgtattggaaggcaacgaaacatattacactattggtgccatagtgccaacaaaggtctttcctaagatactccatctggtcatagtacctggtatggtcggacatattcggagttctatttccatacttgaaaacattggacggattccagacgatgcctgaaccaatattattcacgtagctatgtgaccgagctataacattgccgggtcctcggtctcaagtacgattacaattggggaaactgaccaggaccaatgtgctcaacggttaagcattatggtgtcaaaaacctttaacagaaaacctgttagaaggccttagaacctcacgcatattaagtgttgagaagtctctagcttaacttttacacatggtttctataaaagggtataatggtatgaaactagaccttttatatagtggcatatgtataggatagtaatcactattaaacgtatta

SEQ ID NO: 680149 - DNA, 359 bp, Homo sapiens
gttatgcttaccaggattgttagttcttgaccaccctctggttccgaggagcagagactttagaaatggggaaaatgggccgggcgcggtggttcacgcctgtcatcccagcactttgggaggccgaggcgggaggatcacaaggtcaggagatcgagaccatcctggctaacacggtgagaccccatctctactaaaaatacaaaaaaaattagccgggcattgtggcgggcgcctgtagtcccagctactcaggaggctgaggcaggacaattgcttgaaccaggtagtcgggttttgcagtgagccgagatcgtgccgcagcacaccagcctagcgacagtgagactccatctcat

SEQ ID NO: 680150 - DNA, 773 bp, Homo sapiens
aaatgattgctgatattttaaaataaagggtactatatgttcctaagcaattaatcagtgtgtttttgccacatgagaatgaatttaagctatagagggaaaatagaatttagagtttagagcccaagacagctgtattcaagttctcattcctccacttagacaagtggaggttaaccctttgacttctgcttccattgctgatgaaatgagaatactcactacccattggatcatatgaggattaaatgaaatgaagcacataaagcacccacacatcatttctaccaatgaaaacagttatgatgctcaaagaatggattaacaaaataatcacgggcaataaaaatatccaaattagatgctagaatttcaaatttaaaaaagtttcctaatattacaagggatgagaagtacttatcagagtttcaatttctttcctttctttccattacaataggtctctatagactttgtctagaaagggcaaatagtaaatattttaggttttactagccatatggtttctgttgcaatatgaaattctgtgtttgtgatgacagcatagacaataggtagtacgtgacaggtggtgggtctgattaaacactcacaaagcagatcagctggatttggtgtagggcatagatttcgaaccttgctggaatttccaacattcctaacatctcgcagtgaaatacgcttgaagttcagaggagaggctcaatctctgtggccatacaaccttccccaaaattctctcaggtggcggt

SEQ ID NO: 680151 - DNA, 1293 bp, Homo sapiens
  misc_feature (344)..(344): n is a, c, g, or t
  misc_feature (495)..(495): n is a, c, g, or t
cttactttctcagctctcggcgcacgtgaccaggttactcttggtacttagtagcaacttcggcactttcatctcttgacctcggataagttatccctagctgtgcgtggaccgatcagttgtgccatcagtgaatgcgttccgttcaaaaatgtcttagctgtgtcactgatatatgcctagtggcaaacgcttcagctttgggagggtgtcgatccatcatcttagcgaacccacaccataagcgtgtcaactagtgagagtctagtacgaatacgtcctagttacatataactttatagaattgtcttgaagctggtgattgcttgtttgtaacaacttgnaacatcgaggctcattcatatggactcgacatatggatgatgtgattgacgggttccactccgagttagatcgaatctaatttgtatgaacctaaattcatgccaagccaagagtagcgactaaggaatgaacctacggcatcatctgccntatcgtccgtacccacgaagaagggagcacaaaaaagggaacctttggcatttccacggcgaactttgaaaaggctccaaggcgcttttaattcgttgtgggcgccaacctcttgcgctaggaaaccgggtttgcaatttcttagcggaggccccctcaatttggaaacgaaacaacccttgtgctccagctacacttgcaccgggcattattctttgaaagccctgtaaaagaaggcctttacccacaatttggaaccatggcggggcggacctttggggaaacaaccccagagaaacggcgatggggaaccgttcctttcctttccaactttttggcaaggaattaccagtttccgttggactttccccaaggatacatccccaatacaccaaggtggacaggtctttggcccacgatggacacaacctttcaaaacgccaagggaagggttccctcacaccaacaggttggaaaaccaccttggttcaccaaataggcaacgtttggacttccttcgcgaacgagcaaaacggtggaacacaatttacctcttcttcccggggcaccaaacaacttcctttggggagtttggaaacatttttcccctgcgccaaaagaggcgttggaaacttgaagatttttggcccccccctctggtgggcacaagaagcggggtttctaagaacacagcacaggcacaggacagggggaaatgagggcttcactttgtgtccacatatagcgcattctcattcggagagacctctgagacatttttgggaacccccaaacaga

SEQ ID NO: 680152 - DNA, 301 bp, Homo sapiens
gaattacctattatccagcaatcttctttcgtggttatatacccaatagaattgactgcacgacctcaaacatatagtttgttaactcctgatcgtccagcactatccacagtcagtgccagggtcaacccccatcgcatgtccattgttggattaatggatcagcaaaatgtggtatatgcttactatagaatattattccgcctttagaggcaccgaaactttaacatgctatgataacatggatcaaccttgaagacgttgtgctaagttcaatactgaatgctaccacttataatag

SEQ ID NO: 680153 - DNA, 612 bp, Homo sapiens
cagaatcacactcaaaatacactgttggggtcagaaaacagtagcccaaaatgaaagcctcagaatcagcctcagaaacaaaagattttctttgacttttcatgccttcctgtctctcagtcccattctcccctgaggcttgccatagaaactagaattcccattctgtaggtggctcatagaaaccagaatctcttttccccaaagacagtcataaaacctaaaaatagtactctaattttttctccacccttctatgtaaaaactggccatgtaaaaaaataacttaaaaagaaaaaaagttacctgatctaccttgcttgactataggtcataagacccccccattccagagagggtcctgctttacacccagaaggagggaatgccactcagagaggccaagagaaatattgacagacaggccttgttgggtttccccactccatctattagcattagaacatgtccttttttgtccagtcgtatatcttcaaaactgttcgtactttgttgaacctaagcacaaaagtggacaatttcccctgaatctttgggtcttcattctgaaggtctctgtgtacacatgttacataaatgtgtatgccttta

SEQ ID NO: 680154 - DNA, 515 bp, Homo sapiens
acgataccgtaactagtccgtcactagtaaagttcatgatcgaaccgactacttcagtaggaaacaaatggtcgttggatgtccgttcaccccggcgaaggcgacaggtgcgctacaggacagcataatttcgggaaaaagctagcctgaaactgtacaagaccacaccggagtgtcatcttagtatgttggattcagaactcatttgggctggtggcaacgacaactggcttggcatgatttagtgattccctggattatgcagaaggaaaaatgaagcccaaacatagacttgcataggacgactggcgctgtcatgatgcaatgaaacaagacctcaagaaagcaacgaacaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcaaaagaaaaaa

SEQ ID NO: 680155 - DNA, 189 bp, Homo sapiens
caacgctcagcagaacgtgcgcggatagcgaagggggttgaacctggcgcgcggcgtttgcgctgacgcaaagcgatgattgctcaggctggatattcatccagccttttttatgttataagctttaccagcaacggcatggcagggcgccatgcccggtcattctgcaggagggtaaatgataggtcg

SEQ ID NO: 680156 - DNA, 259 bp, Homo sapiens
tctgaggctccctcttcgctcatatactctccaactatggctgatatagagtcaactggtctacaacataggaaatagtatggaataggggtcaggatcttgacacgaatttacagccaagtaggagaaatggaatgaatgtggaagggaagatgactattagacatttaggtagacagggtctttccactgttcaggatatccagacattctcccagaatggtatccctgaatatgcaggccaaaagaaaatgacttc

SEQ ID NO: 680157 - DNA, 508 bp, Homo sapiens
  misc_feature (15)..(15): n is a, c, g, or t
  misc_feature (43)..(43): n is a, c, g, or t
  misc_feature (54)..(54): n is a, c, g, or t
  misc_feature (73)..(73): n is a, c, g, or t
  misc_feature (80)..(80): n is a, c, g, or t
  misc_feature (130)..(130): n is a, c, g, or t
  misc_feature (492)..(492): n is a, c, g, or t
  misc_feature (500)..(500): n is a, c, g, or t
aagtaaaaagccccngccccctggatggttttggtttcccttnccctttttaanggcccctaaggatagtaanggagccncctggagcccttaagttttttaaatacaccggagggaaggtgacaaagantctttgcctgggccaaaactttagtcagactccctcaaccttcctcgtaggtttatctgtgcatttcccttggaaaatcccagttagaaccctctaccctcaatatctgatcaggttcctcatcctctacccatcccaaggtgatgtctgatcaccttgacctattttcagcaagaaacccctttactcctgaagttccttcttagtaattttttatccagtgaccccaagctttttgttccttggctataaattcccacttgcccatgctgtatttagagttgagcccactctctctctcctaattcagaatcccattgccatggttgctatacctatcctgatggtccggaataaaatcnaaactaantgtgcttt

SEQ ID NO: 680158 - DNA, 535 bp, Homo sapiens
caaaggaaaaaatacaacgatacaaccaggtctggacagttccccccgatatgttgaggttttagtttccccgaggttttttggggtggacgggagactctagaaaattaacagaaaccaccggtcaccggtagtcaatgggggatggtcccccctgcacggagataactagagatttggttgggtgcccaaccccgctaaaagcccaataccaaccagacacccatgcaatggcgcctcatcctcgggacagaaaacccaccggcagcatgcaaggcttgggctattaatattattacggttggagaggtcgaacacaaccagattccccaggaccccctagaacccccggattttctgggaaccgatagaacccatggaaggaggaaacccaaaaccaaagaaggcgcaacttcgcgagaacggggaaacaaacacaggcctgggggtgcccaaatggcgcactggaaaactcaacacgaactcccccaaaccaggaaatttggccagacagccccttcctcgcactccgcgg

SEQ ID NO: 680159 - DNA, 537 bp, Homo sapiens
ctgaatagtactctgttgcgtatatgtaccacattttctttattcattcatctgttcatggactcttaggttgcttccaaaccttagctattgtaaacagtgctgcagcaaacatagcagtggagatatctctttgatatactgattttctttcttttggataaatacctagcaatgggattgctggatcatatggtagctcaatttttagtttgaggaattgagctcaattttcaatttgaggaacctccaaactgttctccgtagtaattgtactaatttacattctcaccaacagtgtacaagtgttctcttttctccacatccttatcagcgtttgttattgcctgtcttttggatctaagctattttaactggggcgagatgacatctcattgtcattttgatttgcatttctctgacgtgattgaatgttaaacagcattaattgtcatattctgatgaaattttggaacatcatggataaagaaaaacatctaaaacactcttgagaaaaataaatcatattatctacat

SEQ ID NO: 680160 - DNA, 438 bp, Homo sapiens
attcaatagcttgcccatatctatcacgggacgtaggccaacaggaaatagaaaacccacattaaaaaaaaagttacagttcgctaaacgtttacctgaagccgaatctgaagtggagaggacgtcagtcgtcctcgtcattctcgtagaagtcatcgtcctcctcgtcgtcctccccgacgtaggacaccggagtctccaccctggagccgctgtactgagacccattgaagcttgtggccagcatcccatctgcaccgttggtcaggtcacttgtgccgttagacgtgaaacctgccgtcgtgatgaacacggcctccaacagttccctgaagccatttctgtcacgtatggctccagagccttggggaccagacttctggccatttaacggtcttcggcaaaagcaagttccccaaatccagcgtgctgatacaa

SEQ ID NO: 680161 - DNA, 339 bp, Homo sapiens
aagagaaaatcgtggtcatatatatattattgcttcccgttctcaaccagtacacattgttgccactgacgaaactgacagccaggagtcggtcgagaatgctcaagatttgttttattctacacccatgcctgttcacagggggtaaaaatcctaataaataacttatgatgtacttcttgatttcactcataccaaacacagcactactgctaccatccatgcctctgtgaactttggtcctgctataatgagacacgctttgcctccttcatcacgagcaatcttccgtcatcagtctagcgtgcctctgtgcttaagttagctccaataagagcc

SEQ ID NO: 680162 - DNA, 336 bp, Homo sapiens
  misc_feature (133)..(133): n is a, c, g, or t
  misc_feature (156)..(156): n is a, c, g, or t
  misc_feature (238)..(238): n is a, c, g, or t
gccgcactcttgagtccgaggccatctttttttggagaaggcgtcgcgtttggcgttttcccgaggttgggctgtacattgtctcgtccgcggaaaaaaaaagctctgaacccgcgccgcccgacaggccccnggctttcggccgctgctcgccgntccagagctaagccactttcccccagtgccgaggggtttcttgtgacccctcccctccaactcccaattcccttctgaaagnggcacctgctcttggtgagaaaagaaattatagcacgaagagccagtatcagaagagtatccatcacccgcagcaaccccttcgggaccaccatcaaa

SEQ ID NO: 680163 - DNA, 220 bp, Homo sapiens
gtcggcggtactaataaacattaaactggcaggcacggggtcatgccgcatccaccagcactttgggaggccaagtaggaggaccactgaggccaggagttcaagaccagtctgagcaacacagcgagaccctatctctatttttttttaaagaaaaaaaaaacattaaaattactttttccggttcggggctactagaaaatttaaattacaccggtat

SEQ ID NO: 680164 - DNA, 164 bp, Homo sapiens
ctctagaggaatcccctttggggctccattcaggacacctggctcctcagctgggggaccatggccatggcccaccacctggcccttcagtgttcaggcaggggacatgcaccctttagtaaccgggaggggacccatcacatgacaaccaccccaacgaccat

SEQ ID NO: 680165 - DNA, 381 bp, Homo sapiens
ccccactagtgtaggctgtgtgaaggctgggggaaaacatgtagtagttacactgtttctcacaaaacactgtgaggtatggaatacccctaatataactagtggagctcatctactggtgcatgccaataaagaataaacacccagttgttgttgttgttgtttttttttttttttttttcaccaaaaaaaacggtactgatagttggggagtccaagggaaagagataattcggaagttgagattaaactgcgcttaatttctctacttcgaggaatagtccaccatgttgtccccccaagttatctgcctagttcctcacagaggtgtactcttggggcccggccagaaggagaccgggaagacggggttgttccctt

SEQ ID NO: 680166 - DNA, 919 bp, Homo sapiens
aggaatcggaatccaaagggactttggaacagcgtggacagtaatccagaagaaaaggaaagtcaaatcctttggagtcaacagtctctgaagtcctatcactgcctgtcagcagagacgtgtagtgtctgacagccaaatgaggaccgaattgaattcaagcgccacagaatccgccctccgtaaagcccgcttttcccagcccacgtgcgtccaacaaagatgttaatcctgattgaagtttcccgtctccagatttgaaacgcccgctgaaaaggctgcatgtacctggttgagaagaatatgatggagcaaagtgataaacgaacaagtttgatgactgaccagaacagtatgctgtggattctttttctaaggatgatcaaaaagcagaaaatgatatggcaattgaaacgggcagctttgttggacgaaaagattaagaagggaaaaggaaactcagctccggaaacaacaggtgggaagcagacactggagcatacagcaaggcaggacacacaggcgctacaactgagcgaagaacgtcaggaagacaagacagcatgcacagagcacgcagagaactccattcaggcaagaatatatgagggcggaaacatactgaccactaatggacagattatggcatacacgtacgttaaaccccgatcctcaagtacgtaacaccaacaaaaccagggaacaacaattcttatcacagagatcataattggaatcccccaatacaccccataaagggtcctcccagtctcttaccctccttagggatcggttgaaacacgggtgataacgagaaccgtcccatcacggccacagaggcacgccgaagatcagacgtctggagaaaaggcttcttatactccacagtcccaggggcagtcgaaaatggcccaaaagc

SEQ ID NO: 680167 - DNA, 138 bp, Homo sapiens
ccccccctttttttaaaaaacccttttttttgttgggccatcaaaattaacttgggtttccccccctttttgtaatttttgtttttgtggcccctttttttgaatttttttttggtcttttacccaatttgagggcca

SEQ ID NO: 680168 - DNA, 131 bp, Homo sapiens
cgactcttgggatcccctcacgcacaaaccacctctcacccacaaacccctctcacccacaaaccccctctctaggctggcacggggaacagacgggagagggggtttgtgggtgagaggggccttgtggg

SEQ ID NO: 680169 - DNA, 357 bp, Homo sapiens
  misc_feature (225)..(225): n is a, c, g, or t
  misc_feature (257)..(257): n is a, c, g, or t
tagccagcgaccctgggagcacatccaacccccttctctccactatcctggggcacatccagcccccttctctccattctggtcagagtagcacccagcacagcaagtcacccttctttcctgaacaacccctcagccttcccctggacccgcctcgcgtgcccctctctcagcgaggctgctcctgggccgggcactgaagcccagcctagaaccacactcgancccccaaggcttcaaacacctctgccctccanccccacactcacatgcccaaatcccagaggccagctgctggcctcagactgcctgttcaaacgctggcctacagcacatgccggcatgtgctgtaggcca

SEQ ID NO: 680170 - DNA, 1248 bp, Homo sapiens
taactgaggaatcagtattagtccatgaggggtcctcaaacaagaacgacgaaaacatagacacagttcaccagagcatttcttagagctaaatagactttacagtttaaaggactctctttgacttctaaaatttacaaccgttcctaatccttgtggtgcttacaaatgccaattctctattcacaaacaggacttactgattcataaattggatttaccttaattatcaaggccttacttgggaacatcgtatagagagaatgtacaatcctcaaaagaagaacgagctagacaaagaataaccataccaaatctgcagagtttgactcaaggaaatataaggctcaatggctaataggggttcaacttggacaattcccaaaacacgtttagggcacaaagtcactgtgcctttcagaaaagcataccttaccgtgattgcttcgtcaatccaattagttacaccagtgggcaggataattaccgtacctaacagggaaacagaaatgcccaacgccaaggacaccacttacggccagtgaatcaccggaggggattgcacacacgggggtgacatatctacttttaacccgccacaatgatcccctaatgacatcaaatctagcctataccggtgtaaaaccagtttaaatgaccgcgaagcaaggcaatacctataccaagggcccgaaggcaaatgtggccgtgggcatcgggcatcacggcgcggatttaagttaccttacttttcaccccaacgcaaaatgttatatataccactttgatcccctgttataacacgcccattaagctttagtggtgccctgttgacaccgataccacacaaattattttttagcgcccaacacaaagttaagttaacgagattttcataattgatctcgtacacaggtgataaacaactgtctgtcccagaaactataagatgtatgacaataggaaagctaaattttttccaaacattgtaatataggtcggagagttaccatacaatgtataaaaggggaaaacgttgagagggttatgtagtagtgggcgtaatgggtaacaagacaaattagtgcggaagaactctatgaatgtggtatgaaaaacaacgaagacgacatgaaattatgatgatatagagacagaacaacgcaatcaatgtatcagaggagcacaacaaagagaaggagttctccaaaaacattcacgttatgacatacccagaataagtagatg

SEQ ID NO: 680171 - DNA, 319 bp, Homo sapiens
tcagtttttttatttgctttaagagttacataccatgagacacactgctttggtgtttttgaacttttggatgattgtgcgcagtgctcacgcagagcaagtgggtattgaacgtcccagatcgatgagccgaccactgagccgctgttacgcggacccctggggctgcttccggtgcaccccttcctgcagctgttcttctttttggtcctgacatttcagctctttttctaaatgtctgtcttcttgaaggctggacattaccttcttttcatgaccagaacctgaagagatttgtaagtcccactttgtctttctt

SEQ ID NO: 680172 - DNA, 121 bp, Homo sapiens
tgggcagatgaccagcggaagataaggctgagcggcacgtcgctcacccgtgtgtcgtactccacgcggcccagaacccaactcgcgagagccagaacttcacaattgaactacgggcagg

SEQ ID NO: 680173 - DNA, 1081 bp, Homo sapiens
  misc_feature (1)..(1): n is a, c, g, or t
  misc_feature (470)..(470): n is a, c, g, or t
  misc_feature (475)..(475): n is a, c, g, or t
  misc_feature (477)..(477): n is a, c, g, or t
  misc_feature (490)..(490): n is a, c, g, or t
  misc_feature (499)..(499): n is a, c, g, or t
  misc_feature (506)..(506): n is a, c, g, or t
  misc_feature (522)..(522): n is a, c, g, or t
  misc_feature (535)..(535): n is a, c, g, or t
  misc_feature (537)..(537): n is a, c, g, or t
  misc_feature (552)..(552): n is a, c, g, or t
  misc_feature (573)..(573): n is a, c, g, or t
  misc_feature (589)..(589): n is a, c, g, or t
  misc_feature (594)..(594): n is a, c, g, or t
  misc_feature (601)..(601): n is a, c, g, or t
  misc_feature (613)..(613): n is a, c, g, or t
  misc_feature (641)..(641): n is a, c, g, or t
  misc_feature (653)..(653): n is a, c, g, or t
  misc_feature (682)..(682): n is a, c, g, or t
  misc_feature (690)..(690): n is a, c, g, or t
  misc_feature (699)..(699): n is a, c, g, or t
  misc_feature (703)..(703): n is a, c, g, or t
  misc_feature (732)..(732): n is a, c, g, or t
  misc_feature (754)..(754): n is a, c, g, or t
  misc_feature (763)..(763): n is a, c, g, or t
  misc_feature (794)..(794): n is a, c, g, or t
  misc_feature (797)..(797): n is a, c, g, or t
  misc_feature (800)..(800): n is a, c, g, or t
  misc_feature (805)..(805): n is a, c, g, or t
  misc_feature (855)..(855): n is a, c, g, or t
  misc_feature (861)..(861): n is a, c, g, or t
  misc_feature (874)..(874): n is a, c, g, or t
  misc_feature (898)..(898): n is a, c, g, or t
  misc_feature (900)..(901): n is a, c, g, or t
  misc_feature (910)..(910): n is a, c, g, or t
  misc_feature (1022)..(1022): n is a, c, g, or t
ntaggagggctgccaggctcgcggtagagacacgtgtcaacttatatcctttttttgcaccgctaaactcttgtcatctgctgttttcttatttggtcacctcctcttttctctttgtcctatctatgcgcctcctcttatgttggttcctctctattaatatcactacgttgttttcttccctctcacccttggtgtagttatttcccccccccgtctcctttttaaccgccctgagtctgggtttttttgggtttctcaatgtattaatagatacctctccgaaccatgtacccgcttgggattcaaatctgtttctttggcaatcctcgtggaacacacccttcagtaacttcggccctgggacccacgggaatggatagcacccctgtctgaaaggttatgggaagaaatagttagatgaagccgaattttattttgatgtggatcctgataaaatatgtagagcncagcncnaatgctacttcanaatgcggtnaaattcnatctcgctgagtttcnagaagtgtggcancngagtgttcctgaagnaatggtaactagtcttgatcngcttaagggtttagcnctggnggataancactcgagaccngaaatcatatttttgctgaaagtagatnatttacctgagnataatcaggaaccttttaatacccttttntctctaangggagaagnggancagaagaagatattgctccatatattcanaatttgtgtggagagaaccaanccatagggnacattactcactaaatattctcgttcttcgnatngcnaaatnggtggttaaagtttataattcgagaagacccatttcttaaaagaacaacngtcttntcttcaggactcnagttgctttataaagttgctgganannagaaaaatnacttgtacttttatttctgacttttagaaacctagtcttctaaggcatttttctcctcatcttaagcattttgaaactactgttatttcttaaatgttataggatgtagctntaaaattatattttactatgtaccccagtgtaaacacaggaccaaagaattctttccta

SEQ ID NO: 680174 - DNA, 345 bp, Homo sapiens
  misc_feature (53)..(53): n is a, c, g, or t
  misc_feature (66)..(66): n is a, c, g, or t
  misc_feature (70)..(70): n is a, c, g, or t
  misc_feature (81)..(81): n is a, c, g, or t
  misc_feature (138)..(141): n is a, c, g, or t
  misc_feature (145)..(147): n is a, c, g, or t
  misc_feature (191)..(191): n is a, c, g, or t
  misc_feature (202)..(202): n is a, c, g, or t
  misc_feature (219)..(220): n is a, c, g, or t
  misc_feature (242)..(242): n is a, c, g, or t
  misc_feature (285)..(285): n is a, c, g, or t
  misc_feature (287)..(287): n is a, c, g, or t
  misc_feature (316)..(317): n is a, c, g, or t
  misc_feature (328)..(328): n is a, c, g, or t
ctttcattctctcttcctgcagtgttttgcatacatcagaagctaggtacatnagttaaatgattnaganttggctgtatntagatttatcactttttaatagggtgagcttgagagttttctttctttctgtttttnnnntttnnnttgactaatttcacatgctctaaaaaccttcaaaggtgattatntttctcctggnaactccaggtccattcnntttaaatccctaagaatgtcanaattaaaataacagggctatcccgtaattggaaatatttcttncntcaggatgctatagtcaatttagtaagtnnccaccaaattnttatttgactaacaaag

SEQ ID NO: 680175 - DNA, 1774 bp, Homo sapiens
gaatagtaggctggcatgatcaaccctcaggaccccatattccatgggtggaaccatgcgcaacaattctgcagggatggaagccagcccagagatgatgggcctaggggatgtaaagttaactccagccaccaacatgaccaacaaggcagatgggacacccaagacagaatcccaatccaagaaatccagttcttctactacaaccaatgagaagatcaccaagatagtactgagcatgggatggatgagccatgagcaggaagcatgatggcatggaccagctcaatcctggcactacatcatgaagagcagaagagccaatgggccatgaccaaaatctgcactgctgatcgggataagggccacaccccatactgggaaccctgcctacaacgcccctacgtactggcagcaaccagccagcacacgcgcaccaactacgcgcagcgacgatcgcgacgcaccacggaacacaccaaacgaaaaccacaacaaaactagcgccacgcccaaacccacggcaacaccccaagacatccaaatagaatgcggagcaccactaccaatgctatactaggaccatctacaagacactaccctaggacacatcatacgaccggcactataatatccacagcagaggagacaacaatatagacccaaaacgagagcagatgccaacagaaatgagacacccagcagagcaaggacacgcaccccccatccgaccgcaatgcacatcattccatcagacaacgacacagccacgaacaccgccacaaaaagagacagcacccccaaggaaccacaacaacaggaactgccgacacgacgtaccacaacaattacgacggcagcgcgaaaaacagggaaaaccatacagacagcagaggcgacacaagaaaccttgaccgacagaacacaaaccaaacgagaaaaacacagcaggacacaaagaggcacaggaagcagcatcacagcagacacaacaacacagcaaaggcgcacaccccacagacacaacaacacgaaaccaaaacaacgacaccaacagagcaagaaggcacaaagcgacaggacaaccacaccgcgcgatcgccaggaaggaccaccacaagcactgaaaagggaagcgccagcaacacaacaagaggaagaacatcgacactacaacccgggcgaaaaacccacaacgaacgaaacacccacagaaaaaaagacagtcaaccacagcaacaagcaaccaacaaagagacaccactaacagacgacagaaccacagaacgacgagaagaagagcagagcaagtataggagacaatgacacagaaagggacagcgagacagaaccgcgacaacacacgaggcaaaaagtagaagagaacgaagaccaccgagagagagcacaatagaacgcagcacgaggacgagctatacagacaaacaacacaggagaagagcagagcaagaagatgatcgctcaccagagcagaagaaggaaaagacagaagaaatctgcatagaccagaaaaagcacagagagaggagatgacacatcagcgacacaagcaacacagagacgcaagagaagggacgaacagaacgagaagtgaagaagggaagagagagaagaagaaaaagcaagaacgatgacatacgaagaagcgagcagcagagacgacaagagtagcacgaagcaaagaacaaggcaggaaacagagcgcaagaaaagaagggagcaagcaagaagagtcagaagccagatcagaacg

SEQ ID NO: 680176 - DNA, 235 bp, Homo sapiens
gttgcgtgccgtggtggagcagacaagagcggtcccggaagctggcggagaggagctgattgagactagtgagcgggtgcagctgctgcattcccagaacaccagcctcatcaaccagaagtgaagatggatgctgcctgtcccagctccgactgaagtggggaggcagttcaggggtgcggattctgcggggaggccagaggccttaggttgcgccttttgcggcagactaaac

SEQ ID NO: 680177 - DNA, 803 bp, Homo sapiens
ggcagcccagctgtaaggcaataagcatgggctcaccgctgcaagtcagagttcatgtgctagccgggcataggggcgagagaaggcccagaggcgacgtcagagagaagcaactgcgccccgtgtgaagagaagctcgacccatcaccggctggagagaccagctttcacgttgaagatggcatgggtccacgaactgttgctatgagtccacatcatcgtgccgtctgcggtggtccgtacccatcgattatcactcttatcggtaggacagttgatccggaccacgtgacgttgtccatcacgtgcatgtgagagcgacagagaagctcaactcgctaggaacaagtatctgacaggggactgaggcgacgcctagcaagtctcgcgtcgtcccaatagagcctgcacagggaagattgatgtggccctgtgtaacctttgaccctgtacaagctgaacccacaggactgtcatatgggctggctgaaacatgaaggcgacatttattatgatacggtactgcccctgttcctatgactctgcacgtgcatgtgggggccaaagcgcagtcatgagagacgctcgaggcgtaaatgcgagtctaacatgctagcttgtggtctagttgaaacaggaacaaggctagcctatgatgaggctgcgggggctggggatgggaatgattccaaactagtcaaaggatgcttgagcctcagttagggcctggcgatcctaatgggagaatggcctttcctggagaccccccctgtacagccaggagcagctgtcgtccaaggtgg

SEQ ID NO: 680178 - DNA, 157 bp, Homo sapiens
agcggagtcgctctgcctatctttcagaggcgtcccgcagcgtggtcccacaactcgtccgggacagcctgaaggaccaccccacaaggaggcaaccagtcccaggtcccccacctcgtcccggaaagccagtaaggatcaccttcacaaggaggct

SEQ ID NO: 680179 - DNA, 290 bp, Homo sapiens
tatgcatctttctagtcattggaaatactcttcaatgacatcctttgcctgagactcctatccatagtccttcaactactacacaactgcaaccaaccacttcacgggttttcccctctctggtctaagtttacacaggaatacccattctcctatttgcttgttgtcatctaaccttaaattagggttgatttgtgtgttcggcacaaagggcctccatccaacttgacatacattggctcatcacagttggatgcgatcacactaagatgggtttggcccttatcgag

SEQ ID NO: 680180 - DNA, 127 bp, Homo sapiens
cttgacaacctccaaggcagcatgaagcatggaaggacttccccagcccagtgccacagcgggagggcagtcgctggaatgtcgggctgctgttgaggtcctcaggctacactggttgtctgtgtca

SEQ ID NO: 680181 - DNA, 940 bp, Homo sapiens
tgtttttgaggagaccagaatagacataaaagacgagaggctggcgcatcggtctttattacatccagtatatacattgtcaatgtttaagaactgaagtgttcatattattcatttgcttaattttttaattacacaaatgatacaaaaatacattcttctcataaaataatcagaattttaccaataaagttgggctcccattggccaccatccccaatcccagccacttccccaagagaaattgggaaatctttggtctgttttactactcctggtcttctcacctatccagacaatcatgagggcagacaggctccagggcactcctctaagtattaaaaacaagtgtaacaaacgctttacctgatcaagaatatgcatctagaggagcggattaccctcagaagaaccgattttaatatgatgggcctatggagggccctggactgggatgatggagtaagcttcccttagatcgctgctacattacaacacgcatcgccaagacgggtttgtttttatttgacgaagtttatgggccgttaatcgtgaccataaggacaatgccgagagctggaagggtgtagagccttagaatgctagattgccaccggacctttatgaccggggaccattgggagtgtgtgattctttttgttggccaaccgacagggtgtgggcttattatgaaggtaaatagtggaagaagagggcgggggagtatagtccgtgtgcgtcgagataggagagcggagggcggtgagccgcgggtgagagtaggcagctgtgagacgcagtgtgatcgggacaggctggggaagagtgagggcagggtagaggagatgagaaggtggagctgttgtgacgaacggcgatgctcgtccaatgagacgcacggctagaatccgaatgtacgtcccgtatgcggataggtgcg

SEQ ID NO: 680182 - DNA, 1257 bp, Homo sapiens
gagtccgagtggcagcagcagcgcagctgcagtggcttgtgtggtcgcgtctcggcacaacccggtcagcgcttgcagccatggctgcacccaactgactgcaagcagccagcattgccagcaattccacacagcacagctattttccactcatttgcaccaacagcatggtgcatggcacactcataaccacccaacaggcaccttggggcaacttgtcacatgcagcatctccttggggcagcacatcccaaacagacaagcaagcagttacaacaggcacccatgcattccaatgcacagtcagcaatgctggatgggtcaattgggcacccaattgcaactctccgctgcacattctctgcacccattgcattgggccaagcaaaacaattggaccagcacaacagcacaaggtgcaaagcaaaggcaactttcagcagcacagccattcccggtaggtgatatgggatcacagggcatggggaacagtgggggttaatcatacaagttgggtggcaaagaaagtttcgaccaatgttggattggaaaaaaagcatttgggcggcacaggcaaggttagacaggatggaaagcaaagttggcaatgccaaatgacatcccggggggcacgccaacaccattggaactgggtcgactgggtccacaggtacacactaatgacccgaacggcgggtgcccaacattgacgtaaccaggcaacagtgtacacgaacgcctagtgtccccaccatggttggatacacaatgtgcatcgtgtccaagaaaaatgggctcaactcggcccataccccaagagcatggcaaactgcactgctggtaaaacaagggtataacagcactacagggtcagagaccacaaaactgtgccctgtcaaccgaaaaaacagggcacatcaagtgacaaccacaggtaatccataccgggtaatcataaagagcaacaatgaacccacaaacacgctcatacgaaacaaaaattcggaaacagacacaagcggaagccaatggaaaaaacacacgggaacacatgaacaaaaccaactataagcacgaaccatccaacctgcaagaggagcgctaggccaacgtgggcagaaacacgagcggacgccgaccatagaccagaagcaatgaaatagaaacatgcgaacaaagcccaggagcacacaagacgacacagcaaacactcagagaaacacaaaagaacaacaaaccacaaacaagagcaaaaca

SEQ ID NO: 680183 - DNA, 308 bp, Homo sapiens; identical to SEQ ID NO: 571301

SEQ ID NO: 680184 - DNA, 699 bp, Homo sapiens
gggggtaaaattgctgagtgaagcattgaaaaaaaaaaaaaaaaaaaaaaaaaaaaaaaaaaaaaaaaaaaaggaaaaaaaaaaaaaaaaaaaaaaaaaaaaaaaaaaaaaaaaggaaaaaaaaaaaaaaaaaaaaaaaaaaaaaaaaaggaaaaaaaaaaaaaaaaaaaaaaaaaaaaaaaactttgtggcccccttggcccaagtggtttttaaattggacaagctttttcattgggcccgaatttggggctaattggccaatttccccttatggggggccttttacaaataaatgggccgcgttttaaaaaggtttgattgggaaaaccctggggtttcccaatttaaaccccttggaaaaaaatccccttttcccaagttgggtaaattccaaaaggcccccaccggacggcttttccaaaaattggccaaccctaatgggaaatggaaaattgaaggcggaaaattttgttaaaaatccgggtaaaattttggtaaaacacccttttttttaacccaatggcccaaattgggaaaatccctttaaaattcaaaggattcccccgaaatgggttggagttttgtcccatttgggaacaagagtccctttttaaaaaccggggcttccaccttcaagggggaacccgttttaaggggaagggccacactttgggaaccttcccttgtttttggggg

SEQ ID NO: 680185 - DNA, 821 bp, Homo sapiens
tcctggtcagctggagagaaaggtgctcctggtagaaaaaggtccccaagggcctgcaggaagagatggagttcaatggtcctgttggtctcccagtggaccagctggtcctgccggctcccctgggtgaatgacgggcaggaccaacatgggtgagaattggtagagcctgggtacgaaagaaggcattgcgaaggtgtgactacagggagcaaaatggccctcccggtcccccaaggtcgttcagaggaccagttggttgcccctgtgaattgctggaggtgatggtgatacctaggtcctacggaggacatgcaggggtatgttagggcatagagaaggtgatgagggtgccagtaggcttccctggacctccttggtccaataggtcttcagggtctgccaggccctacctggtgaacaagggtgaccattggggatgttggtcccatggggccaccatggtcctccaggcccagagaggccctcgtggtcccctgtggagctgatggcaccacatggtacccccaggtctgttgcgttcagttgcggtggtgttggacgaatttgggtgaacctggcggaagctgtgaagcccagggtcctccttgggggaacgcggcgtgtagggcggggaccctgaggagccgatgagggagagaacgggggaggctcggtccgccttggtgcgtgtggaccttcgatgtgccgaggggcacccatgtgatggtggcctaggattcccggtccgcggggcttcctggcgaacctgggcccccgggggacttgcccgcggaaagtgtgtgggggaccaggggcgc

SEQ ID NO: 680186 - DNA, 82 bp, Homo sapiens
atcggaatagttgttatttttggatttctaatttttgaacttaaatggcatcatagaatatgtacccttctgtcgtcttctc

SEQ ID NO: 680187 - DNA, 247 bp, Homo sapiens
  misc_feature (146)..(147): n is a, c, g, or t
cagtggctggtctggctgcccagaactccccagaggttcctgacaccaagcatcctacgtgccctctccacaggctcccactgaacccagggccttctcccttgacttttcctccaaggactctccgtgccctggtgctgcacctnncctccccctggctgcattccccagtcaggaacactaggctagcaccagctcagccatccttctctactgccagttctggcgtttccccagaggacgctat

SEQ ID NO: 680188 - DNA, 238 bp, Homo sapiens
gatttcgggcagggagccaaccataggccttcctattgattattgcagtatcgaatggacaagtccgaggtgatagttaccagtgaaggtgtgttctgggttcaaccggagtctctcgcatttggtctttttcgtgtggttttcagtattggccctttggatctctgattgtctcactatgtggtatctcttggaggttagttgtcctctagagaaggccatgatataccctggattg

SEQ ID NO: 680189 - DNA, 174 bp, Homo sapiens
ttgagtatccctataaatctggaaatcggagtcgtcacgtattccaggacttgtcatctctggaattacattttcagactgtctcatgtgtggtagcagttcttacgaaactttggtaaagttcggggcttagattgtgaatattcgctgttccaacacctgcagtgtacttcc

SEQ ID NO: 680190 - DNA, 441 bp, Homo sapiens
  misc_feature (143)..(143): n is a, c, g, or t
agaggatcccaggacagcttaggcacattttcttatttctcactgagagcatatacctaagatatttaggtcttagattctcatgactgtttggatggctgttgatcttgacaatttcttctggtctgtgtgtttatactatnttcctacaagacagcttcctagggtagtgtagcagtcagacatcctcagtaccatcttagttcctcctcccataaaaataatgcctcccttgttttctgaaactcaggcagcaggccagtcagaaaccatacagaaatgatatctggagattcagaaagagcagtagatattagattgaagctacagacgttttaatagacataaatttatatagttactcattaattgataaatgtagtgctaatgtataatgcatgaaaaattcaattgagagtcttgagtacagaaaacaaatat

SEQ ID NO: 680191 - DNA, 352 bp, Homo sapiens
  misc_feature (21)..(21): n is a, c, g, or t
gggtcccccccgtgacctggntggcctcccctgtttcagggagcaggtcacaggtccccatggggaattttagccccccctggggggatgttacaaccccaagctggttattttggcggctgtaattttgggggaaagtgtgtggccacgtgtgtgtgggtgtgggggggggggggggtgtgttttgtgcccccctgtccccatgggaggtccccccctgtccccaaatcccctattccccccccaaaaacaaaaacactcccagggattttggggagagggtgaggacaaaaacccgctgtccctccaaaggacatttttttagcaaaaaaattgagggtcccctttttta

SEQ ID NO: 680192 - DNA, 132 bp, Homo sapiens
gcaacagcagcgacaatcaggacagcacagacagcctgagatgtccctgataatcatgtagagataaagtcacgagtgtccaggggcatcaaatgatagtcacatagtactagctggaaccaaataaaccac

SEQ ID NO: 680193 - DNA, 125 bp, Homo sapiens
cccccccccccccctttttttttttaaaaaagggccttggggttgtttgggggtttcccccccccagtaagggggttttaaaatttttttccttgggcttcccaaaaaaaagacccttgtgttta

SEQ ID NO: 680194 - DNA, 109 bp, Homo sapiens
accggagagagcaaggggaggtggatggcggcacttgcttgcagccagcacctggcatggggtaggtctgttggaggtaggagtatctgtcgcaattctcacaaaggca

SEQ ID NO: 680195 - DNA, 616 bp, Homo sapiens
gggcctgcccgcctgcggctggaggcactcgcgccctgcgaatccggccgcggcggctcagcagcgctggtgcggcgggcgctgggcgtgggtggctccctcctcgtgctgtcccgtcgtgtggaccctttgccccgctctgccctgctgggggacatgcgcgctgctcctggtcctgctgtgcacgggcgcggggacgcctcggcctagtggcccctggccccccattgataaacgctgagcgctcggccaggggactggtgcatataccccacgattcccctgagaactaaggttggatcccgcggtgccagtgaacccatgtgttgccttcccgcgggatcccatgcctttgaggccccaggaacgcccccgccgccacgcatgcccgtgtggaccgcgcgagggcctggggggttggcgtcgcgacggcgggcccgaaggcactcgggcgcgaggcgctccgggagcgcagatgcaggtgccgcaagtcgtcgttcggcttctaccaggcggtgccgcgacttgctacccgttgtggctgcttggaggatatgcccgccagcgaggcctttccacttggacgaggcgcggggccgccgcagcctactcggcc

SEQ ID NO: 680196 - DNA, 428 bp, Homo sapiens
agcgggtcagtgacgtcgtgggctgaagggcactagcacccaacgcaaggcagtgcggacctgtcttgcagtgtcccttcactgtggttggagagacagagcgtacgcgcagtaggaagctgggcgctcgggctctgtggcacgcctcgatctcctgggaatctgagtagttgaaaagctgggctgttgtatttcgtgacaccgtcgagcgagcacgactcccatggcgagatccaggtcagcatgctaaagatagatcctgggcctccatgtcgtccttgtaagcagagcatgacgagatccgtcgacgtgtcgactgaagttgctagttagaagatcttagcaagtgaccttgagaaaagcaaggctatgacctccagcatccacttttgaggctgcggtccattcacgagaggttgcgtggactc

SEQ ID NO: 680197 - DNA, 162 bp, Homo sapiens
ggggggggtaaccccccccccccctttccccccaacccttttccccccctggggggggggggggggggcccaaaggggggggggggccccccttttggggggggggttttttttttttttttggttccccccccaaaacttttaatttaaggggggggggga

SEQ ID NO: 680198 - DNA, 410 bp, Homo sapiens
  misc_feature (33)..(33): n is a, c, g, or t
  misc_feature (67)..(68): n is a, c, g, or t
  misc_feature (72)..(72): n is a, c, g, or t
  misc_feature (77)..(77): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (96)..(96): n is a, c, g, or t
  misc_feature (103)..(103): n is a, c, g, or t
  misc_feature (112)..(112): n is a, c, g, or t
  misc_feature (129)..(129): n is a, c, g, or t
  misc_feature (187)..(187): n is a, c, g, or t
  misc_feature (206)..(206): n is a, c, g, or t
  misc_feature (221)..(221): n is a, c, g, or t
  misc_feature (225)..(225): n is a, c, g, or t
  misc_feature (228)..(228): n is a, c, g, or t
  misc_feature (238)..(238): n is a, c, g, or t
  misc_feature (245)..(245): n is a, c, g, or t
  misc_feature (262)..(262): n is a, c, g, or t
  misc_feature (275)..(275): n is a, c, g, or t
  misc_feature (284)..(284): n is a, c, g, or t
  misc_feature (290)..(290): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (331)..(332): n is a, c, g, or t
  misc_feature (336)..(336): n is a, c, g, or t
  misc_feature (344)..(344): n is a, c, g, or t
  misc_feature (349)..(349): n is a, c, g, or t
  misc_feature (351)..(351): n is a, c, g, or t
  misc_feature (367)..(367): n is a, c, g, or t
  misc_feature (384)..(384): n is a, c, g, or t
  misc_feature (395)..(395): n is a, c, g, or t
  misc_feature (406)..(406): n is a, c, g, or t
  misc_feature (409)..(409): n is a, c, g, or t
tggtcttcgaaagttctcgggaagattggcttnatagagtagtcttgctttagtatttcccatatcnngcangcacngttatcngtncngctgtcnattggtntaggttgantgatttgaccctggatntatgaaccccaagatttctatgaattcctagtttttttgatgcaaataaacacaccantattcgcgggaagcccatngaggacctttggccncgcngtnggggcagtanttgttgncctcctccctcagaagnttggatagggtgngcggggggnggtcgntcagcttcggagccttctcccgncnggngggggnggncatnncggnaggggggnggggngncggggggagctagggngggggggggcgctggcnggagccgggcngagtgaaggcnccng

SEQ ID NO: 680199 - DNA, 880 bp, Homo sapiens
gggtttgtgaagtcgtggccgttagcaggaagcctacattcagtcgccccgacgctagtgagggacccaaatctgagttccccggccagccgaaatccaagccgtgtgttctgcgtgctcagcattgtcccgaacagatcctagctaatacttgcgaccaaatccgcgtgcctttggacgcaacgatgcccaaaatacgatcagtgtgctgtgtgacgcgatccgatgtggatgcgagagcgtaggtacgttgtgccatccgaggcccatagcatcaccgggaatgcagctattttgcaccacggtgtgtgaagaactatttggcattgatgggaagttgtgcggtgtcttaaggtctcgctaggtaccgaggtactaactaacaggtttctccagctggctgtagagatctcaaataatagaggtgactgccaggatgtgcggtaaggaatagcccactgcctctttaagttccgtgccaagtgctaccctgaggatgtgtccgaggaattgattcatggaacatcagtcaacgtctgttctttctgcaagtgagagagggcattctcaatgatgatatatactgcccgtctgagaacgctgtgctgctagggcatctgtatgctagtccaagtctaaagtattggtgaccttcacagtaatggagagtgcagttaattctggactaccttggccggagaacaaagttcgctcccaggaatagaagtcctggaaacagcgacaaaatcaattgaagggacccagtgggagggaacggatccacggtgttggatgaggaaccacgtgggcatgctcacggaggaatgccggtctgggcatatctgaggcatgcccagaaccggcgatgtttgtggtgacc

SEQ ID NO: 680200 - DNA, 184 bp, Homo sapiens
ctcatggcaggatctatattggtcattcatgttttcatatagccaacccaccacagtatattcttggtgcttaataaatgtttatcattgttaacaaataaacaacaacaaacaacaacaacaaaacaaaaaaacaaacacaaacaaacaaaaacaaaaaaaacaaaacaaccaaaaaacaaca

SEQ ID NO: 680201 - DNA, 206 bp, Homo sapiens
aaacccctaggaagggagaactggtgagtcttttcaaaaggaggaagtccctcaaaaggggctgtgttttgccaacggcgcccccaaagggctgaaatacttcgatttggaaaaaaaagactccggccctgagggaaggggagggtgcccatctggagtaatttcaaggctttttccgtgttatttgatgtggccccaagtagaga

SEQ ID NO: 680202 - DNA, 1061 bp, Homo sapiens
gtttctgctctccgcccgtgttgagtggtgggggcctgggtgggaatgggcgtgtgccagcgcactgcgcgctccctggagaggagaagtctcagctagaactgagctggcctaggtttactggaagggaggatcatggaatgtttgcagagcggctggaaccagactggtgccgatagtatgtgaatgctgtggctccatggctgccctcctgcttgctgccccgtgctgctgttgctaccgctgctgcttgctgaagctacacctctggcctgcaggttgcgctggcttcctggctggacttggccttttgctggtgcgagctcttgtgcttgcaaaatgtggctcttcgatgcatctgctgccccttggcactgacggatttgcctgactggaccacagagaatgggtcccctgatgggaggggcatagcaaggaccttggacccatgagcgccatcgctgggaaaccttggcaccatgcatgactgcgcacttggtgaagaaccgttttctcactatcacgggcttcgccggctggctataagctaacatccactaaagggccgtgtagtcgtgatgaaaaagataaaaaaggggcatgtattgtcgtctattatcctttaggtttgctggctaaaggcatgtggtggaacttgggtaggtaccccgtggaggggggcgggtgtgaaatagtgaatgtgatgtgggtgtaggagcattagaaggaaatgtgcagaaggcgtgggtaaaagagcgcgtgtgatagctggtaggaaattgcgaggagtgacgtggaaagtggagcgacagaggaataatgtgcgggaagcaaggcgcgttgaccgagcagaaggaatgaagaggacaggagggcccatagtgataggattgatagaatgtgttgcaggggtgatcacacaagtgtggccacgaagtatattagtggagcatgagcaggggaaatggaagaggaggcatgtgaatttcatttttttactaacgctgtgggtgcccagttgcgtagcagaatagtatcgcggaagtaggtatcgaagaatg

SEQ ID NO: 680203 - DNA, 1035 bp, Homo sapiens
  misc_feature (86)..(86): n is a, c, g, or t
  misc_feature (139)..(139): n is a, c, g, or t
  misc_feature (304)..(304): n is a, c, g, or t
  misc_feature (310)..(310): n is a, c, g, or t
  misc_feature (335)..(336): n is a, c, g, or t
  misc_feature (342)..(342): n is a, c, g, or t
  misc_feature (356)..(356): n is a, c, g, or t
ggtgaagcggttgggaaagtgtcggtttatcttcgcgccccttgcgttcttgccgcggcttgctgggcaggtaaagcgcgattgcnagactcggcaaccctgccgactcagccggaaccgctcccggcccgagggtgtnggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgtgtgaagcngaatgngttggccataagacgccccggagannaagctncggggggcaccaanggacggggacaggcccaagatcctgatggacagccccgaagacgccgacctcttccactccgaggaaatcaaggcaccagagaaggaggaattcctggcctggcagcatgatctggaagtgaactgataaacgctcccggccaggctcggccaacggtgtctcgatggacggggggcggacacagcgacagttacttatctgggtccttcaacaactggagtaaacttcccctcacatgaagccaccaataacctttgtagccatcctggattcctgccggaaggagagcatcatgtaccaagttcttcgtcggattggtcagtgtggacgccacgaacccacttccagagcccataagtaaaccagccaaggttgtgcacacgttaaacaacaattcagtcacggtgaacgaccacttgacctttgacgtattggaatgattctactgggtggatccccaatacttgctccgaatggttcgcttgagcctgttacaggttcctcacccaagtaacccttaccagtcaaggaagccctaggttcatgcaaacccgcgagacgcgctttcagggcacccactaatctcacccccaattttcctcacaggtcatcctgacacacctgcactggcgcttcctgctactcaagttgttcccagagcataccgtcatgtggact

SEQ ID NO: 680204 - DNA, 813 bp, Homo sapiens
  misc_feature (11)..(11): n is a, c, g, or t
  misc_feature (86)..(86): n is a, c, g, or t
  misc_feature (88)..(89): n is a, c, g, or t
  misc_feature (96)..(97): n is a, c, g, or t
  misc_feature (108)..(108): n is a, c, g, or t
  misc_feature (110)..(110): n is a, c, g, or t
  misc_feature (183)..(183): n is a, c, g, or t
  misc_feature (187)..(187): n is a, c, g, or t
  misc_feature (190)..(190): n is a, c, g, or t
  misc_feature (195)..(195): n is a, c, g, or t
  misc_feature (201)..(201): n is a, c, g, or t
  misc_feature (221)..(221): n is a, c, g, or t
  misc_feature (226)..(227): n is a, c, g, or t
  misc_feature (235)..(236): n is a, c, g, or t
  misc_feature (252)..(252): n is a, c, g, or t
  misc_feature (286)..(286): n is a, c, g, or t
  misc_feature (289)..(289): n is a, c, g, or t
  misc_feature (299)..(299): n is a, c, g, or t
  misc_feature (312)..(312): n is a, c, g, or t
  misc_feature (328)..(328): n is a, c, g, or t
  misc_feature (330)..(330): n is a, c, g, or t
  misc_feature (348)..(348): n is a, c, g, or t
  misc_feature (373)..(373): n is a, c, g, or t
  misc_feature (451)..(451): n is a, c, g, or t
  misc_feature (529)..(529): n is a, c, g, or t
  misc_feature (565)..(565): n is a, c, g, or t
tggagaagtgnaggcccagggcgtcgtccgagtaaacagcggtgctggccgtgtggaacccgggcccgcttagaaccatggaaggngnnaactcannatcctcgactncngggcccgggcggcggcgctagagatccagcggatgaagcggtcgaagaagccgggttgcgccaggttgttatntttnttnttttngaatangtcggcgcggtcacccaggntgttnntggtgatnncgttcatgttcacgtngctgctcaaggtcagctcggtgggtaccacgttntgnttgttcatgntgttcgccgattngttcagtttgttgttncncgttatgccgtccgtgantacacgaaggacagctctgcgtgcnttcgggccccgccacgcggcatgcgcacgatggcattgatggcgtgcaccacgctgcgcccacgtgcgagagggagtncaggtattgtgtggtctccagcgcctcgtggatggccgtgagggtgtggctcagcgggaaggccacctgctgctcgcnggggccaccaaactgcagcagcgccacgcgtgcgtngagagggtcgtcgtccctccgggccagcgtcaccggccgcgccacctgctccacgaagcgccgggccttgtggaagttctgctcacccagccgctcggagccgtccagcaggaagacgatgtccacgggccgctgcgtgcactgtgccacggacagctctgtttggcagggaaggtctgggcacacgatctgagggtccgggcagaggacgtcctccatgttatcgatgaacttctcagcgaccaggg

SEQ ID NO: 680205 - DNA, 508 bp, Homo sapiens
gtatcaacatggagggaagtggaggtcgctatgttaagtgaaataagtcaggcacagaagggcaaattccgcacattctcatttgtgggaactaaaaataaaaataattcaactcatggagatagagcagaaggatggctcccagaggctcggaagaggaatggggccgggggaagaggtggggatggttaatgagtacaaaaacagaatgagtaagatttagtatttgatagcacaacagggtgactatggtcaacaataatttatcacacatttaaacataacgaaaagtatcactgaattatttgtaacacaaagaaagtgtaagtgtttgaagtgacgggaccccatttccccaatgtgatttacacacactgcatgcctgtatcacagtatcacacatgccttatatacacctactgtgtacccacaaaaattaaaaatacaaattttattaaaaaaaaggacaacgtcctttttttcccccaccaccaaaccaaaccaaaaa

SEQ ID NO: 680206 - DNA, 273 bp, Homo sapiens
cccgactcacactccctcgctactcctcctccactctacactctcctgactccgctccgactttgctcttacttatatagcctgctaggactccggctctgaggttacccgacattgtcattgttgtggatcttctcttcagcttggccttagctcttgctgcggctctatgccagcgctatggctgcggctgcggctcttgtccttgctggggctcctgcttttctccttcttgctccggctccgactctggctccggaagaagaaaatgat

SEQ ID NO: 680207 - DNA, 791 bp, Homo sapiens
gggcagctggaggtagaatgactccttgggttataagagttgcaacgcatgaagtctctaacaatgtatgttcttcagctctgctattcaagtagcatgtactgtgtggtttggtatggtgctaggtccccgggtgtgaagcaaagaccccttccaggggttatacagtctatattgagagcatcgtcagatgtctggcacactttatatgtagatattcgtcgcacgcagatcgatttatggcagaccgtttttaaccgtcctcaagttcctagagcaggtgattctccgccttgtgcatgtctccctccttccgcttcctggtagccttttgcgatttcgcatcgggaaattgaggagggtaaatctgggttcaggagacttgggatggagcagaggataattagaatgtcagggtgaacgtggtgagtaatctgagaaacaatgactaattcttgcatatttttgtagacttccatgtgagggttgttgcagcattgatatttgtgtgcattgtctaaacagagatgaggtggtatcttcagtgtagaacatgtggtattccgctgtgagcaggcacagaagaatagttgaacctattgtctctttctttgacaagattgggtccaaggattcctctgttctctgccattggtgattaaatgacatagccttggggctcttacactgggtaagccaggcaagcaagggtctggtacgcgtctgggggcatatatggggttcccatttcacgtattcacggaaatttgcggttttttccccttgatgtt

SEQ ID NO: 680208 - DNA, 119 bp, Homo sapiens
taacaatactgaacgctgcagctccacaagcgctggcgtgcaggaagaatctaccactttccagagctggtcaagctcaagtgacacaacaccttcacctcccggctccggcgctgcgg

SEQ ID NO: 680209 - DNA, 670 bp, Homo sapiens
  misc_feature (147)..(147): n is a, c, g, or t
gatgccaaaatgaggtagaggctaagtaatcacataatatatgctttacaacataattgttagttaaaatcatggatatcgctaaagtttagggtattccagagtcacagtctctcattcagatgccttatcagataggctctgatnagggagacggagtctcgctctgtcgcacaggccagattgcggactgcagtggcgcaatctgggctctctgcaagctgcgcttcccgggttcacgccattctcgtgcctcagcctgcagagtagctgggtctacaggcgcccgtcaccgcggccggctaagttgtatttatagtagagacggggtttctccttgttagccaggatggtctcgatctcgtgacctcatgatccagccgcctgggcctcgcaaagtggtgggattacaggcgtgagccaccgcgcgcggcccagatggcttattcttacccatcgttaaacgctgaagaaagaggtaatatataggtaatataacagtggaatctatttctaagttatgttgtatcatcgtacctgtgtaattagaaacatatcctttcttttcactttgtgagatagcatgttgggcaggaagagggtttccagatccattatatcagaaaaaaaaacaacaaaaaaccattccactcatcctatggctcttctt

SEQ ID NO: 680210 - DNA, 834 bp, Homo sapiens
tcgctagttctagatcgcgagcggccgccctttatttttttttttaggaataacaaatgtttattcagaaatggcatagagtaatagcttaatcacccttcatctcttatatgccccttcctctctgttcgtgcagcaggagcaaacgatgcatgggtagacataaagggcatggcgaaggtggtacgtgaggacacaggactagcccaccaccttcgtcgctcccggtctcccaagatgacttagcttaatatgagtggaggaggcagatacaagtgtccctctcaatgtagcccgtgattggttgcgctctatagtcaacctagctcatagatggccgacgtggcagcagctggactcgatgatgctctgtgacaacctgaaaatacctgacgttaggggataagagggaggataaagccatgcagggaggatatttaccatccctaccctaagcacagtgcaagcagtgagcccccggctcccagtacctgaaaaaccaggtcctactgcttctggatgctctctgtgggccaggaagggaaaagtgtgggaggaatgtcttccagctgctaacgagaagtctgcacccacttgaaagggttaggagaataaaaaagccagcgattctttaaaagaactgcgaagtggagcaaccagcaggccccttcctgtggactttcccgtcctgggcaagctcagaagcctgacactgaaagctgggttcaaatcctgggtccttcctggcttgaaagactgaccctggaacaatgagtctcctgggtttcttccaggggtaccctacaagcaaacttggggagcctgggaaactcg

SEQ ID NO: 680211 - DNA, 248 bp, Homo sapiens
  misc_feature (62)..(62): n is a, c, g, or t
gtggcgcatctctgacatcgccgcttgcgattccctctaagcaagactaggcaaagggaggnaaacacaaacggggattagaaaactatagtagcatttgagggaggagaggcaaaaagcaatactgaaaaccaagatatcttacttctctacctacaaccttctttgcataaaatgatctaatgcaatccatgtaaaatgatatcaactatagaataagccagccaattttggaataaggagaggta

SEQ ID NO: 680212 - DNA, 100 bp, Homo sapiens
atacgtgcaggttgtacagcagcgcacgttcatcagccccatcaagtgcatagaagccctgaagctggaggagaacgcgttgtgaaacgcgtcaaatctg

SEQ ID NO: 680213 - DNA, 362 bp, Homo sapiens
tctgcggtatataccgtttatgctttgggctctgtatccctgcccagactctcatgtcggattgtggtctccagctgctggaggtggtgcctggtgcgaggtgattggatcgtgggggcggtttctcatgaatggtttggcaccatcccacagtgctggtcttgtgatagggttctcacgagatctggttgtttctaggtgtgtggcgcctccccatctctctctcttcctcctgctctggccacgtggccgtgtgaagtgctactccccctttgccttccgccatggttggaagcttcctgaggcttccccagaggcagagcagaggctgctatgcttcctgtatagcctgcagagccatg

SEQ ID NO: 680214 - DNA, 330 bp, Homo sapiens
agatggagagccgcgtctgtggctgatttatccagaggagataggtggctctagcttcagaggaagtctacaccccattcccatctgcttacaatgtacccagtgatatgtgttgagcatcagtaatactgtagcaggacatcacatggaaaaaatctaagcagctggctcactgtatttcactgaaaagaatgcctacagatgggatatttaatcgggaaaatgaaggcactttaataacaaagcttcattatgtgaatacttgtggactattaacatacaatataccttgtatattaatgccatagttgttagaaacactaatttaaa

SEQ ID NO: 680215 - DNA, 1111 bp, Homo sapiens
agctgagagtgatcacagaattgttagattgccagtgagctctgggaggccgaggcaggaagatgacgaggatcaggagatcgagagcattcctgtccatacttggggatagatcgccgttccttgctagctaaatagagtacaaaaaagactcagcctgggcatgctgggcaggttaggatggaagtcccgagacacgtctgataaggctgggagagcacggtagaatcgggggatgtagaccacaggtgctggtccaggaagcattagctcgtcccgaggacggcaggatttggataccaacttggggatgttccaagacgatgggacgggcacggaaaagcgaaagcaggtccttggtttcaaagaattgacaacactggccgatgcaactatgtcaaccgtgccagataccagaaaaccactcatggagaagacccccgtggggacgacctgtgcccttgtgattcgcgctgtcaaaggaagtgaaccagggggaccgcgagtttttcaccattgggggggagcccaatgacaatggttgcacacaacaattcgtggacgtgcacagggacacgtggggacgccccttgcaacctgggccccgcggggggcctagcaaaaggataactttggaagggcccgagaccaacactttaaacccttctaggggggcacaaatgcaggaggcacgaggggagcaggggaaattacgccaatggcttcgcgcataggagtgaccaagaacagggtaggttcacaatcacaatttcttcaccgacatggtatcccaagaaaccggaggaaattgcacatttggagcactgcttgtgggcaaccaaacgatgggcgatgagcagagggaccaatctttggcgccccataaatttggaggaccctctgtcgcgttcttggtccaacacaatggggtaacgagagcccaggaaacccacaggaggagtgcagaccgagcaacaggggacacccagagacagcatagtaggaccgtgaacacacggcggacaacctggggacggcctgtaaaaagagaccataggccgaccaaccctgggccacaccggggaaccaggtgacaggcgacacggagaac

SEQ ID NO: 680216 - DNA, 131 bp, Homo sapiens
gcgaggtcgcgtcgctggcttatccagcagccaggtcgtagaacgcgcggagcagatacgggcgacgcggcgtcatctgagacatgtccatcgcgcttagccccgggtctgcaggcgcatttcacgctcgg

SEQ ID NO: 680217 - DNA, 414 bp, Homo sapiens
tagcctggatgccctttttagaaactatgtgctatttgatattgatatggtttggctatgtccccacccaaaatctcatcttgaattggaattcccataatccccacgtcaagggcgagaccaagggtggagataattggatcatggggggcaggttcccccatgctgttctagtgagtctcacgagatctgatgcttttatcagcgtctggcatttcccctgctcacactcactccatcctgccaccctgtgaggaaggtgcctgcttcttcttttccttcgtcatgattgtaagtttcctggggcctctccatcattgcagaaataagtcaattcaacctctctcctttataaattactcagtcttgggtatttattcatagcagtgtgagaagggactaatacagatatat

SEQ ID NO: 680218 - DNA, 1664 bp, Homo sapiens
  misc_feature (439)..(439): n is a, c, g, or t
tggaaagggaaatcttatatggttttcttgtataaaaatgtccatcaaataaaggtcaagggggtggggggcaagattgctttattgcgggaaatatacgcgagaggggggcacgccccagcacgccttttcacgccctctcttcttcgggtgcaggcgccttgtgctctcgagagctcccagagaaactccacagggctccgggcattagaaccaggtagaagaggtcaagagggtgtgagaagggctctcaccacagagaggagaggagaagagagagaggagatctcaccacaagaggcgctcaagagaagacaggcgcacacaaatctcacagggggctctcaggcggcgcgtggtctcagacagggtgagagagtttctcttaaaggcggagaggagaggtatatctctctcactatactgcccccttctcaantatatctcacaccacacgcgctctcacgccgtgtgtgtgcgaccactctgcgcagacgctctgcgttcacacgacgcacacgctgtgcgtgtgtgtctcaccacatctcacgccctctctgctgtgtgtctctccatcttcttgtgcagcgggagaacccccccgacgggctctcatcatgagagcacacacctgtgaggaccctcacgtgctgctgagagagccagagaccgtggtcggcacccctgtgagagcagagagcgcgggatgacacaacagaaacacccacaagatttgtgccacaccccttctctgtgggggcccccctatattctgtggtgggatagacctctcacacggcggggcagcacagcgccggggagcatcgtcgccaaaaaaactctctctcatatatatcaccctgtgtgccgtgttactccacccaaagggggcgccctatatatatctccgtgggggcgccaccaacatgtgctcccgagtccccctgtgtgcatcgtagaaccacccaccgcgcgttgcactgtggctagatttcataaagaaaagctgctggggtccccccccaaaaaaatgttcggtgatataccacacgaggacagagcgccccccctccaaagacatctcattccataatattgtcccgcggattcttccgcggcaccaaaatttgccggcgccccccccgccagcgaacatcacaccgaacactcttcggcgcccacgcgggcgacattgtcacaggctggcaaactttcgaactaaagacatccccccagaagagactctcgtgcggaaacagggggggggccaccagcggcccgcacgcgaaagaaaacactactctccccatacaaaaaacccccaacagaggacgccttgggcggaaccacacataaaaccccacaaatatactatgccggagggaagcaatatgaaactactgaggcagctcccccagatgaggacaaacgtagctatcaacgcccccactaataattatgagacgcccgcagggtgggtggcccacgcaaggtagacaccctcttatctagctgactagagacgaccaactttactacaggcgtctctttgcaacacccgtcagcaacgaacattatggaacgaacgctctcttcgatgtgaacccccccccaacacatgaggcggaggcggacaggcacgaaccacccaaaatagtaggcca

SEQ ID NO: 680219 - DNA, 352 bp, Homo sapiens
  misc_feature (318)..(318): n is a, c, g, or t
tacctaatggctgtgtctcgttagtgcttctggcgagcagttttgttgattttaacttttcaggttcagggctccgcatgctgtggtatctaactcccagtttgggtcttatctattgtgtgttcatatatcttacagccactttcgtagtctattttgtgtcaactggagttttttacaactcaggttagttttagctttattggggagggggtgatcttaaacactctttacgccggcttctattgactcggttatcgtgtgaccgcagtggttggcccgaatttgaccaaccctgggtttagtatagcttaattnaactttcgtttattgctctaggtttctccctgct

SEQ ID NO: 680220 - DNA, 483 bp, Homo sapiens
aaagcagtgttatcaacgcagagtggccattacgccggggcttcgtttggaggaaggtagggtttgttctaacgctttgcacaaaggcgggaaacggtcatcaaagctgttgcgaagggaagagccaatgcattaattcgatccaagaggactcgcctcgttggatttgcagcaacctaatctctcgctcaggaagaaaacgccacgataaagagttttctgtcctccttgtttgcacggagcagcaaacgcagagacaaaagaaacgggccccgactgacgggggctcactctgtcccccaggccggagtgcagtggcgcgaccacagccttctgcagcctcagcttccgtgctcaagggacgcgcccgcctcagcctcccaacatgctgggattacgggcgtgagccaccgcccgggaacaacttaattaaaaaaaaaaaagccagaaaaaaaaccaaagaaaacaaaaatacaacacctc

SEQ ID NO: 680221 - DNA, 544 bp, Homo sapiens
aaagcagtgttatcaacgcagagtggccattacgccggggcttcgtttggaggaaggtagggtttgttctaacgctttgcacaaaggcgggaaacggtcatcaaagctgttgcgaagggaagagccaatgcattaattcgatccaagaggactcgcctcgttggatttgcagcaacctaatctctcgctcaggaagaaaacgccacgataaagagttttctgtcctccttgtttgcacggagcagcaaacgcagagacaaaagaaacgggccccgactgatattccaacttaataaaaaggtaatatactcattatgttcctgtttcccagaagacactgcttgggagttctgttctgtcatcaacagagctgtgatgaccgtggatgtcactggtagtggccaacatttctgcagctccttctcagttacatcctcaacacaaactcctcaccaggtggcagaagtggaagaagctgagatgtggctgtgagtcctgacttcactgctgtccagcggaaagagtctgagcagtctaaacccgt

SEQ ID NO: 680222 - DNA, 131 bp, Homo sapiens
ttctccatggatggctttacgtagtttacattcccaccaacagtgtataagagttcctttttctccacatccttaggcagtatttgttactaatatatgtcgtttaataatacacattctcactggggtga

SEQ ID NO: 680223 - DNA, 272 bp, Homo sapiens
  misc_feature (18)..(18): n is a, c, g, or t
  misc_feature (22)..(22): n is a, c, g, or t
  misc_feature (27)..(27): n is a, c, g, or t
  misc_feature (145)..(145): n is a, c, g, or t
  misc_feature (268)..(268): n is a, c, g, or t
tgtctctgggcaaccagnctgnaccancaactggagggaatcagtcttccacttcggtgggccaacctggagacacttcatcctggactccaacccgctggtcctgcgactttcggtctcctgtgggtgttccatcgccgctggncttcaaacttcaaccggcaggcagcccacgtgcgccacgcccgagtttgtccagggcaaggagttcaaggacttccctgatgtgctactgcccaactacttcacctgccgccgcgcccgcatncggg

SEQ ID NO: 680224 - DNA, 197 bp, Homo sapiens
gacggacgaacgacgcagaggctgggagctagtaggtcaatgaggaggcggaggtctgcagccatgcccagcagagctgtaaggcattcgaagatggcgtgaatttcccagcaaggcttggttgccctcaagcagtgcaagcggacaaggccccctctttctgcctgggactgccctggcccctgggagcttctggg

SEQ ID NO: 680225 - DNA, 172 bp, Homo sapiens
ccccgactagcccgacgtgaactttgtctgggagagagctgggaaaattccacagaggtagagcatttatgctgaaaagaagggtaccatcatgaagtcagaaaaaggcatggtgtgtttgaggacaggcacatttcacatagcagaaatgtgcctgtcgggctagtcgggg

SEQ ID NO: 680226 - DNA, 1085 bp, Homo sapiens
ccataataactatgcgtggaggataaaatagcgtgctgaggaatagaccgtggtgagccatgttagacattgacagctcactcgcagaaggtagagccactctacattcaccagacatcgtgaccacgtcacaaccctggaacggagaccatgactgcacgacccaggacagcaactggcccagtctaaggcggctagacctaaagttgtgtaaccaggtctaatcctcatgagctagtatgtttacaggatggtaatgcaggttatagcttaggtaatagtatactagcccacttaagagacaggatgtccagggagttccagagacagcagtgtgacttgacgagaatagacctggcaaatgctgtggcagccctgtaagtacttgatgatggtgtttccgtcttattgttaaagattcaagacttggtggtgaagatggtagttgacttatatagaagtgaggcacagagaatagggctcaggaggcagggaacttaaggccagagtacgtgcagaattcctaacagaacgaaacaccaaggtccgggagcagggaaccgtaaggccaagttaacgtgaactgcctacatctaaaccagaaaaaatacgcaacagcgcggacgaccacgaggacacttgaaaacacgtacaacacgccgccaccaagcagacagcagacgcagaagacacagcgccaacgaagcacagcacataccaggccagacctagcaaggccgacgactgagaaaaatctcacgacctatctggaaccaaaagacacgcaaagacagaatattacaaagaaccagggaccgcaaaaatacgcacataaaaacgaccagatataaggcgagacacaccactcggtggcatcacaacacacccgacacaccacgggccaaacaaaccagtgggcaacatcggcggcatccgtgcaacacacgcggaacacggctacacaaacaaaagatagccacaaagcgatagcaagaccgtccaccctccaaccaaaagacacagaagaacaaaaaacaagcacaaacagcctacaaaacacaacaaggaagagcaaaagcacccac

SEQ ID NO: 680227 - DNA, 824 bp, Homo sapiens
ccagtcaccgaggtcaaagggccatgggcatcttcggaggaaacaaagggccgcacaccgagttccagggtcaacaatggccgccccaaggagggttggccccaccccccgcaatcccgaggggggccacaccaccatccctgtggcagccccacaacctattcgcgcatcaggtccccgcgggccgcacaccaagagtccattcattggcgggcgccacacaaaccctggggcacagatcacccccacggaaccgtgctgcgccgtacgcacaaggggaccaccaaagcgcaccgttccgcgcactcctgtatttggtcggagaagcgcccctccattccctcggcacaccccggggggcaccctcgaggactttgtttctttcgcgccacaactctcgtaggttccacaaaagatacgccttccaccaattgagacgtctcgcgtgtcattcggattggcctcttggtaccacgcctccggaggttccgcgcggtggctgcacacctccccaccactgcgtgccacacttctttccacacggccgcacgctcgtttgtgagacccccatctgttttggtacaattcccccatcaagtctctctgtgttccccccaccctctgtgagaagaagacatttattcctcccacctgttctcctttactccggcattcttcctgtgccccctcgtccacaaacccaccaccaccgagtattcccctccccaggacactcgcgcgtcccctccgcgagcatccaaccaaccaggtgttctataacaccaaaaaaaataaaagcggaattctatcgcccaacaataaac

SEQ ID NO: 680228 - DNA, 444 bp, Homo sapiens
gctgggtggagaaggagacatactactgaccccattggaagaagaaccaggcatggaaagatggggagctctggaggtgttgtggggatggtgatggacagggatggagatagcggacggcatcgcactgcagcacatggggagtgataatgccgtcactcaccaggctaaacaggctgggatataactggatgacattgctgtagacaccgacaacgcaatgattcggcctgacgctgagtggtagggatatgttggactgactcctgattactacgctttacaaggtggcaactagattgggatgatttaaggtgagtccaactgtgtaaatttgaatatatatatatctatatctttcagcatagatcagcatccgcagcgtccggggtggtccagtacgcaattcgctctgagagccgtatcactatactggccgtccct

SEQ ID NO: 680229 - DNA, 976 bp, Homo sapiens
taaacccttaataaaagttaattgaagcacactcactcgtcgacctccccaccccgatccaagcatctcgcgcatgatgaaacttcggctcactccttggcgcctggctgatcgctccaaagtcaccgacaggactattcgctagcgcgatgcactacgtcaccagacgcctcaactcggcacttttcatcaatcgtccacatcactcgagacgtaaattatggctgagatcatccgtctaccttcacgccaatggtgcgcctcagatattctttatctggcctcttcctacacatcggggcgaggcctatattacggatcatgtgtctcgtactcagaatagcctgaatactagtcggcattcatcctcctgtcttgacaagctataggcagacagcgcttctataggctgatgtccgtcccgtgcaggccaagacatcatgtctgaggggccacagtaattaacaagagactgtgactatccggccatccgcatacactggggacagacctcagttcaatggaatctcgaggaggcttactcaatagactagtcccaccctccaaactgattctgtgtaccttgtcacttcatcttgcccttcgattcattgcaagccctagcaggactccacctcctattcttgcacgaaacgggatcaaacaagcccctaggaatcagctcccattccgataaaatcagcttccaccttactacacaatcaaagacgccctcggcttacttctcttccttctctccttaatgacattaacactattctcaccagagctcctaggcgaccagacaattataccctagcaaacctttaaaacccctcccaattcaagccgaatgaatttcctatcggcttaacaatctcgatccgtcctaaaactagagcgtctgcctattatatcatctatctagatatccatctcaatttcaaaaaaagtaattggcataccactttgccta

SEQ ID NO: 680230 - DNA, 672 bp, Homo sapiens
gcgcagacctggacacagagtcaacggtgcccaacgaggaaaacacctggttcagttacctgaaaaagggctacctgaccctgtcagacagtgtggtgacaaggtggcctgtggaatggtgacaaagaccatggggtcctgagagtaccaactggctgtgagaagtgggagagtgcatggagctatcctgacctgcttgttttcaattgcgtgaaactctactccgtggatgacctggactgggcggtacgtctaccagatcgaagtgcagcaaacgccgtgccctggtgtgattcttgtcctgacggcttgactgtgcacctgtggcagcaaacgtgcttcaatgtgcctgacatgtggctgagcagatgcaggaccgagctgtctgtcacgtgtgtgctggcactggtgccaaggagtgtgacgaccactacgggtgatgtggtgaaccgacgaacccggaagtggctcgacacgctgggtgtgagacataccaaagggatgcactcgtagtacaacaggacgaacctggggttgatgccaacttacaacggccattagcagccttgcttcccaagcatccagtcgcaaggcctatatacatacaagagactgactgacggcaatgaccggaaagaaggaatgtactaatgccagccaagcacgcaggac

SEQ ID NO: 680231 - DNA, 275 bp, Homo sapiens
ggcaatatggcaaactctagctttatagaaaatacaaaattaccaggcgtggtagcacatgcctgtagtcccagctacttgggaggctgagatgggaggatttcttaagcccaagaggtcgaggctgcagttagttgagatcgcgccacttcactacagcccaggcgacaaagaccctttcacctaaaagttgtcagatggatattgaggtaaaatcaaggtcccggcttggggcctttgctcatactttttataccagcacctttgggaggcca

SEQ ID NO: 680232 - DNA, 500 bp, Homo sapiens
  misc_feature (37)..(37): n is a, c, g, or t
gaaaccaaaacatagagaggtgtagaggtcaacaagngaaccggccgcatcttatttattacacatggattgacctagagatggaaggaatagtgaattaagatatggtgaacactgtttatcacaaagacccaaaatagcagtggcttaaatctgatagtttattcttctttcacatgaacgtttgagcagctacaggtcctctactatacggaatcatcgagagtcctgtggttcctgtttatactcttgtctatcactccaacataggtccgaaggtaagcgtcaactactcaaggtcgcacatatcccacgtacagtgggggagaggagagacccgcaacaagtgagtgggactcgatcacgagcttttaaagagacaacaaaaccagggggatacagacattgtggccctatctgataccactatacgctgattaaacgcaaggaagttaacactacaatgaactgctaaggagctgaagggacaccagaagagg

SEQ ID NO: 680233 - DNA, 508 bp, Homo sapiens
ggcttttcttctgaaagcaacctttaacaactgtgaaatgttctcatttcatagtgaataactgaaaatagaccctgtactgtttgaaagttcttccctatcatgtggtgaacctatttcacaggatgacatctaatctatctagttcagactacttcttttgaactcctaacttttcattggaaattttttggtgtttgcttatcctaaagcctgaaatgagaaggttattttttgcccttaaaaacctggaaaaatagggggactttttcaccaagggtttgggaaatttctatttcgaatattttcaagctccaaagattgggaatggggaaaattttggaattattcttttttttttcgccccattataacccgccgatggcctcttatttaaaggtccccaagaattttttttgttgcggaccaacccctttcccacaggggggagtgggttttttaccgcccacaccggggggggggaccgggctcttttctcttttcgccc

SEQ ID NO: 680234 - DNA, 425 bp, Homo sapiens
  misc_feature (294)..(294): n is a, c, g, or t
cacgagggggcgcgcctggtcgacgctgggccggccgctcgatccgctgacgcaggacgtctgcgccttctaccaggaccacgcggtctacgacgacttcggcggcgtggtggtcgagctcgacgaaggccagcggatcgccaatgcgctggggcccaacaaggccgtgatcctgcagaaccacgggctgctgacggtgggccgcactgtcgacgaggcggcctggtggttcatcacgatggagcgctcgtgccaggtgcagttgctggccgaggcggcggcggcgcgccgaanacgatctcggacgccgccgcgcgtcaggcctattcgatcgtcggcaccgcgcaggccggctggttccagttccagccgctgtacgcgcgcatcgtcaaggagcagccggacctgctcgactgacgccagat

SEQ ID NO: 680235 - DNA, 305 bp, Homo sapiens
  misc_feature (188)..(188): n is a, c, g, or t
gtgggggtgcctcttcctgggcgcccgccgcctgcatcctgctcgccctgtctgggaatggggccgcccccgctcctggcgcgtggcccgaggtcgccgttgacgctgtgcgccacagtatgggaggacgcgacgcgtgactgaggaagctgagtcggcagtcggagtcgtgccgtgtactgactctnggcagtcagatcgtgggggctcatgggcgcttactcagcggcagtcaagttcagcgagttgcttgtctcgggctcgcatgtggcatgtggagtgcgtggaagtgacagagtaccaca

SEQ ID NO: 680236 - DNA, 116 bp, Homo sapiens
gcaagatggagttagtgcagggtcctaaaacgcgggctgcagcagatcaccgggcacggcgggtcttccgaggctatctacgggtttttttcaggcaaataatgcaaggttggtac

SEQ ID NO: 680237 - DNA, 774 bp, Homo sapiens
gaattgggactatatacaaaattattaattggccaggtgcaatggctcatgcctgtaattccagcacttgagaggctgaggcaggaggatcagttaagcttagaagttcaaaaccagcctggacaacccagcaaggcccgcttatctaccaaaaaataaacaattagctgggcatggtgggacatgcctaaaattccagcaactggggaggctgaggtaggaggatcacttgagcataggagttggaggctgcagtgagcagtgatcataccactgcactcctgcctgggtgagagtgagactctgtctttaaaaaaaaacaaaagctcaagagttcaagaccagcctggggcaacgtagtggagacccggtctctatgaaaaaaaaaacaaaaaaacaaagcaaaaacagggggggggcagggagcccggagaaaagacgtttctgaagaacaacaggcgggggacgcgaggggagccccaagaagacagaaggagaacaagcaggggccacaacggggtgttacagcacggagaaagacccggggcgagagacacagagccggcgggaaatcctcacaccagcaaaataaaagaaacagcggcgcggaggagagcacacgagaagagagggctgcagaaaacaaacgacccaagaagtaggagagcacgcagcagagggagccacactgggcgggaactcaattagaaaagcggggacccacaggaagccaagcgcagagtagcagacaaaaaccagccccggggcgcaggg

SEQ ID NO: 680238 - DNA, 416 bp, Homo sapiens
ttacgtattcaatcggctcgtgcctcatatgtcatctgtgaaatgcaacaggtcggtggtaaattcaggatctagagcactatagagagcctactgcctgggctcaaaagctaccacttactgaacgtatggcctctaaacagttcagttactcaagctctctgggcatctttatttgtcaaatgatgatcatcatactacctatcccacagacctcggtagagttaaactgagattatacatttcaagcacttttgaacaggcttgacatacatatcatctatttccttttttaatttttctcccctaaatattattattagagaccagcaaatcttttccattaagagccagataataaatatattaggcttcaggggcacacatagttccatgttgtctagttttcctgtttt

SEQ ID NO: 680239 - DNA, 261 bp, Homo sapiens
gctccttaaagctctcaggaaacagatactgccatgtctcctgtacagcctgcagagcggtgagccaattaaatctctttacatatgaataacccagtctcaggcattccgtgtttttggccctgaacgtggactctatgcagcttgtttgtccaggctggagtgcaatgggctcaatctccgctctctgaaatctccacatccggggtacgaggcattccccgtgccccatgcctcccgcagtagctttgaacgagcatt

SEQ ID NO: 680240 - DNA, 969 bp, Homo sapiens
agcggagtcgcccagccgcctggccagtcctacagcaccagctcgcccatcaacatcgtcgtgtcctcggccggcctgtccccgatccgcgtgaccatcggcccgcccaccgtgcaggtccaccatctcctccgtcgcccatccacgcagctgagcgccagcagtcggcacgtacgccaaccgtggtcgccacaccaagcgcctggtccacgcgtccgagcagatacagcgaagcagctcgcgaggagctgtatgcgcacggacacacctaccagaggccgggcagcctggcagctggttcccgagcctcatacacgcagaccagcatgggcacactgggcccagagttgacgggccctgacaggtcgaccagaacaagcacatagatcccatctatgaaggaccgagtctatcagaagccccctatgagcgcagtcatgcggacacagagccagggggaccccactgccgaccagacacagaacggggcctgaacggcaaagagcaaaagaaccccaaacactaacacactgacgacggcagcacgtcacatcaccccatggacagaagcacaagagcaagaccgagcaaacgcgccgcgcaagacagcgaacaacacaggcaccaccactcacaaaaggcgcaccaagccgccactgtacaccacaaccgggcaccaccaggccccacccgaccagaccgccagcggacagcccctgagacacgcaggaagaagacacgagcaacacggacaacataccgaggcacagaaacacgacaacgcgaagccagaaaggaagcaacgaccccgacgagcacagccacaacgagcagggacacgaacacgaggacacacacatagacacaagacagcgacaggacaaacgcgcaccatgccgcaacaaggactaccaaacacaacaaagcacaccacaacacacacgcacggcacacgcgaccacccccacc

SEQ ID NO: 680241 - DNA, 973 bp, Homo sapiens
ggccatctacaaagggaaccccatgaggctaacagcagatctctcagctgaaatcctacaagccagaagggattgggggactatatttaacattattaaagaaaatcttcaaccaagaatttcatatccagctaaactaagcttcctaaatgaaggagaaatgagatcatttacagacaagcaaattctgaggtaattcattaccaccacatctgccttacaagagattttagaaaggaggactaaatatagaaaggaaagaccactacacactaatacaaaaacatacttaaacacacagaccagtgacactataaagcaaccacacaaacaagccaacataataaccagccaacagcacaatgacaagatcaaatctacacaaatcaatactaaccttgaaagtaaatggacaaatgccccaacttaaaaaagggcagaggtgggcaaggcttagattaaaaaaaaaaaaacaacaaaataaaaaaaaaaaaaaaaaaaaaaaaggagggaaccccccaaggggtttgtgtgtgtttttgaaagagacccttttcaccttagtgtggacccctttctttgtttcacataaaaaagggggggggggaaaactttttccagattttaaaaaaaaaaagggggggggggggaaaaaatttcacccccgggggggccccccaattgggtacccccttttttgttaaaaggggcccaaaggggggttaataaagcaagcaacggggcgggtttaaaggttggtgtcgggaaagacggtcatctggaacttggaggagacctttttcgggcggcgatcatgcgacacacccaacatttaagctcgggaaaaaacgtaggtaaggggacccagcatattgctgaaatgctcggttatgataccagtgttcgatgatcgggaggggagtaaagatagagtgaggagtgtgaactgatgacgaggaagagtgatgagatg

SEQ ID NO: 680242 - DNA, 469 bp, Homo sapiens
gtgtgattgtgagcaagatatttatctctttagcccttggggatcccagctgagagcaatctcttgcattttttgacccgtgtatgtacagatatcatttcttgtgtatgccatgacttgaaacaagtccgggaagctctttagcaatatcagctaaacaggatatgaaatcacaggtgatagcagtcgtcattcagtaatttcctacaagcagaccccaaaggaactatagtcctaatctttactatccacttctaaatttaattgtgaatttccatacatgtcatcagatgtctgctcgcataacttttataaacacattattcatcgcggagtttaacttccagattccatgctatcggaatggtgtcgggctaccatgcaagaaacttggaagcaaacacacggagggaatgcactgctgcataagtggacccaaatcatcatttgcatgcaatgagaaattatt

SEQ ID NO: 680243 - DNA, 113 bp, Homo sapiens
tatctctaacattaaaggtataattattacaaatagtagttcatgcaacagattgaatttcaagaacagatatgagactttgcgttccttgattagtggagtaccgagactcg

SEQ ID NO: 680244 - DNA, 352 bp, Homo sapiens
cgcagtggctcacacctttaatcccagcactttgttaggccgaggcaggcagatcacgaggtcaggagatcaagaccatcctggctaacacagtgaaacccgcctgtactaaaaatacaaaaacaaaattagctgtgcgtggtagcggccgcctgtagtcccagctactcgggaggctgaggcagaagaatggcgtgaacccaggaggcggagctttgcagcgagctgagatcacgccactgcactcctccagcctgggtgacagaacgagactcagtctcaaagcaatttcggactatctagtgctgaagacatgcatactctataactctataactcaatattccccctg

SEQ ID NO: 680245 - DNA, 311 bp, Homo sapiens
taaactgacgcgatagtcagacggagtctttcatgctgccactgacgtcaacttaaaatgaccacgttttcggagaagtgctgcctggatgtaccattttcggttcctgcagtcgaaggcaatgactccattctcatctggttcccatttaatcccttggtggtacgtgttcgttggtacttggacgtcacttagactggatgttcacaggcaaattattaaaatggtcatttggggctaagatgaattcctttcccagctccaaaaaattcccgtcttggtccctttcatttatcagcacagcattgaag

SEQ ID NO: 680246 - DNA, 177 bp, Homo sapiens
tacagtgtgatgtctaatgatctgtgctgtataaaaacattaacccttgtatcaaaacagagatggataaactgggtctttctaagtggtaagaatgacctgtcactatatatactgtatgtctacattttatttatatttaatctcttatgtatagggtgataaccttccccagaa

SEQ ID NO: 680247 - DNA, 425 bp, Homo sapiens
acttcctcaacagggcgctggatatttttaatacctccctggtgttccccatctactacgtgttcttcaccacggtggtcgtcacctcttccatcatcctcttcaaggaatggaacagcatgtcagctgtggacatcatgggaacccttgctggctttgtcaccatcatcttgggcgtgttcatgcttcatgctttcaaagacctggccatcagctgggccaacttgccccacatgcacaaaaacccaacaccacctactcccagcccagagcccactgtcattagactggaagacaagaatgttcttgtggacaacatagaactttccagcaccccatcaccagaagagaagcccaaagtatttataatccattcgtaaagctttgaatacaggagcgacaggatgagcctgacagtacagctt

SEQ ID NO: 680248 - DNA, 119 bp, Homo sapiens
gactatactcagcgggactctcgtccaaccggtgtcttctcagaaagcagaggacccagctctgaccaaaccacataaccttggatccgtccgctgtcatcctccatggtgctagagga

SEQ ID NO: 680249 - DNA, 119 bp, Homo sapiens
ctggcttaaggagaaggtgacattgtcagctctgacagcgtcacccagatgtctccagcatggtcctgttcctccttcactgtgggtggctaagggatcaggctggagggggccgcgcg

SEQ ID NO: 680250 - DNA, 1546 bp, Homo sapiens
tctttatctttttttgtgggtgctgattttgtgctctgctgttgtgtggcatcctcctctggtgtctagtcttcttcttctagtggggtcggtctgttgagagatagctggtggtgatcgttttaggggcgcctctctatccctcgccctgttgtgggcgcctttttaattccgcgtgtgtgggcattctttatgcggtaaccctcgtctgctcgctcgtgtgtcacggctggtgttgttgtgtgtccccctattggagcctccctttctccactgggaagatttttgttggtgacggtgggcccccggcgtttgtgccctcttggtgctcgtgctgtttgaggggtggttactcaccgctgctgtggaaaggttgttgggctgcaccagagctgctctgtataggcgccgccccataatttggtgtcccacagaaatgtcgcacaatttgtggtagattataggtgtgggcaccccgtgggatgttgttgtgatactttgggaaacagcgggaacaccctttatttaatctgtgagtagagaggttgtctggttgtcttctctatcgagggagttgggggggaagagaaaggcggcttgtgttgtaaatgtccacagaagagtgtgtcatgaagagcccctgtagttcctctctcgtttatttttttccggcgaaaatatttgtagagctgtttaagcttttagaggctcgttatatctcgcgcagatagacctgcccctacgtaatcgacatttgggggaaactctcccctctgtacacgccccccttaccgagggacccctcctctgggagatatataacgcccccatgaatggtgggaaatatgcacagaggggagcttctctcgagagggtggcccacaccccccacgaaagccctctttgtgtagaaagagtgaatgatagagacagtgttttgtgtaaataatatagcttattatttttaagaatattctacacttgcacagagaagcactggtagagagagagagaagagatataaataaagaaccccccactttggggtgtggggggtgtggggggaaggcccaagcggtgttaacacagagagtgataccacacactctaacggggtttttgtataaatgtatcctccacattctggaattaccctctgttatattgggaccacctatattttcgtcacgcacctatcacccggtggttgtgcacattgtgcttaagaatggccacgcgagaaatggagaatggcccacacacatgtagaaaggttaatgtttggcacacatgaacttctcgagaaagagattttgtataaatgatttttataaactcttgtgttgagaatggggccctccccctctcttcctctctgctgtttttttaaagttttagaagccacagaaaggccctctccccacccctgcgtttattgggtgtgtaattgtattgtaaatgggatgacattaaccctaactgtgctgggaagaaattgtgccctgaaggtcctttaaatttttttaattaaaacaattttaataaa

SEQ ID NO: 680251 - DNA, 222 bp, Homo sapiens
ccagacgcaccaaggagggactgaatgattcactttggcattcgactttcatttatgctttcatttcatgtaacatgtagctattccaggctccaggctgaagcaaccatgagcctctgcctacgagtagctcacagtggtctgggcggacacagacatagagatgcatcgagagcaagcccagaaggactggctgacaaggcttcctgtaggaggagactg

SEQ ID NO: 680252 - DNA, 126 bp, Homo sapiens
gagaagtaggaaaacatacgtatactgcatatagtgcattatcaccatgaagacttttcagcatgtaagattaagacaggacagtgctttaaaacaattgcatggatttgggtttgcctattcaaa

SEQ ID NO: 680253 - DNA, 278 bp, Homo sapiens
gctgccattcctaactgcaaaatggatgttataaacagaaccttcacttccttccatggggaactttcaaagagaagtcatctgagggtgtctgtaggtcacatgcctgcatccaagaaaacatggagggtgggggcggtggctcacgcctataatcctaactctttgggggtccaaggtgagtggatcacttgagcttaggagttcaagactaccacggcccacatggcaaaactccatcactaccaaaaaaaaaaccaccaccaaaaaaccaggat

SEQ ID NO: 680254 - DNA, 862 bp, Homo sapiens
  misc_feature (464)..(464): n is a, c, g, or t
taaaaacccccttcaaaaaagggaaacttccaaaaatatccaccacccccttttacaaaaggccagtttcgggggggggttccaaacccaaagggattttgggttttaaagggaaatattattgggggagatagaacgcaaattaatgggagaggactgttgagcccccaataattggccatagaatgcccgggggaacgccttttgtgcctacacacaacaattggtttagacgccggataaaatggccgtgcggagaaaatgttgtagaaggtgagaacatctcagaagatcacttcttagcagcgcctttgatcgagcgagggtgtaaacatatgaaacaccctcagataacccactgtgtacaatcacacgccgtccgctcgagacaataatactgaggcgtccacccgtgtggcgtgctacctctacataccaacaacctaatggaggtgaaaccccanagcgggatgcgaatgacagaccaaccacccaggaagatatcgcacaaaaaaaacaaccggagatttgctcttaactcaaagacgtgagggacacccctcaccaaaaggagagcaatcaccacaaccggcggggatagaccatcccccttcagtacgagggggcaccacacggcccccactccgctaaatatcgcgaggagcgatacaaagcgagaacaaacgcgtagcgaacatagcacgacaaacaagcgggcccccaaacaaaacaaatcttcggcgccgcacgaacacacaaccaccctcctcgcaacgaagcaagcaacaacacgaccattcaccccccccatcatccaaccgcgcacttctggaggaccaccgcagatcggctatcaaagcgc

SEQ ID NO: 680255 - DNA, 184 bp, Homo sapiens
ccacttctcagaccgggtgctgtgtgtgctgtgcgtttgtgtgtgtgctgtgctcgtgtgtgtgctgtgttcatgcgtgtgctgtgtgttgtgtgtgtgtagctgcggtggatgcatacaagtatgacgtgctttttatggatgggacattgagatgtaacgatttgccgcaggtggacgcggg

SEQ ID NO: 680256 - DNA, 342 bp, Homo sapiens
caggcatggtgggtcacacctgtaatcccaacactttgggaggccagggtgggagaactgcttgagcccaggagttcataccagtctaggggcaacatggtgagaagttgtctctactaaaagtaaaaagaattagctgggcatggtggcatgcacctgaggtcaggtcccagcgacttgggaggttgagaggttggaggattgcttgagcccaggagatgaggctgcaatagcatgatcacgccgctgcacttcagcctgggtgacagagcgagagcctgcctcaaaaaacaaatatgtttcaacttttttataataaatatgttcattttgcaactagca

SEQ ID NO: 680257 - DNA, 229 bp, Homo sapiens
ctcggtttaacccattcatgattgtgaaaatcctcgtggtctccactgtaggactccacaaccatttacccatgttctaatacaatcctagtgactcaaggcttcaacaaacctaaatgagccagcagaaaaataaacttgaacatgaatgtcaacgtttacccacatgtactacagggttatcataattatgaaatgtatatatcaaagagcgttggtaatttaaacc

SEQ ID NO: 680258 - DNA, 110 bp, Homo sapiens
ggcaggtccccatcgcaggtctgcccttgctaactgtgagacctctccgatcatgtcatgcacacatcatgaagccgcacattttcatgcctgctgcgaaggtgcctact

SEQ ID NO: 680259 - DNA, 208 bp, Homo sapiens
ttgatattgtcaaggaattctaccagccatgcatatttgtgcaaatcaaaagatggattgagcaataatggtgcatctttcttcgccatccatttaataccttttaacacagtggatttttgattccacacttcagcattacacgcagacagctgtccaccattggcaaatgatgtttccattgcgggaaataaatgtttatcaataa

SEQ ID NO: 680260 - DNA, 646 bp, Homo sapiens
gcctgctgccacctctcagcagctcatgtttttccggcgatccgatcgtctgcgtttatctgccgcgatcgctaagggacaggacagacgatcgtcgccgctggctcattgacaatgacacctgggcatgatgcaaaggtcgttggtttctgcttgagtgaccgagcggctcgccctgaaccagtcgtattcccttaccgagtcgctcgcggtctgcaccctagaactagcgcagaggtcgctctatcgcggtgcgtgcgaatggcgcctaggaaagggagctcgcatagcagatgcttcgtagggaaggacgccagaagccaaggctgtgggcaatccttgcacgcgctgaaaggttggcaccacttggaagcataggtcctcagtcaaccatgcttggagaacgagtatgagagtaagatctgggggctactagctttctagcaactgaagctgtcgcgatggtcccggggaggagcaacaagtggtttggttgaactgtatgtcccgcacgtgtaatcgctcagaggacgtaacagatgacgaccgatagattgcgagattatagtgacgatgatcgttacatacattcccttggacattgttatcgtcgggacattcgaaggcgcaggaggcaagtcgccgg

SEQ ID NO: 680261 - DNA, 179 bp, Homo sapiens
  misc_feature (16)..(16): n is a, c, g, or t
  misc_feature (37)..(37): n is a, c, g, or t
  misc_feature (46)..(46): n is a, c, g, or t
  misc_feature (52)..(52): n is a, c, g, or t
  misc_feature (62)..(62): n is a, c, g, or t
  misc_feature (79)..(79): n is a, c, g, or t
  misc_feature (102)..(102): n is a, c, g, or t
  misc_feature (107)..(107): n is a, c, g, or t
  misc_feature (109)..(109): n is a, c, g, or t
  misc_feature (123)..(123): n is a, c, g, or t
  misc_feature (133)..(134): n is a, c, g, or t
  misc_feature (136)..(136): n is a, c, g, or t
  misc_feature (179)..(179): n is a, c, g, or t
ctaatcagttacgagntgaactagagaaacatggttntaagatggngacttnatagcatccngaagaagtgttgaagtnacctaaacttgacctgcttaatncattntngggcagagaacccnggatgggacnntnaaaaaatgtgtttatttcattatctgcttggatttatttgtgn

SEQ ID NO: 680262 - DNA, 246 bp, Homo sapiens
cgagctcggcacggctctcgtgaactcatttccattggtcagtacaaaaaaaagagattcttaattttagattagtctttttattttctgatagttttataaactctaagtattggcagggaaatgtatagatgcggaagcaacccctaaaattgagcatctatggagagcaattataattcactacaaaatgtacctgaatttctttgtcagagtcaataagtctcacgagcagtctcacgggga

SEQ ID NO: 680263 - DNA, 233 bp, Homo sapiens
  misc_feature (94)..(94): n is a, c, g, or t
  misc_feature (225)..(225): n is a, c, g, or t
cgatctcgtatgaacgagcttggcgtgtggacatgccgctcatgacgagactatgcggaagtcgcaggaagaagttgtcgccgagctgcagganctggtctatcaacatccggccactggcgcgtggcagacccgcgatcaatatctgtccggcaacgtgaaagagaagttgtcccaggcaaagatcgccgctcagcaagatccccggtacctggcaaacgtgtntgccctca

SEQ ID NO: 680264 - DNA, 644 bp, Homo sapiens
atactttaagttctgggatacatgtgcagaacgtgtaggtttgttacataggtatacacatgccaggtggtttgctgcacccatcaacctgtcatctacattaggtatttgtcctgatgctctccctcccctagacctccaccccctgacaggccccggtgtgtgatctcccctccctgtgtccatgtgttctctttgttcaactcccatttatgagtgagaacatgcggggtttcgttttctgtttttgccttaatttgctgagaatgatgttttccagcttcatccatgttcctgcaaaggacatgaattcatccttatttatggctgcatagtattccatgctgtgtatgtgccacattttttttatccaggtgttcattgatgggcattttggtttggctccaagcttttgctatttggaacagtggctggaaggaacattacgttgcatggttcttttatagtaggatgatttattatcctttttattttatagattaaagaactggggcttttataaaggtaagtcaagaagataccagctcttaaattattggttttagaaactttcaacttggccttttatttgacttaagaacactttatatttaaaccctttttattttcaggtcttatttccc

SEQ ID NO: 680265 - DNA, 210 bp, Homo sapiens
ggaaacccccttataaaaacccttatagtaaatgggggcattccctataatgatttaagaagctccagattgtcatagttgttttcctgctttacaaaattgctccagatttggaatgccagtttgacctttgttttttaaaaaatttcctttttttcccctctttgaatctctgtatatttgatttttaactaaaattgtttttttaaa

SEQ ID NO: 680266 - DNA, 233 bp, Homo sapiens
  misc_feature (43)..(43): n is a, c, g, or t
  misc_feature (46)..(46): n is a, c, g, or t
  misc_feature (77)..(77): n is a, c, g, or t
  misc_feature (134)..(134): n is a, c, g, or t
  misc_feature (187)..(187): n is a, c, g, or t
gatgttaccaagtttgccctctatacctgggattcatcccagngcncacccttcacctccaagggcaacttctaccnccgggaaatattccttggagtttaggagcatgcataacccaccttcatctagttttnctggaccctctcaaccctgctgtttactttccatccacgggaaataccttttnttgaagaagaaggtcatagactagacacagttagagaaaggagaga

SEQ ID NO: 680267 - DNA, 318 bp, Homo sapiens
  misc_feature (26)..(26): n is a, c, g, or t
  misc_feature (70)..(70): n is a, c, g, or t
ccgccccttccgttttccctactttngggggcccctccctgttgttaggaccggactccttattggttantgatgttttgcggtatcacccccaactttcataaacatcgctcccaacccaggttttggcgggttaaaaaaaaaatgaaccccccccccaggaatacccatcattgtttggtatttttgagttcaaaataattatggcctagtagtggaaagggagtagcatctaattagtattttttagtccaccttgttgaccaaaaaccaaatgatttagtcagcagaattttgggggttagagttccttgttta

SEQ ID NO: 680268 - DNA, 206 bp, Homo sapiens
cacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagtataggttttttctttcaacttgatctgtagaaaatggacatcaagtt

SEQ ID NO: 680269 - DNA, 91 bp, Homo sapiens
ggctcgcgagtagatacccatttggaaaagttcctcaagcatagacatgcaacacctaaggcaagagaggaaaaagaaacaaaggatttac

SEQ ID NO: 680270 - DNA, 143 bp, Homo sapiens
  misc_feature (105)..(105): n is a, c, g, or t
gccgggtgatggccaggaaggtgccctctgttttttgtaaaacagccattggcctttgtcattgagtcaccacctgcagggcttgggagtgagcgttgggtaggntcaggcccccagaaccgcctgggtactcaccgctagca

SEQ ID NO: 680271 - DNA, 1009 bp, Homo sapiens
  misc_feature (1009)..(1009): n is a, c, g, or t
ggaagtggacatgcagttgttaaatcctgccgtggcaaatccgctgacgcaccggcgtgatgtccaggaagataggacgacctggaaatccaactagttccttaagatcatccaactatggatgattatccgaaattgtttcatggtgggagctcgacaatgtgggctccaagcagatgcagcagatccgcatgtcccttcgcgggaaggctgtggtgctgatgggcaagaacagcatgatgcgcaaggcatccgagggcacctgtgaaagacaacccagctctggagatactgctgcctcatatccgggggaatgtgggctgtgggttcaccaaggaggacctcactgagatcagggacatgttgctggcagtaaggtgccagctgctgccgatgcctggtgccattgtgccccatgtgaagtctactgtgccatgccaggaacaggtggtctcgggcccgagataggacctccttgttccaggcttgaggtatcaccactagaaatctccaggggcgcattgaaatcctgagtgatagtgcgaagctgatcaacgagtggagagaaagtgggagccagcgaagccatgctgctgaacatgctctacatctccccgcttctcctttgggctggttgtccagcaggtgttcgacgaatggagcatctacaaacctgaagtgttgtagcacgaggaaactctgattcttcgcttcctggagggtggtcgcatggtgccgtgtctgtctgcagaatggacccactgtgctagtacccatctatatcaacgggtcaacgagtcgggctggttggggaggttaacctcccctgtgacaggaagcttggggacacttgcttgtgggggccctgtgttgtcacacgctcttggtgacgccacagagagacgaatctgggggaattagctctatacacaacacacattagaaagttctaaaaaaagggatgctcgcctctctactgcttgctgcatactatatattcagcatcagn

SEQ ID NO: 680272 - DNA, 146 bp, Homo sapiens
cactcttgttcttacagctgctccttgttatctccgtgaggctccagacgtgcgcagtggcacgctccttgttcctccgtgccacccggatcaggtgaccatggaggctcccaggaagaggatcaacaccataactaactgccccg

SEQ ID NO: 680273 - DNA, 193 bp, Homo sapiens
  misc_feature (11)..(11): n is a, c, g, or t
gcggatcgcanctggaaacgctggagaccttggcccgatgagcaggattcgtcgtgggcctggcaggtacgccggcacagcaggccagcgacatcatcatcgcgcttgaaagcgccggtcgcgcctgacgctccggctcagtggatcttctcgccacgcgcgagcatcgccaccagcttctcgccataagcgc

SEQ ID NO: 680274 - DNA, 449 bp, Homo sapiens
tgaaattaaatatagagaacaacaattaggtatccacatgggtggggataatatttacaaagtattggtatggggcttaaatggcttatgtatgtaaatatcaagcattgtatacagcatataacagacataatagtaaataacagtagctattataattaataataaatgtacaagtcgtattagtatacccactagtagtatataatctcttggagctagaatagctctaaaatgtcattttgcccaaaacgcacatcaacaaattccttctatagattttaagcaggaatcatctagcaataggaatggttactacctgaatcctgccagtgataggacaggtcaccacttaatgctaacatgttttcctcataacaagttgaagtctgtctccctgtaatatctacccaccaaatctatacaataaaatcaatactcctgcaaaa

SEQ ID NO: 680275 - DNA, 641 bp, Homo sapiens
ggacgcgtgggtccggacgcgtgggtcgacccacgcgtcgctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccacaaaaaaaaaaaaaaaaagatgccgcaacccacaagtcaatgaccaggtccctcttgtgtgggtggctgcatctgggctctccgttagccccccttccaacttgctccaatcgcttcctgcctgtggggtggcaggaattagagtgcgctattcccggtttattaacccggttctgcagaaacctatttatataaagattttattaagacagggacaacaatatagaagaacacgtacataaaagacacaaataaaaacaaacacaaatcaaggcgcgcccacaaaaaaacatcccg

SEQ ID NO: 680276 - DNA, 414 bp, Homo sapiens
cttttacgtcggccttttgagcgtctgggcggttgttaggtgagtgggtattgcgggctagtatccgagcgatggtggcgcaggccgagttaagagctttaatcctgtgaagacatcttagtgaagagtttagagtgctgagagctgaaagcttgcacgtgcgcgtgcgctcgtactgccacatgtactgaggttgagtcttgacgctcacaggctcctagttttcgcgtgaggcaccgctcttcggccacgctcgcccgacttcgctgcttccggtatgtgccctcatcgccgtcgcaattcacctttactcgcgctgcacctctagcccctacccttctatcctcctttcttcctctccccgactcgtcttccccatccagtcttccctaccctgcgcactcccctcccttc

SEQ ID NO: 680277 - DNA, 82 bp, Homo sapiens
caaaaattcaaatgtcttcttaaaacctccacaattgattctccccctgtgatgtaaacttagatatccctaaaaaaaaaaa

SEQ ID NO: 680278 - DNA, 693 bp, Homo sapiens
  misc_feature (92)..(92): n is a, c, g, or t
  misc_feature (157)..(157): n is a, c, g, or t
  misc_feature (159)..(159): n is a, c, g, or t
  misc_feature (205)..(205): n is a, c, g, or t
  misc_feature (214)..(215): n is a, c, g, or t
  misc_feature (236)..(237): n is a, c, g, or t
  misc_feature (246)..(246): n is a, c, g, or t
  misc_feature (248)..(248): n is a, c, g, or t
  misc_feature (282)..(282): n is a, c, g, or t
  misc_feature (286)..(286): n is a, c, g, or t
  misc_feature (341)..(341): n is a, c, g, or t
  misc_feature (352)..(353): n is a, c, g, or t
  misc_feature (405)..(405): n is a, c, g, or t
ccacgcgtccgggctaattataattcagcgttatttaagcacataaagaccaaaaaaaaaaaaaagaaatccaaaagatccaaacttttttnaaaccttaaaaaatctcttggtagtatgtcagtggcactttttttctgccataatgtaacgtagntngccccgtcaaaaattcaattaaaattcatgggccagcaatcctgtnccccctcannatcctgatttaatttccctgnnggctttggntngcttctccatttaatagttactgaactttatgcntgtngatctatatggatttcactgcagttgaatgaacaaattatttcagtggtgacagncatgactcaanntcccaattagcttgaaaagggtacttgggaattggtcccatattaatcaganatgggcaaaaggaaaaagttctcatattaccagggtggaattggtggtctcatttcaaatttttaatttaaaattatgggtttccattttggtttaccttaaagtggatgcttaaaagtgggcatgtaattaggacacttaggttggtggaaagcatttcgacattggtatacaaagaattggtgataaatatatccaggtggctcaaccaaagaaccttgttttaccaaccttaaatcagattttctacctgatagtttcactcattatactcagaggagagactgt

SEQ ID NO: 680279 - DNA, 842 bp, Homo sapiens
ggagagagagaactagtctcgagttttatttttttttggtattagttaattcataatcataaacttactctgcaatccattaggcttgggagggaccccggaaaacttggaacccaaagggactctgcgcgaaaccccaaagattctaggatactgcgagcacaaattgggttggaggggtgctctcctgaggctacagaaggaatgatctgggtggctaagataacaccacaagtcacacttattcgagttgtccacagcagcactggctgccatctccttgctgatcttgccattccgtggacccaaagcgctccagtggcctcccacaactatctcactgcctctcttccattttgccaacccaccaccttggcttgccacctccacccactcagctctggcgcagtgccctctcaacaacctgggacccatttggcgctcggcctccccgcactttgcccctgggccaacgctcccaggccccgtaatcgcttcagcgcatgcacgtccctcctcctccacattctcccccatccatgccctcccccccggtcgcattatggcgtgtgaagtcccacccctgaccctaccccctggcaatactccctgtgcaccgctgtgaccccatacttgtgccccccgccccgcaccctgggcttctccccacccctgcggcctcctgccccacaacaccgcggcccctgcatgctcacgccggacgccgcgcacccctgcgcccgcgcacccaccctcacaccgacttccgcggccaccctactcctgactcccgtctgccccgctgggtcatacacgctcgccttccgcgctcaccccctccc

SEQ ID NO: 680280 - DNA, 100 bp, Homo sapiens
ccctggcagggtaatataaggaggtgagatatgcatggcttggaggggggagccatcttatgtaagggcaggaggaagagagccgggaggggtaccgagc

SEQ ID NO: 680281 - DNA, 404 bp, Homo sapiens
cacaaatgagaaaaatgaagcccagggaggttaactaatttgcctaaatcaccagcctagtaagtggtggtgccaatttttggaccctgacagtctaactccagagcctgaaactttaccagctgtctccgctgtggtgcaagagaaatgctgaccatggcgatgtgaattgtctgctgcattagtagatttaacaaaggcatttgatttgttaaatgggttccaatgtagaaatgataccaaagatccgctttctagggaagctggtgcccccatttctttccccaggggattatcctttgggttttccagcccgaggaatgttaaccgcctagggtgtgaccggttatcccaacaagttcggtgtcctctacccataaatttagtttacagatttcagcaaa

SEQ ID NO: 680282 - DNA, 192 bp, Homo sapiens
gtgaatgcccatatttttcttttattgtctttcatattactgtgcacttttctcttcattttctatacttacataagctatccattgattaatgaaatcgcttgtcttcacttttgtctactcgagtagaccacgagtatcatagagagcattatatctttgcgctcattgctgcatccagggtctcaagtg

SEQ ID NO: 680283 - DNA, 444 bp, Homo sapiens
  misc_feature (23)..(23): n is a, c, g, or t
  misc_feature (28)..(28): n is a, c, g, or t
  misc_feature (68)..(68): n is a, c, g, or t
  misc_feature (106)..(106): n is a, c, g, or t
  misc_feature (114)..(115): n is a, c, g, or t
  misc_feature (117)..(117): n is a, c, g, or t
  misc_feature (126)..(126): n is a, c, g, or t
  misc_feature (133)..(133): n is a, c, g, or t
  misc_feature (145)..(145): n is a, c, g, or t
  misc_feature (377)..(377): n is a, c, g, or t
  misc_feature (397)..(397): n is a, c, g, or t
  misc_feature (413)..(413): n is a, c, g, or t
  misc_feature (431)..(431): n is a, c, g, or t
agccccagccaccatataccccngcagnttgcactttaattgatggtagttcagttggggtccctgcnctatggaagttttgattgatttacttgcccgtcccacncctcttcnnanctcaatganatctgangtggatcgccangttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcagggcaaaaagggaggagttttctngtcccttttcccagggtttnaccactccaaattttnggtaatcccttttccaangtgctcttttcta

SEQ ID NO: 680284 - DNA, 513 bp, Homo sapiens
ctatgtcgtgtatgtgtgtaggttagctgtatgttgtcaagatgtgacagcaagccggccatgttatgtaattgtcacaagtcgtaattatgaaggactttgatgtacatgatctgtcttcttaattgtttatgtttgagtcaggaatgaccttgatgaaattagatcactaaaatcagtcacaaaagcaaagttggagtctcgtcagtctgaactctctcgtctgtgtcctgtgagaatggtttcatgtcataaaaagcatcactttcgtttaggactgagttgaatgaataatcgaatcgcaagtcttgtctgtgcattaaattgtacccaaagtattatgtttagaacctaaatatcaacacagtaattttgtgaaattaatcttgtgttatcctttatgtgcatccaagtctgtcagaacagtgtttcgagtcacacgaaaaagtcctacggttttgttaaaagttttattcctgtacatgaaataaagttgaccccatagtaatgcta

SEQ ID NO: 680285 - DNA, 438 bp, Homo sapiens
  misc_feature (235)..(235): n is a, c, g, or t
  misc_feature (248)..(248): n is a, c, g, or t
  misc_feature (288)..(289): n is a, c, g, or t
  misc_feature (340)..(340): n is a, c, g, or t
  misc_feature (388)..(388): n is a, c, g, or t
aggggtcgggctcggccgtcgtcgttgttgtcgccgcatccccgcttccgggttaggccgttcctgcccgccctcctctcctcccttcggacccatagatctcaggctcggtccccgcccgccgcagcccactgttgacccggcccgtactgcggccccgtggccaccatgtccctgcgcggaaacggaagggagatctacaacgtatgaagctgccctaggacagtctacgcgnatagaactggagntagtgcggccccgataagcgcctattcgcttgggcgctgnnggcagcttcccgtggcaggagttacagacaacagaggtatcgagcttgttnaggtttacgctgcaggacgacgttcaagagctttattttggcgagaanaacagccttttgaccaggcccatacccgcgagcacgaaaggctccagtgt

SEQ ID NO: 680286 - DNA, 244 bp, Homo sapiens
agcacgtgtcaggaggcaggtggtctctgtgggaggcatgcgctggccgcacactggcgttctgggcagcaatgcactcgatggctctttcttctcctcacgctgcccaccatggtatggcaaacccagcccctgacaaggttttggtgagacgccgagactgcgtggagggcacaggacccagagggtctccaaacttcacagtggctccaagtcctggggaggtaccaacgcctgagcgaac

SEQ ID NO: 680287 - DNA, 725 bp, Homo sapiens
  misc_feature (70)..(70): n is a, c, g, or t
  misc_feature (100)..(100): n is a, c, g, or t
  misc_feature (117)..(117): n is a, c, g, or t
  misc_feature (134)..(134): n is a, c, g, or t
  misc_feature (157)..(157): n is a, c, g, or t
  misc_feature (165)..(165): n is a, c, g, or t
  misc_feature (168)..(168): n is a, c, g, or t
  misc_feature (172)..(172): n is a, c, g, or t
  misc_feature (259)..(259): n is a, c, g, or t
  misc_feature (319)..(319): n is a, c, g, or t
  misc_feature (355)..(355): n is a, c, g, or t
  misc_feature (388)..(388): n is a, c, g, or t
  misc_feature (562)..(562): n is a, c, g, or t
  misc_feature (573)..(573): n is a, c, g, or t
  misc_feature (575)..(576): n is a, c, g, or t
  misc_feature (623)..(623): n is a, c, g, or t
  misc_feature (625)..(625): n is a, c, g, or t
aaacttacggctaggtacgaggccgggtgttaatcggccgaggcttgagccggttccctgtgtgtgtgtncgctcgccctctgctccgtcctgcggctgnccactgccctcctacgngtccaccatggccctgntgcgctccggccgcgtcctcccngggatcgngcngcgncttccacccgggcctcgccgccgcggtgctctgccagagccagctcctggtggacccatgtggagaatgggacctccagatcccatnctgggagtcactgaagcctttaagagggacaccaagagcataaagatgaatctgggagtnggtgcctaccgggatgataatggaaagccttacgtnctagcctatgcgtccgcaaggcagaggcccagnattgccgcaaaaacatttggacaaggaatacctgcccattgggggactggctgaattttgcaaggcatctgcagaactagccctgggtgagaacagcgaagtcttgaagagtggcggtttgtcactgtgcagaccatttctggaactggagccttaaggatcggagccagtttnctgcaaagatntnntaagttcagccgagatgtctttctgcccaaacaacctggggaaacananaccatcttcagggatgctggcatgcagtacaaggtatcggtattatgacccaagacttgcggttttgacttcaccaggcgcttgtggaggatatatcaaa

SEQ ID NO: 680288 - DNA, 466 bp, Homo sapiens
gagaggataaggcgtggtgctatggtgaggctatgtaggcatgctgattacgatgcctataatgatggctatggatttgggtcagatagatatgtaagagacctcaataactgtctcgcaggaatgtctgatcacagatacggggactgtgtctctactttccagagcacaacaggacactgtgtacaccatgcggggattaccttacagagctgctgagagtgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcacatattcgacacagatatgtagaactcttcttgaattctacagcaggagcaagcggtgggtgcttacgaacacagatatgtatgaactcttcttgaattcta

SEQ ID NO: 680289 - DNA, 236 bp, Homo sapiens
ccgcttgcagtgggcactcacaggggcagattagtctgaagaaagattttagcggtagggtgtgatgttgtggggtggtcagaaggagcattttttgtatagaatgattggtgatggcctggatgtggttttgtaagaattgagaaactaaacggaagactcaaggtccgaataagagaaggagaaaaataggtattaactaagacttgggaggacccaggacatccaattagaga

SEQ ID NO: 680290 - DNA, 986 bp, Homo sapiens
gcaaaattgtagtgaaaatgtgacagttgattgtcgatcaatttcgttgataggaatgctgcgctgccattgatagtaggatccattcctaggaactcgaaacacgtgtaagtgcagcatatgggagtatagtctttgatctatttcgttcattttccttatttgttgttcatgaatatcattgccgttgtgtgcagcgcagaatcagcagaagagccttgcatacgtactttatcgtaagaatgcacgtgtcattctctcggggattcctgtcaggtctactggttcaaggtcatctaagagatccattttgggttggagtccttaatgagataacatgcagatatgtagaatctgtgcacggtttcgtgcccgtccctacatggcagatgcgtctcgtgactatggagtgtcatgctagccacggcatgggtacgttgtcatacttgtgtaaagctgcgttaggctttgaaaactacgactcaggcatatcatttagcacacataggatttttacgttgtaccttaggactcgaggtcatctccagttaatattgatgatcactatagctagctaataaccatttctgggttgctgcctaacccctaaattgtctgtcaaagccaattctctgggtgtccagtagagtggtggctgttgggcttttccactagttggctcgattcacttctaccattcttgcgctgttaagagataagcatttacataattgggaaaaatctgggatttctgatgccaaacgggttaaaggttcttcgattccttggcattgatatacaggcactattctctttgtcggtcaggtgccattgcgccagttgtccgggtactgaccattccttgtccgcatcacgcgcagggttgggcgcaacttgggtcctgctttttgggccatgtgacctcggttagggcccatgacagtacttccctggctctgaggaagcgcccaactaagacatcgggt

SEQ ID NO: 680291 - DNA, 754 bp, Homo sapiens
  misc_feature (5)..(5): n is a, c, g, or t
  misc_feature (38)..(38): n is a, c, g, or t
  misc_feature (88)..(88): n is a, c, g, or t
  misc_feature (171)..(171): n is a, c, g, or t
  misc_feature (200)..(200): n is a, c, g, or t
  misc_feature (384)..(384): n is a, c, g, or t
  misc_feature (508)..(508): n is a, c, g, or t
gttcnaaggaagactgaagccgaggtgaggggtcctgnggaccattacggaagccgttaacctagaaaaccgggagcacgcccacaanaaaccacacccctcaaaaacaaagggcaacagaggaactgagacacgagagaccgggaaaggttaaacaaactttttatagangaggggtgggaaagcaaaaaagaagaagnaggaggagaaccggccgcacgaagacaagaggggtcaaccccacaagacggagggggaaaggaaagccctagaagagagcaaaaagagggggaaggagaaaagagggagcgcaacacacgcgcaaaaacccaaaaaagcgaggagaggagccacgacagaaacagacgagtgcaaaggccgganacaggggggccaagaaagggacaacgggcgcaaaaggacaaaacccgaagggggccatgcgagaaaaaagaaaaagggaagagaaagaccaggcccagcgaagccaaaaagcaaggggaaaagnggcccctaaggggaagaaagcagcctaaccgacgcagaccaccaataagaaagaaattgagaagaagaaggggaaaagagaaaagagaactacagacctccatacaagaaaagagcgcggggagagggcgagaaactagagggcacctaggaggagagagggaaaaagacaataaaacaactgggagaaaaagaagaaacggaaaggaggacccgcgcgcgaatgcaggagagaaaagagcgcgaa

SEQ ID NO: 680292 - DNA, 1278 bp, Homo sapiens
gcttctccatgggagtttcagataggtggctacacacatctaggatgaggaaccaaggccacctatagtgccgggaaagacatcacatacctatcagacacttctcacaatgtcactgctttagtcatattaacctgaagtagcagttatagacacagtgtagcttggggctgtctttctggctgcccaagacttatcagcgcacatttatcaaccattcaatcaaggaaccatagctaaagcgtcagccagataccatcccatacaagcactcaagcaggtagagggcaggcaatccatacaatcaccacatgcacatgagcggtgcaagcacgccccaaaggcataacacccacacacataaacatactgcgacgataccaacccagatacccactacactgcacactacaagaccacacaacgccacacataacacaccactacaacactacacccgacaccgcgaacggcgaacacccacacgcccacccaacctcacacacaccaaacacgccgcaccacacaaacagccgagacaccgagccccataccaacaccatcacacccacagaacacacggaacaccaatactccacaacgcccactcccccctgcgacaacgcaagtaacaccagcccagcaccaccaccaacacaacaaccacaaactggccacaccataacatcacaaacaggcaccacaccccacagaaccgccgccataccccccagccgagcgccacgctgcccccccgcaacccacccgccgacaaggaaaacaaacaagcacaccacaccacccacacgcaccacccccccgaccacgcacccacaccacccccacacgcacccaccacacccacatacacgaaccccacacagcccaccccacaccccacccccccaaccaccacaccccccaccgcgccgcccaccccccccacgcccaccccgcgcaccaccaccaccaagccacacacccggccagcgcaccccacaagccgccaccacaacacagaacccgcaccacccacacccagcaaacccaacacaccaaaccaaacactagcgccaacacacaaccaccaagtcccccccccggcccccccaagccccacccaggcaccaacacagaaccaggcaaccacccccccagcaccagcccacgacaccagccccgagcccaccgcccaccaccaccgacacacaataacccagacaccaagacacacacgagagcccaaccccacacagcgacacacacaaccaccaacat

SEQ ID NO: 680293 - DNA, 160 bp, Homo sapiens
gtagcagcgagcccatcattccaagcatatccaatgcgttgaacgtcatctcgatatacagtaggacggatgagagcagctcctgtacagcggaacaagctgctcggaaatttgaaagttgaagcctggatcgcaaataatttcccggaaactcaatcaa

SEQ ID NO: 680294 - DNA, 1288 bp, Homo sapiens
acgtgggtgagggctgcggccgtaagagagcgggacgcggtggtgcccggctgcgtgtgtgggggtccccggcgcctgcccccacggcacccaagaagtgcctgtgccagtggtaccctcctgcgtgagccctggggtgttgtgtgtgtggctgctgtgtgtccctggctgccgcgaatggtgccctggtgaccccgcagctgtgcctgtgagctgtgctgcctgtcgcccgctgtgccgcattgtccactggttgtgcgctgtgctgcagctagcggcgcgtgtggaccagcgttccgtcaagcgagccctgttgcgcggtccaggtgtggattcagccgtagcgctgcttgcgtctagccttgcagctacggttgcggcgccgtacaggcgtcccgctggctgcgggtgctgctgactgcatgcgtgtggccagtgtggcctgacgtggcatgttgcagcacgcgatcagtgggactagcgacggcgcgacctgcgcgcgcgcagcgtggctgctgccctgctacgtgccctgcagcaaggccatggccaccgtgagtcggacacctgtcatgctgtccgtgcttgtccgttcccgcttcatcattcaggacccatgcctggcgctgtggggcggccacgcgcggagtgcggctgccgctcctcgtactagcggcccggttcatcggtgatcgttccaggtttggctgggtcctccacacagatctccgcaccgtcaggcctcatcccggagctcgtcaccaaggacccatgaagacgggtggagctcacggcactcagggtatagcgatcaccggtggtggccaagatcaccagtctacgagggccggcctggcctcctgatgagacttgcacgcgctcgccgcgggttgagccgcacgaaagacatcagcatcagcgaccagcttggtggtgcaggactgttccccggggtcacgggaacacgggccatgcatggtagagtagagaagacaggaacgacgaggagcagcagcagcataacaacccgtagggagcccggggaacagaggacaggcagcattgccgagagggaccagggagagaggagacaccccagaaaggcaccgacagagaggcgaccccgctgacccacgacggacgggcaccccggggggcacgcacccggagaggcctcgcacgaacagacaggccaccacgacagagcagaggacggcaggagagcgagacgacgacacggagcagaacgacacaggacagaggaacgagggaggcccgagacgaagcc

SEQ ID NO: 680295 - DNA, 393 bp, Homo sapiens
taggtactcagagctcattgcaggtttaaaagaaataacgtgtaaagtttttagaagaatatctgaccagagttctcactaaatgttagctgaggaatctcattaagaccctttggtcatctgtattccaacaagctcactgtgatgatggtttgccaacattcgccgttttcaccaaacaggttatccttactgttgggtaaacctcccttggatgtatgagtgagctttatgtgcattctcacgaaggtttctgtgatgtataaaagtatacccccatcttacagataggaaactatgccctgatttctgcgcctagacattatcacgttctccagtcagtgtatcgtgtggaaggtaaaaacgtgattcccttttcaggtgtcatcctga

SEQ ID NO: 680296 - DNA, 223 bp, Homo sapiens
  misc_feature (101)..(101): n is a, c, g, or t
atcgaggaccagtgccatctcatattcaacacaagatatattcgccactagcatcattatgatcctagcgcagactctcatttaactggatcggaggacancgagtagctacccttttaccatcattggacagtagcatccgtactatacttcacaacaatcctaatcctaataccaactatctccctaattgaaaacaaaatactcgaatgggccccagctt

SEQ ID NO: 680297 - DNA, 286 bp, Homo sapiens
aaacaggatatttattttagcttcttagttaacatcattaattttgtgtagttgagcgactcgttgactgcctcctccctgcagttttttacggtgcctccgctgttcgacaggcccactgtgagccgcaggtctgtggtgcaagtgacaacagccgggcgggaggcgtacactcaggcggcaggaagttcccagacggcgacgagatttgtcatttcagacatcgtcaggaggtcgtgtcggtattacagtcagacactcttatctttcaggtatctgcttggga

SEQ ID NO: 680298 - DNA, 225 bp, Homo sapiens
gcgctgctcgcggcagcgggaggggggcgcgggcggcggctgagccggggccgaggcgggcccctcccgcgcggctcaccctcctcacctgccccgctcagccgcgcaaactttctctcctctttgtctcgggggcgcgaggggaggggcgcggggcgcaattcgccgggcggggcggcggggtggggggcggcgggcgagcggcgctgcggctctcggcggccg

SEQ ID NO: 680299 - DNA, 150 bp, Homo sapiens
tctcttgagacctggctcaggtctgaggacttaccaggttacttccttcccttgaaggcattgtggctgtttataaccggaaataacgatataggaaaaaacaaaaacggaattatgggggggaaaggagaaggcacggaagggttgccc

SEQ ID NO: 680300 - DNA, 374 bp, Homo sapiens
aaggggggcaatattgcaggtcagctcccataggacatagttcttcatcccgagcctccaggcgacagctttttagaaatatcactgtcgcctcacctgcctaggtctggatcttctctaattttccttcttgtctcagcactttctcctcttcaaacagcttcttgttctcaggggatgcatatacagccagtccctgaggaaggagtcgattccggcctaaagatttcttcactgagaccaggtcaccccggactccaacattctccaccgactgcgtcaggatgagctccaggttttctttgggccgatgcttcgtgtcctccaccagcttatagacgcgatgtcgccggtgcaggcgcggcttccggccc

SEQ ID NO: 680301 - DNA, 603 bp, Homo sapiens
aatccagcctgtcgttattaaagtacagatcttgcacacattgtgcacatgactcactgtagtttatggaggtcgctcaaacgatttcgatttcgactgttcatgatacgatcacaaatcatcagctgctgggacttgcaaacgacaacaatccgtggcatgtatggctcgtatcgatatcagcagggcagtgttattgagacagcagagttcctaactttctcactgacatcattaaactactagtgccacgtaatgcaggggttgtgattccgatactagtgtaattctgaatgacaggcttctaaagcttcatgcggacacgctatgggttctctgataatcagagctgtagtacacaatagcatgacataaggacagctccatatgccttaatggagagtcagtgtctgcagagagttcactagacagtgagtgagtacattgtgacgatcatatcaatgtatccataaggtgaagcaagaaaggcaagtggcatgtcccgccaaaattgggcaaatcttagaaataaaagtaagggtacaagaccccactgctaatggcccctgtgggttcaggggtatgcatgagactgtatcctgg

SEQ ID NO: 680302 - DNA, 355 bp, Homo sapiens
ctttgccctgtccaaatttcacaccctatatttgtgcacagttcctcaaccgacccttcaaatcctctcttttgggcccaggaccataatgtctcacacatctggtcccacaattccattgagaaatgcctacagcgctttctccgtgccaacacacttaaccaacaggctcacttggcatgtagatatttccatctctttctcagggcctatgtattctccttgtcacagcttaaatatgcgctttttccggtcatataattctcaagtgtcccatttggtacccatttcacatatgtcctctgtgtgtacacagctgtctgtgtccagagcttcctctgttctcgcctcgtgc

SEQ ID NO: 680303 - DNA, 1113 bp, Homo sapiens
  misc_feature (392)..(392): n is a, c, g, or t
  misc_feature (687)..(687): n is a, c, g, or t
  misc_feature (700)..(700): n is a, c, g, or t
ggtcccgaggccgggccggggcggccgggaagacgggtgtgtggtgaggtgtgttacccagtaggctcctgggaacatcgttcgggttaccctccacgccgacgcatcgcactggcatggtggatcggccggctcgggtacgatgggctcagtcgataacatggtttggcccgcaggggtgttaatgcaggaagtacgcaaccgtgtatcgctgtcgtctcgtatggagggggcctgtggttcctgtgttcgagtgaccggattcactggcggaagatgattcgcgctacccataacgttgatggctgtgagccttgctatggtccagtattgtaaaaagcttactctatgggtcccagattggactatggcataaaatgcttcgtgttgtnactgcatacttcgcgatgcatgctaccgcactaatttacggcgaatgagatgatgaatgcgtcctggatagatccacgtgggaggttgcgagaacacatacctggaccttcgtaaagatatgctgtggctagaatactagttcgtagtattcctgaacaagaccatatgggaacagattgaggcagtatgggaaaacggccttgtccgaatgtgctatttattcgtacgtccacgagaactgccccttatcagatatatgccacgacgtgtaaatatagtgtcgtggaacgaaangaccactattcgntctcgcaaacatttgcggggatacaagtcatcgatgggggattgactgctgtccacttgggttgataggccgaccggggaaaggtcacgtgggcagatataagtacttccataggggagaaacaggcccgttaaacaatggtgggttgtcataaccaacggattgtagtagaacaggattgggtgacatgggaggcattttttgtgccctgccaatttcaaagtgggcctagaggtaaaatccaaggattttcccaatggttttttatgccacatatcacttccattagggggaacttaaaaattggttggagtgtgtcctatttggcggttgacaaatggggttaggttaaggaattgacgtggttacgtggggctaatttacaaagttacgagatgttaggttaaaggaac

SEQ ID NO: 680304 - DNA, 761 bp, Homo sapiens
  misc_feature (486)..(486): n is a, c, g, or t
gcccctctgttgttgctgcaactccctcacccacagcagtacctgaggtggttctggagagactgcagatgtagtccaaactgtgcagagcagagctcgtgaatggggctggggtcatacatgcccagtggaactgatccagaatttactgaatttatgcatgtgatctggcctaccttgggtggggggcatggctgcaatgtacagtcttgggcccgctgcctgatttttcctctacatcgtgacgggcagcgagaggcagccaggatcacaatcaatttgccagagatccagaaggttccagtcgaatcagaaaggcaagttaggcaggagaccatatggaggtattacaagggttcctcggagatgggaacttttaccagaaaaaacattggtataaaatctataaaactctaattctccgtgtgactcaaggccaaatcttaatctccttcctcatgtgttggagagaagatggcaaccttncttgtggccagctggagaaaggtggcttcgtgttggtccaggggatctcagggtatcgggatccaatttatattattaccagtggagtcagtgctacaagggtggggtggtccttgaagtaggtcgggagaaaggtgtgaaaaggtttggacttcagttggtggaaatgttctcagaatgatggcctgataaccttgccataacaatgtttcccagggaggtaaagggtgggctccaaatgtgttccggggcggaaaatgtgccgggaaacagag

SEQ ID NO: 680305 - DNA, 278 bp, Homo sapiens
agctgcgagtgatggtgtcttgatcttctggcatcagctcagtagctctgttgcaacaatattctcagtgcctttggctgcgctatgtgtactgtgcgccgctgctaacagagcaggagagagcttatgccagatccacagacattggggagctgtgcattgctttctgggagatctgcttcttggaccaatggagcctgattacagtgtggggcttgatgctgccccgaaacacgcacgcacgcgcacacacgtgtgcacattagccatgcctctgg

SEQ ID NO: 680306 - DNA, 216 bp, Homo sapiens
  misc_feature (66)..(66): n is a, c, g, or t
  misc_feature (87)..(87): n is a, c, g, or t
gagagagaagaatgagtgcccagcgaagggggaagccccttataaaaccatcagatcatttaaganctcactaacaccagaacaggnctgggggaaccagccccataattcagttatcaccactgatccctctcatgacatgtggggattatgggaactgcaattcaagataagatttgggtggagatacagccaaaccatatcagggtactaatt

SEQ ID NO: 680307 - DNA, 449 bp, Homo sapiens
  misc_feature (1)..(1): n is a, c, g, or t
  misc_feature (8)..(8): n is a, c, g, or t
  misc_feature (42)..(42): n is a, c, g, or t
  misc_feature (368)..(368): n is a, c, g, or t
  misc_feature (409)..(409): n is a, c, g, or t
  misc_feature (436)..(436): n is a, c, g, or t
nttcggcncgagggggatgaagaaactttagtttggtgatcngagtggtagtcgatagaggcctagactagaatggtaattgtagaaatggcaaggaagaagcaaatcaggagatggtgaagaaaattgacatgataatcaatagaagacaaacatgagttttacattcagccccaaacacaaatataaaaacaaataatacctaagaccagggtctccagacttctgctttactatacagtttttaaaatacagtttgagcacatatcctctttatgcgtatattacttacgcacatgtactcatactatatacattataaaacaaaagtacatttaaaaagggatgaaactaaaattaatgttttnaaattgcaacagttataaagtccgtggacagtggtggattnataggcgtatttttggaaaaatttttncaaaatttaccgt

SEQ ID NO: 680308 - DNA, 1131 bp, Homo sapiens
  misc_feature (501)..(501): n is a, c, g, or t
  misc_feature (516)..(516): n is a, c, g, or t
aacaaatgtagaggggaagaagcactaaccaggcataataccgaaaccggttccaggggaaagaagggctgttgggtattccgctggtcgtcctaggcgcttatattgctgaacactccgagagctggaccagagggtgtttgtcaccggtgcggtctattgattgtcattggggcatcttacaatggcccacatggctttgcctatactctgtttctacagaagcagacgagcatgggatctacagacaaagatatattgctattaccctaccaataggcacttttgtcctcctctgatggcctcttttgatgccttttaggatagacagattccctagggtgctgtgtggaaagagacatctatggaaatgccaacaaaggcgagggcctaggtcctttgtatgcatagtcggcgctgattcacagttcttgaaactttttcagtttaatggatttaatagtcatgccagtcatcttcttacaaatcacatagcattcntcgtacccttctccnaagttcgccagtctatacagtgtgtcttggatggtccaattacccgagtccgagaacccatggttgtacgttgaatttataatgtgcgtgaaagtgtgttggagggaggctagcgacatggggtgacccactctaatgtggttgtaccctagttgagacactcgtgggtgtccctagtacctatttttatgcggaacgggaaataaactattcccgataattagaagttgcaaaaagcttcgatcatgggcgtgttgtctcgtcccaccctgtggcaaggtcgatcgataggatggatggtcacgtgtcccattttgaagtggaaggtgtaaaccatttatttgtaccaaccaaaatggaatagggtcttgagaaaagtccccctaaatggatacacacgccttcaggtctccaaggggtttttccaggatctcattgtattttctactgataccatcaaagatgtattttgtgttgaattgagtggttcgtcaagtggtctgccctgggttggttgtaattgtggtggcaatttgcactgtcaaggtaacatttatagtctttttaaaattgggaaatggtacttgtaaaaggcaggtaggattaggaattaac

SEQ ID NO: 680309 - DNA, 764 bp, Homo sapiens
  misc_feature (297)..(297): n is a, c, g, or t
gagcgggtgtttcccgggccgaacctgggttgtgtgggggctgctggggcctggtgccaggcggcatctaaggacccgcggtgacagcatgggtgaatggggagcggggcagatgaggccttgggctgttttcggctggctgtggtggtggtgctgagggtgctggcgggtcagatgtccctgggtccatggtcggggctctgactcgctggttggtgttcccccgaccccgcgagctgctggtggtgtcgcttgtccctcgcccactgatggccagacatgcgagtgctgccggantggtccgtgaaagtgtgttcattcagcgatgactacatgcatgatggcacatctgctgccatgttccacgaccagcgttcccttgcggtaggctggagaaccggattgataggcagcagtttgaaggaaacagttcgaactctaaataagcctttagtgcaggaaagcaggagaagctcggcggccagtcatatctcgaaggttgttggcttgtttaccaggcatatacccatcttcctattgcattggaaactcattatgacgaaggttctgaagaaagtctccaaaatacattcaagagcagaatgagaaggatctatgctccacaagggctcctcctgacagaccctattgagcgaggactgcgagttattgaaattaccatttattgaagacagaggcatgagcagtggaacgataaaccgaagaattaagatcccacttccagcggggccctcatgtatcca

SEQ ID NO: 680310 - DNA, 126 bp, Homo sapiens
acttgacacggacctcgcgggactactctacccacgcaactaccctgactcacctaccttcgcacctacgtttctcgcgtacctactgcatactgactccacactactcacacacggacaatgact

SEQ ID NO: 680311 - DNA, 174 bp, Homo sapiens
agtcattgtgcacatgactgagatcaacagatgtgactctctctgtactgactctgcacccgcggcagacgcttgatctctacatgacatgtcctgagtgggcctgagggtgccgtggcttggtggtactccatcacgcagcagttgttcaggatctcaccactgcactcgttg

SEQ ID NO: 680312 - DNA, 822 bp, Homo sapiens
  misc_feature (822)..(822): n is a, c, g, or t
ccgagcggatccgcggcggaggttgagggacccccctcctcccggtcaccgtctccgctgagtctgcccccttccccatccgcagggctcttccgtgtggcggcggcttcgctgggcttggagttctgcgcggccagcaggagtctggagcctgctgggcctctggacctggtgtggccccccgtgactgtggacgggggcgtgtgtgcggggccccaggagctccgatacggcagcacatccccgtcccaagcgcagagatgccaccccagggaaaaggccacggctggacgacggtcatggcatgccgaatgcccttacaaggcctgatccaaccgagcccgtctcctatactaggcgggccccaggttagcaagcctatcagaccacaggagcctggggcttgtgagcccttggaaccgaggcccatgagtgcgtgccccacagggcaggcgtacaggcagaaagcaggcagacagaagcgaagacatgggggactggcgaacctggcacaggtgacgcagatccatcatccgatacaagcacggaaaagacacaacgatgccacacaccgaagagacagaccccacctaaacctgatacaggaggaggcaccgagacccatgcagcaaagacaacggcaacacagagggcccccagcggccccaagcgcgctccacgcgggatacccaacagatgagacctaggcaggcagaaaagacggcataggcgggggaaaaacgggaccgcaagaaggaaccagagggacgaaaacaggacaaatcgcaaagaacgaccaaccactcccacggacccaagggn

SEQ ID NO: 680313 - DNA, 201 bp, Homo sapiens
agctggtctagaggatcacaggtgctctaggggaggagctggatgaacgtatggcccgttctgccaggcccaggtgctaggggaggaccccttgcttgagatgtacaggatggactccgtcacttcttctgggcttgtgccctggcccgctgaatcttgtcagcggtggccccatctgtggctcccgtgcagtgggacaac

SEQ ID NO: 680314 - DNA, 205 bp, Homo sapiens
  misc_feature (1)..(1): n is a, c, g, or t
nacaggatcccggaattgtgtggtgttatgtaggaacatatttccttaatatagacacatgaaagacattatgtacttctgctaatgatggaggtagcgcaatctcgtaaggccacgttgccaactttctttaacacctcaaatggtcccacaaacctaggacttaattttcctcgtttcccaaatcacataacaccacacaatt

SEQ ID NO: 680315 - DNA, 1112 bp, Homo sapiens
gtctcaatggatgtccatcctccgatcatagttctccagaggtgttgtttccctcagtggggtgagatactattggatcccaatactgtgtgtttgttggtgggggagcccaggagcagttttccaatatgggtatgctgcaagctactctattgcgctctgagggtcgcttgttgtttttgggagcagttcgcatattcaaatcatcttctttgttgggatagctctttccaacgctgtagatacaccttgttttcttctcgcttggacctcctgttaagctggtgtccatggtgcaaatatacgtctcatgtgctgtgctcacattttttctcctctcgccatatcgtgatttgtgacccacttaggtggggtttcccttggggagacctgggttgtgatatcactgcgtgatgtccatcttggtggaatttgtttaatccccaatcaaattcccgtgttcactactcacggggacattttgggcacacggttttggtacgcgccacaagggtttcttgtccacattttgggccctttttgtagacaagaggcttttgggaaaagaggtacacaggggtcaccttttgggaaccctaatttccatacacgtggttgtggcactgtcccactgctctgagtttgggcacagagggttagcacgtcacgccggtcgcgcgaaagattggtgtaacgtgtccgtgatgtccacttaacttttcgagacctcaccagtgaacttttcgagattctgaggtgttgaaggcccttaaggaacgctggtattctcctcgaccgggcgtttgtggcttcaatgcctggtaatctccacccacctttttgttttaaaggcacaggcggatgcacacctcgaggtgcacaggagagtgttaaagagccacgcctgacccaactatggagaaacctttgttttttactaaaaatataccaaaaatttagccaggcatggtggcactacgcctatagtccccagctacttcaggaggctgaggcaggagaatcacttgaacccacggaggcagaggttgcagtgagctgagatcacgtcattgcactccatcctgagccaacaagagcaaaactccgtttca

SEQ ID NO: 680316 - DNA, 226 bp, Homo sapiens
tcagaggtacaggtggtcgctttgtctgtcccagtgaaatgaacggaacttgatgattatgagacgggagagattgacagagtggaacggacgaaagtgcttgagggacagtgagagaggttggagaagagagtaagaacgaggctgcttacctgcatttaaaacttggtgagacagttcctatgggcatggtcagctctgacggcacctgacagtcatagcgtgg

SEQ ID NO: 680317 - DNA, 116 bp, Homo sapiens
gacaaaccaactgtgatcagtgagctcagatcccgacctgcagcagaatgaacaaggacaagcgataccctgagggagaggaaccagtatggtaggcctagagaaaacatagcata

SEQ ID NO: 680318 - DNA, 106 bp, Homo sapiens
tcaatcgacggtattccatatggtcacgcgtagttatgaattccgagctcaggtgatctgttcgcctcggcctcccaaagtgctgggattacaggcgtgaaccact

SEQ ID NO: 680319 - DNA, 135 bp, Homo sapiens
  misc_feature (69)..(69): n is a, c, g, or t
gaaactcgcgcggcttgctagaagtcatcaaaaagctattagtgggagtagagtattgaagtccttganggaggattatgatgcgacctgtagagtgcgttccgtacgtttagagtttgctagagcagaaataat

SEQ ID NO: 680320 - DNA, 499 bp, Homo sapiens
tgttaaaacacctacaaaggaagcccgttggaataatagcgtaactctcagcagaaaccctacaagccagaagagattgggggccaatattcaacattcttaaagaaaataattttaaacgcagaatttcatatctagccaaactaaacttcataagcaaaggagatcctttccagagaagcaaatgctgagggattttgttaccaccaggactgccttgcaagagctcctgaaagaagcactaaatacggaaaggaaaaaccggtatcagccactgcacaaacactccaaaatgtaaggaccaatgacactatcaagaaactgcatcaactagtgtgcaaaataaccaggtagcatcatgatgacaggatcaaattcacacataataatactgaccttaaatgtaaatgggctaaatgccccaatttaaaacacagattggccaattaataaattttcaagacctattggtgtgctgtattcagtggccatctttggg

SEQ ID NO: 680321 - DNA, 229 bp, Homo sapiens
ccagaccgaccacataccatgagcttcgatacggcgtgagctgactgggaaacgagctgccataccggacaggagacggcggctgtgggcatatggagccaatattatccggacttggcactagccaaaggcagtctggtgatgtaagtcgaaacagatacgcagataatgacagcgtaaatctcggaccttgacaacggaataaggggagcctgctagagtctgagac

SEQ ID NO: 680322 - DNA, 401 bp, Homo sapiens
  misc_feature (16)..(16): n is a, c, g, or t
  misc_feature (58)..(59): n is a, c, g, or t
  misc_feature (108)..(108): n is a, c, g, or t
  misc_feature (128)..(128): n is a, c, g, or t
  misc_feature (139)..(139): n is a, c, g, or t
  misc_feature (296)..(296): n is a, c, g, or t
ggcagtgctccagccntcccacccgcttgtggccaactggcttccagtcactccccgnnaatgccagttcgactttcactgggtactggaagatgttggtcaacgagnaatttcgaggtagtacctgngccgccctcgnacgttcaatgtgggccttgcggcaaaatcggccaacttgctgaagccagacaaagagatcgtgtcagggacggtgaccatatgatcatccgcacggctgaggcacttttaggaactacatcatgggacttccaggttgggaaggagtttgaggaggntctgacagggcatagatgaccgcaagtgcatgacaacagtgagctgggacggagacaagcttcagtgtgtgcagaagggtgagaaggaggggcgttgcttgaccc

SEQ ID NO: 680323 - DNA, 333 bp, Homo sapiens
tacacaacacttgtagctcttgtccttttgataatagctatcccaacatgtatgaggtggtatctcaaagtagttctgattcgcattttcctgatgactggtgatattgagcaccatttcatatacctgttggccattttctgtcatctttgaagaaatgtctattcaagtcctttccccactttttttaatcaggttatatgttgtcttgctattgagttgtatgagttcttcctaaatcctgaatattaaaaccttgcctgatatatggtatgcaaatattttctccttatctgtacattgcctttgcatttcgttgatggtattcgttct

SEQ ID NO: 680324 - DNA, 574 bp, Homo sapiens
ttgacatgatacgcctcgatctcggtaccactactgtcgcactatggaccaactacctccaaaatgaattttctcatattctgcaaggagtgaactcagactgaagacctggcacattgatgacatttgtaagatttctgtccagtatgcattctctgatgcctcatgaggtgtgaagtgaaggctttgccactatcatcacacatgtgaggtttctctcctgtatggattctcctatgttttgcataggatgaagcttgactgaagaccttgccacagtcatgacatttgtaaggtttctctccagcgttgagttcaccgatgaactgcaaggtatgaacaatgtctgaaaaatctgccacatttattaccctagtatgatctctcttccttatggattctccagtgattcacaatggttgtagcattactgaagactttgtgacaatcattaccttagtaaagtttccctacaccatggattgcctgacggtaaacaagtgttgactgcctactaaaggctttgccacacccattacactggtaaggtttctctccagtgtgaattctagca

SEQ ID NO: 680325 - DNA, 85 bp, Homo sapiens
accgagctcgaattcggacacgcacgccacgctagaaggctggcgagaccgaagcagcatgtgaggcctctcctgggagtggggg

SEQ ID NO: 680326 - DNA, 894 bp, Homo sapiens
  misc_feature (24)..(24): n is a, c, g, or t
  misc_feature (94)..(94): n is a, c, g, or t
  misc_feature (104)..(104): n is a, c, g, or t
  misc_feature (146)..(146): n is a, c, g, or t
  misc_feature (161)..(161): n is a, c, g, or t
  misc_feature (172)..(172): n is a, c, g, or t
  misc_feature (212)..(212): n is a, c, g, or t
  misc_feature (238)..(238): n is a, c, g, or t
  misc_feature (252)..(253): n is a, c, g, or t
  misc_feature (265)..(265): n is a, c, g, or t
  misc_feature (272)..(272): n is a, c, g, or t
  misc_feature (298)..(298): n is a, c, g, or t
  misc_feature (318)..(319): n is a, c, g, or t
  misc_feature (342)..(342): n is a, c, g, or t
  misc_feature (345)..(345): n is a, c, g, or t
  misc_feature (354)..(354): n is a, c, g, or t
  misc_feature (465)..(465): n is a, c, g, or t
  misc_feature (469)..(469): n is a, c, g, or t
  misc_feature (480)..(481): n is a, c, g, or t
  misc_feature (486)..(487): n is a, c, g, or t
  misc_feature (491)..(491): n is a, c, g, or t
  misc_feature (493)..(494): n is a, c, g, or t
  misc_feature (496)..(497): n is a, c, g, or t
  misc_feature (500)..(501): n is a, c, g, or t
  misc_feature (505)..(505): n is a, c, g, or t
  misc_feature (584)..(584): n is a, c, g, or t
  misc_feature (762)..(762): n is a, c, g, or t
  misc_feature (765)..(765): n is a, c, g, or t
  misc_feature (771)..(771): n is a, c, g, or t
  misc_feature (797)..(797): n is a, c, g, or t
  misc_feature (804)..(805): n is a, c, g, or t
  misc_feature (807)..(807): n is a, c, g, or t
  misc_feature (816)..(816): n is a, c, g, or t
  misc_feature (862)..(862): n is a, c, g, or t
attaagcactactatatgccaggntcaagtgggtcttactctagggatagagaagagaacaagagaagtctgtgccttcatggggtttacattntagtgggggnggggaatatcaagaatatgaatacatgttgacagtcagtganatcaaacaagtgggnggtggggacancacatgagcgtgggtgggaggggggcctctctgtgaggtnactgtgggtagacggagaagccagcnagcgaactggaggnnaagcacccaganggtcgtnctttcctaagctccctcaacccaggncctgagccaagattatttgnnaggtaaccaagttaaatagtgangtnccgccaggnccagggtaggcaggacagaggagccggtgacagggaaggctgtggatggcttcttccctcctgggcatggtgccccaagcttgctctggctgggggcggaggtctgactcncgcntttcagggaanntggcnntcanannanntcnntcantcaagcgtccctagcatctcggaccccaggactgagcaggcagggtgtgacactgcccggtcccggcaccccaggagcnccgcctggatggagggggcctcccgcgtatcctccctgatttgaggcccgggtcctcaggatcccagagaacgtgacgtcaccaaagagaggctgacccccatcccagcaggtagaacaacacatgaggtaggcgtgagattgggacctcctagcagggggtggggagctgtgtggcncancaaggncccagggcaggtgggcagccaggacnggggctnnancgtcaattnttcttggcgcggtctgctgcgtccagggcagcatgttgcgggcggncgtgatcaggtggatgagctgatgagcgattc

SEQ ID NO: 680327 - DNA, 728 bp, Homo sapiens
tagttggagacgttgagctggtagccagtggtagatggtcaattggttctgcagcctgagagttgctctaacacagtgtaaggacggtgtctgctctggtgtgctgtgttgtccttggccctgcctgcctgtggctctgcccagatgcttcagatcctcttgtgttccggagattgcttgacttcaaccttctttgggtagctgcactatgtctccctcggggccacttagttctgcatggctcagtcactactttgaagacccctatttaatgtttgcttctggtcagattatagactcttgtcgatgttcagttacacgtcgtcattctcgtcagcacctaatcttcatctaagataggtattgatagggcataacttcatgtaggttaagcctggacaattggagtccgtcgttttgccttgcctacgtcagcgttcttgctggttgtaatgtcaagcctataaatgggcttccagggcttctggatctctatcgagctattggaaatctatttgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcataccttctaataagtaattcctgctagccactgcaca

SEQ ID NO: 680328 - DNA, 762 bp, Homo sapiens
gggcagtggaaaagaggccaggtgctaataaatgagtccttctctcaagccacgtgatgcaggcggaaggcagagaggtgcctgcagcccagacactcccactttgccaggctaggctgtggtgggggaggtgttcccctcccagttttgtcaagaacgttgaaggaggctctagtggccatggatagaacgtggcgtcgccctttcacaacgtaccctatgctggcgcgtacaggtcgtacatatcattgtggacgttggtgccacagctgtacaagatggtcggtcgtcccacgtcgcctcatggatgcacgagcggtctgtcagtgggggaacgcattgcacatgggaggctgacgctatgctgaaggaatggcccctccctacccaaagactggagcgcttctcaggctcaatttccctggtctgtacagcctgggagctgcgtctgcctgtccccgcactgcgtttactaggtatgggagagcctcccgacgtgggtggtccccgtacttgaggtgccggaactatcccggatggcgggcatggattggcttcgtccctggctgggaaaccccctgtctggttaccccctagggacggggtgcagcacctataagcagtgtgaggccgatttgtggcgcttgtgcacccaccaagcaaggccccaaagaagcgggtgcttgcatcaaggtgtcagggggtttgtgacgaaactggtagatcaattggcttgtcgggacggttgagggccacattgag

SEQ ID NO: 680329 - DNA, 338 bp, Homo sapiens
tgctaggcgggtcgtagcaagggggcaggtagtaactccccaggtggctgagggctagggtgacgctcaggtgggtctcctgttcccagtgctaccctgcatacggggctccttcccaggctctgtggcagcgaaggaggggtaggctgggaggggctgctgacgttgttcacttgggcaggacgtcagaggactcagacaccagcttcccatcacgtgtctcgagtcttcttcacaaaccacggccctggaggagctggtgcgggctgaaaggagctggagcccgggccaaacccaaagcttggagccccaggctggtagctaaggccggggcttgt

SEQ ID NO: 680330 - DNA, 651 bp, Homo sapiens
ggttgtgagtcgacgggtcctccatgattctggagggcgcgtaccagggagtacctgtgagtgcagtctcatgtccgtgcgatcgagatatgtgtgctcgtccatattcgcgggtacttgagaagctgtactgtgaactccagtccgacagtcgtctgaagttagggtgcacgcgtcacctgctcgtatatactgactgagcggggcgctgtcagttcggttactgtctcctcgtggggaccttccccttcaactcttgttctctcgggcttcatctacttgtgtggggagtgtcatcctaacggttgtctgagaatacagatcaacccagagaacaaagcggatgtccaaggtcatctccacagagcgagccttggctgattttctcttttgccagcatccatcctgcaccttgttgtcatgaactttgtgggctgaatcattctcattgtacttaattgaggagtaggagactaaaagaatgtgcactctttgaatttcctggataagagttctggagatggcaggtgattggacacattggatttgtctttcagatgtgcaacttgactgctagctctgcttttcatgcaggagaaaagtccagagttcactgtgtgtcagaacaatttgtaagaagacatttgatta

SEQ ID NO: 680331 - DNA, 498 bp, Homo sapiens
gacatttgtattttagtagagatgggttttcgccatgtggtcaggctggtcttgaactcctgacttcaagtgatccacctgcctcagcctcccaaaatgctgggattacagacatgagccacacgcgcccggactaaattttaacgttttcttttttttccccctgagacagagtcttgctctgtcgcccaggctggagtgcaatggcgcagtcttggctcatggcagcctccacctcctgggtttaagtgattcttctggatcagcctcccgagcagctgggactacaggtgcccgccaccacgcctggctaacttttttgtatttttggtagagacgggttttcgccgtgttggccaggatggtcttgatctcttgaccttgtgatccacctgcctcatcatcccaaagtgctgggattacaggcgtgagccactgcgcccagcatgttagacaatttttaattcatcctctctgtgctgtcgttttctcagctgt

SEQ ID NO: 680332 - DNA, 439 bp, Homo sapiens
tcacgcccatgtcacaaggagcagcagagcaggccccagcatttggacaaagctctgccacggggaggttccagtcccaagtcccaaggctggactacaggtctctggcggggcacagagcagcagtggggtgtgtctcagctgcaggctcatgggaagtgacgagtctaccgtagaattgccctgaaagcagaaggcggatttctaacccggtttgatggaatagagtgacacgtctacctcctttctcatgttctgactgaacaacatagaacttacacggtggttattaggtataaaatggctaaaagagaagctcctgtcgtccacagtagaaggccaacctggcagtttttgtcaaagccagcgggcagtgcctctccatcccgcagacggcttgcatgatgctccaggtggctgaggagaggaaggggcaggc

SEQ ID NO: 680333 - DNA, 145 bp, Homo sapiens
catgaagaggcatttaactccttacctcaggtgaccactgcttggcctcccaaagtcctgggattacaggcattagccactgcgccctgcccccagtactttgctcttaattctagtttcctcgcccttttcgtcagaacaggtg

SEQ ID NO: 680334 - DNA, 1037 bp, Homo sapiens
cctgcgattgtgcaggcatttgttccctacctgggtgtgctgctcccctcgcctggaccctgacttcagctccctgtattgaatgtccacgagggtgaagacaggcctgtcaggcctctggggaatctcccaaatccacatgaactcaccattcaccatgggcctttaaatgcagtaaactccagctaatcagatttcatggggctagctatgacccactgtgctccttcttcagcactcgtttgctactttcaggtgtaagatgcctggaatgaaacccagggggccttcctatgacacagatctttgcagcttcagaaccaagtcagaccatccctgcgactgccctggcttgacgaccatgcaaccttggtcccctgaaatttattgcctagtcccggcgtgcgttggacgtatctcgtcccatgtacaactattgcgagacaatgatcatgctgagataccgaagacactggaaaggctgctcatgccgcacaggttgcctgtgcaggcgctctgcgtcaaaaggaatccacaggagtgactgtgcgtgcaacccgcacggggatggacatgcccttgaccggtgtcactgtgcgcaggcagtgctgctgggaacgcaatctaccagtatacagttgatctctgcgtcgagccacggtggaacagtcccgagccagggcgggtactgaagtgccctgtggggacctgaaattgggctttgctcctgtgccgattccgttttcgccctgtacgttctctcaggaaagctagggaccggcctacttttcccagcagtcatgcgaaaccccactgttctattcttcgaacgactttgcctggacgctgaccacaagcggcacacacctggcaggttagcgccggaaagttcaccgtaaggtttgggtttcccccgcacatgtcggcggacacggcgagtctctggactgagcgtcgtcgtaatcagagtttcgccacagaggagccaggtaacgagtgcaccaataatacacgaaccccacagtattgtcgcgatt

SEQ ID NO: 680335 - DNA, 222 bp, Homo sapiens
tcccggggtcccaaatttttttttttgaaggaatggtccaaataaaaaaccttaaggggtttttttggtccaccttattaaaagggtaagggaaaccccaccatgcatgccttgccttggggaccagggaattcaccccacggttttggggaatttaccccggggcttagctttcattatcactgcttcccagggggtgcttggcaaagagattttccgcca

SEQ ID NO: 680336 - DNA, 84 bp, Homo sapiens
  misc_feature (76)..(76): n is a, c, g, or t
gatacggagtttcattctgtcaccaggctggagttcagtgagccgagatcgccccactgccctccagcctgggcgncagtctca

SEQ ID NO: 680337 - DNA, 129 bp, Homo sapiens
aagcccttgatacttaccacacagtgggaagagacagacagagagagagagagagagacgagagagagagagaggcagagacagagacagagagaaagagagagacagactatagaaagacagagtatg

SEQ ID NO: 680338 - DNA, 576 bp, Homo sapiens
ggggatactgcgagtatggcggcgtcaaaggtgaagcaagacatgcctccgccggggggctatgggcccatcgatacaaacggaacttgccggtcgagggactgtcgggctacagcatgcttgggccatagggattgaaccctgatctacgggcacgtggagcataatgaagtggaaccgtgagacgcaggcgccgtacaaatcgaggacttcgaggctcgcaatcgggctgtttgccactgtacgaggcagaaaccgaccggaggaccttgcaagatgcttcgggaagaagcctggagggagggagggcatcaatcgattgaaatggactgtggcccctgacgtgcaaggggtggggggagctctgtgtgttccaacaaaatccgggcgtggggttgccccccccttgggattccgggggggctcgttacggggctggtgcacccgcaagaggaggtctcctcttgttgcgagcccacgggttggcctgtgggtccagctgtagggccctgtggcccttcgcgtgccaatctgttattcacgtgccccttccccgcattgcgaacggattaatgc

SEQ ID NO: 680339 - DNA, 247 bp, Homo sapiens
tgctgggattacaggcgtgagccactgcgcccagcctattagttcattttcatactgttgataaagatacccaagactggataatttataaagaaaaagaagtttaatggactcacagttcctggtggctggggaggcctcataatcatggcagaatgcaaaaggcacatcttacatgcgcggcaggcaacgagagaatgagaaccaagtgcaacgtggaaaccccttataaaaccatcagatctca

SEQ ID NO: 680340 - DNA, 388 bp, Homo sapiens
tttttttaaaaaaccccaccccagcctgttcccaaaaatggcttaaaaaaacaagggatattttttttttaataaattttttttccattcttttttgaaacagggtaataccctgggcaccacatgtttaacattttcattcaaggtggggaaaaaacccctctggtgaacctagtttatacaccaattttttttcattcaaggtacccaccacctttttcaggggggggacgtttttttttccctaatgaaaagcaagcattttgttagaccttttatattgccttttaatttgactttaatgaatgggggggaaaaacaaaaggatcaagttttttttaaaacatttttttttaaaaggggacaaaaaaaaggcaatggtttttca

SEQ ID NO: 680341 - DNA, 127 bp, Homo sapiens
ggcacatgggcgggcaaaggaagtgagcgggagatggatcacagccgagggagtaaaggtgctgcaaggatgttagctgtgggcacgggggatttttcggaaggaacattaataaactaaaaacttc

SEQ ID NO: 680342 - DNA, 1035 bp, Homo sapiens
tgcccatttcgttgttgcaggacgttcactcattagggtgagctgggacctcttgctattatgctaatccttgaatagttggaaggtcccatttgacgtgtcgcattggctgctacatgcaccagtgggttccacgtgcctatgtaggtgctaccgcgaacatgcgcgacatgtcgcagtcttcggggccaacgcaattcgaagctcggcttacattatgctccctgcgagaacttaaacacgtagactcgtgggtaacgcgatcacactatgccactctcttgatgcgcgctgacctcgagatggaatacctgggagtcgtttctgacgtgtgcagagcgcctattttggacctaccctaattgtaacacgctcgtgagggacaacctgacggcgaagagttcccttcgcaaggacgtgacagggactcgcaaggcatggcttggcgggtggagcgtaagaacgccatgtatggcctggtatataccggtcaatactttggctgtcccgccacagagggccaaagaaacgcccgtggaggcatggataacccacccattgcaatgtgtggaaacagttgggatggcacagcacaaaaaagcaatggagtcagcggagccaaccatggttgtacaacttgcctcaagctgtgcacgggcaacgactcgcagagcacggacgactttcaatggggttggggcttaggcgctgaggtagttggggagtcaacagcgtttggacatgcgagaccggacagacgacagcgtcatacacgggtggacgcttgtgctggacagcagcagcgtaatgttttgacaacagtgcagtgggctagggcagacatttccaaccaagggatgtgtgatctatggccagacacccgaatgcacagtgtgtggaacgagtctctagcactatcagaccaggggcgtttccttaggaagagacacgttggacgtgtttagcctgtagcccacgagaatcgttcagttgttcgcaaataatacgatccaattccccgtcatgtgagtattg

SEQ ID NO: 680343 - DNA, 916 bp, Homo sapiens
ctctattttaatatgtatttccatgcatctgaaactaggctttttaaagaaatatgtcaaaagcaaagtaagtctaaattatagagaaaaagaagctagttggtctttaggctcggtactgtatctgggactcttcagaccagtagttggtgtcttgtctagcttcaggcagccatgatgatatgatgccatctggcatttgtatgaagcttgctattttttgaggccttctaacatgtgttttaccatttgtgtgtttcaactgctctgtgggatgttgctttagatgaatagagaagtttctaagaagttaagagatttgctcaagatcacagttcgccagagagctaagaacccccaggtccaatacattttatttatttatgtatttacctcgtgctttagtgcccccaactgttcgcagctgagtattcataggtgctgctaacctgcctagagacatgcaaaggggaaggataaaaacagaaaagaaaaaagagtgacagcttaaacagtgcaaaaagtgggaaagagcaagttataataaatcaagacagaattttagagctttttgcattttgactcatcatttattgtattgtgatcttgagcaagtaatttgatattcaagcctcaacttatctgtcaacatcggcataactatggttaattatcactgagctagtaaggtcattgagatgctgtctgtggctgtttttacgaacttcttaggccgagtggcttatgaaaatcttggaatcaactttcccctgtgaacacaaaccgattgcgaaggcagagcgttggattccaggccgaaagtctgtgcaacactattgcagctggcacggcacttggggggaactcctcagtttgggggcaaactggggggcattgaggggaggttgcacaatct

SEQ ID NO: 680344 - DNA, 163 bp, Homo sapiens
  misc_feature (18)..(18): n is a, c, g, or t
cgcgagatgtgctgcttngtcttgcacatgtgtcagttcaaaagtctcttctactcgggcacggttcttatctgctttgtttccttctctgttgagtcggaactttttggctttatcaatagaataaatcaccatctccatcaccatctccatcaccatctcc

SEQ ID NO: 680345 - DNA, 651 bp, Homo sapiens
caactattaccaatagacctaacaagtgagatagacagcaacacattaatagttggagacttcaatactccactgacagccttaggcagggcatcaagactgaaagtcaacaaagaaacaagggatttaaactataccttggaacaaatggacttaacagatatatacagaacattccatccaacaaccacagaatacacattctgttcaacagtgaatagaactttctccaagatggaccatacaatagaccataaaatgggcctcaataaattgaagaaaattgaaattatgtcaagcactctctcagaccacagtggcataaaactggaaattgactccaaaaagaaccttcaaaaccatgcaaatacatggaaattaagtaagcctgctcttgactgagcattgggtcaaaaacgaaatcaagatagaaatttaaaaattcttctaactgaatgacagtaatgacacaacctaccaaacctgtgggatacagcaaaggcagtgctaagaggggaaagttcatagctctaaacacatacatcaaaaagactgaaagagcacaaactgacattccaaggtcacacctcaaggggactagagacacaagaacaaactaaacccaaacccagcagaacaaaggaaatacca

SEQ ID NO: 680346 - DNA, 619 bp, Homo sapiens
  misc_feature (175)..(175): n is a, c, g, or t
  misc_feature (209)..(210): n is a, c, g, or t
  misc_feature (269)..(269): n is a, c, g, or t
  misc_feature (286)..(286): n is a, c, g, or t
  misc_feature (289)..(290): n is a, c, g, or t
  misc_feature (303)..(303): n is a, c, g, or t
  misc_feature (318)..(318): n is a, c, g, or t
  misc_feature (322)..(322): n is a, c, g, or t
  misc_feature (342)..(342): n is a, c, g, or t
  misc_feature (432)..(432): n is a, c, g, or t
  misc_feature (439)..(439): n is a, c, g, or t
  misc_feature (490)..(490): n is a, c, g, or t
  misc_feature (493)..(493): n is a, c, g, or t
  misc_feature (502)..(502): n is a, c, g, or t
  misc_feature (506)..(506): n is a, c, g, or t
  misc_feature (522)..(523): n is a, c, g, or t
  misc_feature (527)..(528): n is a, c, g, or t
  misc_feature (619)..(619): n is a, c, g, or t
ggtctgtggccggaggctgatcaggttctagaacagatcagacatttgtaatgatgcctgaaataaacactaaccacctcgacaagcaacaggttcaactcctggcagagatgtgtatccttatgatgaaaatgacaataaaatggagctgagaccaagaagaatgtcacctgancgagaacatgagaaaggattatgcatcgagcttnnagtgtcttcttattcaccaccgaaaataagcttctgctacagcaaagatcagatgctangattacctttccaggtngtnnacgaatacgtgtngtagtcatccattangcantccagccgagcttgaggaangtgacgcccttggagtgaggcgagcagcacagagacggctgaaagctgagctaggaatcccttggaagaggttcctccagaagaaattanttatttnacacgaattcactacaaagctcagtctgatggtatctggggtgaacatganatngattacatntggnggtgaggaagaatgtnncttnngaatccagatcccactgagattcccagctaatgctaaggtggtcaaagggaagaactaaaagcacctttctgcaaaaaggccgccagggcn

SEQ ID NO: 680347 - DNA, 946 bp, Homo sapiens
ggcccagtcactgagccgccgcgagattcagcagcctccccttgagccccctcgctcccgaagtccgtccccccctgcccgcttctccgccaacgcggcttctgagccgtccaccgaaggaaaaggaatcgtatcgtatgtccgctatccaagaatctccactctttcgacccctttgctgatgcacgtaagggtgatgacctgttcctgcctggccactgaggattatatccatataagaatccacagagaacacggaggaagaccctttactatgtccagggatcgctggattgattacgataaaaggacactagtgacgcccgttaccgcaaaaagtttgcctgcaaatggtactgttaatgtgagcatccggaatatggagacacgtacattcaggctacaagggtgaccaacgcaagaaacatattgccaggttcctcgtaggagatgtgcacgtgttaaaggacgatcagtgaaggtccatgggttaaaaagtgcttgtggcctcactgacaggctacgtgacgggattccttgccagtgagtacaacatccccttctctcccttgtcaccaggtttacaaacaacctcaacaggtggttattatagtacccatgggcggtccgcttataactgggacctaggtgtacgtcctttatgcactaagtgagaagagccatgctggtctagttcttgaagtcctcaatttaaaagacggctcgcaaatagcgcctgagggttaagccgtgaaccagcaaaccggatgttacgcagccaagtcctaagattaaacaattgcgggaccctagcacctggaggacgaccataaaaggtacacgaaccgcgattcaagaacgtgagaacccggctaaaggcgtggtacctgtccagcggcacaaacctcggagactcacgcaaccaatggacaaacaccgtggcatc

SEQ ID NO: 680348 - DNA, 81 bp, Homo sapiens
gatccaagggcacaaggagatgagcaaggtgtggaacgacctgaggcccaagctcagctgcctctttgcgggaccacacag

SEQ ID NO: 680349 - DNA, 160 bp, Homo sapiens
gcgggagggggtgatctacatctctctttacgccggtttctattgacttggtttctcgtgtgaccgcggtgtctggcgcgatattgatcaaccctggggttagtatagcgttagttacacttactgatatattagctaaaaggttaatcactagctgttt

SEQ ID NO: 680350 - DNA, 303 bp, Homo sapiens
aatgttactactcactgtcagtcatgtgccctggagaatgctgaggacggtgagcagcgcagaggcccacggggagaccaccttgtagcctacgtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctca

SEQ ID NO: 680351 - DNA, 1033 bp, Homo sapiens
gagagagagagagagagagagagagagagagagagagagagagagagagaggcaaatatctctaaagcacatgacgagtgacatcactcgatcgctgcagagacacacgctcgtcgcacggcgactaatgagtgacgctagtatgacctcttgtcgtggaccacctctcaggagggccaaaagggtgtggtgtaaccacagtagtcgcatacataccccgaaagtttcccgagtaatatgtatctctctcctgtcctctcgtagtataagacctatcctctgatgtggtacgactgacccaggtggtatgaagaacccaatactagtgagaagttccacgaggcgtgtctctgacgtgagtgatcatctcactcatctgttgtagagatagactgtgtgtcttatctctcatcagtatggcccatgtgttgcctctcatcagagcgtcctgagtagtggaatccgctgcgctgtcgtgggttatcatcacgaagcggggcaccgacactacggaggagcagactatgtgtgagagactattaccaaagtgagaattgtagcgtgatgttgtcgtgcctttcctctctcgttgaacaaagcgagcgagatttggtcgtcgtggtcatctcgaatgataaaacacactagttctaagtcgtagttgtaatattaacgctccgtggggtgatgttgttgctaaaactacgatcgtgatcccacagagtaagtgaaagaaagcaccaacttcgatgatggatggtgtgttgatccagtttggataggtgcgcagcattatcgtcagcccaccataaataaggcaagtcaaacactcattattcctaatcgcttcctctcgctgatgggtgttggtgcaccaaagtgcttgtgctccaaagtgattttttgggaatccctgcgtctttactggctggcgacggcctgaaaagcaacgactccaatattttggccacccgacaacaggtcttcatctgacaacaacgggtgagctggttctctcctataattggtctcc

SEQ ID NO: 680352 - DNA, 798 bp, Homo sapiens
ccaccaccaccccccacccacaccacatacactaacacttacgaaagcctgcgcttaaatctcgcacgaggaatcaccatggcgttatgggaccctgtacactgtatcctgaaaactggagggccttcaaggctctcatctgctgctcaagtacagctgtgaggctcagtgtcctgctgtgctctcctgcaccaccccacttccatttatggccaaaccaacctgcacccctgaatttctcctgcaaatttcctgcctgtgcaatggtcccagcatttgatgtgtgtgatgatgtgattctgtgtgttttgacgatgcaacgccattgcctactatgtgagcaatgagtgagctgcgtgggaagtactccagagtgcagcagcccagtgtgtgtgcagtggtgtgagctattgctgattcccgatatagtgcccccagccagtacctgggtgttccccaccttgggcatcactgcaccacaacaaacacgtgccactcgagaactgcgcaggcggacgatgatgaggcgaatatctggaggctgctgtgacttgcttacattgaacgcacgaggactctctccatggctgggccgaacgcacgtgacactaggcctgaccatccacgagttcgtcttgcccccgctggtctgttggctccttcttcgcgcagggttcctacggcgccctctcgttacctctcccgcccttttccgcactgcctgtcccgctcggcttgcccttcatcgcttctccccgctccccgctgtccgggctgtcttcggagctcgtcgtaacc

SEQ ID NO: 680353 - DNA, 475 bp, Homo sapiens
tcctaaagctcaatgtgttgggctctctggtttcatccttagagaagcatgagaacagattgaaaagttaggacatcataatgtgcagagtgtgtcgaagaagaaagtgagcttttccccttgagaaattctgcattagttctatctttccaggcaaaacaaatgggtatcttttcatacaaccattttcaaatgaaccttagaaaagtcttaacaatttacgggtacttttatggcaccaggaaatttaccattttagatgggattagggaaagacctcgtaattgagttgtgagtaaagaaaattgatgatgtactaaaccagtaaaattgtgtggaaaagtgttaaaggtcagcatgtctaatgtgggaatctagatatagcttagattcctatggctaagagtatttgctataacaattgatgtgcatgacaattatatattcctactcggtcatactggactgcttcgtc

SEQ ID NO: 680354 - DNA, 131 bp, Homo sapiens
agctggtaccggttttattgatgcacactgtaagttgtgggcctgccccttaatagacttactgtgtgtgatgggaatgacaaatgtgaagctcgtgaagtgagcaatgcaaatgtggaagaaaagaggtt

SEQ ID NO: 680355 - DNA, 778 bp, Homo sapiens
gcctcccaggctcaagtgatcctcctgcctcggcctgccgagtagctgggaccgcagatgcacaccaccgcactggctaatctttaaaaaatattttgtagaggccaggcgcggtggctcacacctgtggtctcagcactttgggaggccgaggtgggtggatcacttgaggtcaggagtctgagaccagcctggccaacatggtgaaaccccatctctactaaaaataattagctgggcgtggttgtgcacgcctgtaagtctcagacgtcccgagtagctgagattacaggcgcgtgccaggcacgcctaggttaattgtgtgtactttgtataagtagtgatagggtttacgctcgatgatttggccaggttgatctacgaactcctggctctcaggtgatctaccgtgccttggcctccctgaagtgctgggattacccggcgtgagtccaatgcgctccggctgaaaggccagcacttcacgcatcgatctttggtatcctggagggtgggcagaaagccagaggcgccaaggaccagggccctagtgccaacgaggggacgcgctgcgtgcgtggcgcaccttgctgactgggttgctagtaaaaccccgtgggagggggctctggacgatcctttgctactctcgctgtggtccacgcgctccggggcacttggatgccatcggtctgccccttttgcgccggacggttcctcggagggtgccctgtcatggactctctgacctcatttgcgtaatagcccgcgggtataa

SEQ ID NO: 680356 - DNA, 317 bp, Homo sapiens
aaggagtgcagataaaataggagtcattaagattaccatggggaaattcaaattgttataagctacttctgttccctggaaaagcagagccaggagagcatacagcatagctcctatgtagtgccgtatatggaaatggggaaaagtaaaattaaatgaacaggaggatttggaagcacaaataaataaggcaaagcaagcttattggctaaatacgggtaactaataaaacgtcctacctgtgaaataactattcagggaaagaaatttaaaggattacgtactacttctgtggatcttagctggcacattcccct

SEQ ID NO: 680357 - DNA, 616 bp, Homo sapiens
atgacccaccaatcacatgcctatcatatagtaaaagccagcccatgacccctaacaggggccctctcaggcctcctaatgacctccggactagaccatgtgatttcacttccactccataatgctcctcatactaggtctacataaccaatgatactaacgcatataccaattgatggcgcgatgtaacacgagaagagcacagtaccaagggacaacagacaccatcccggtccaaaaaggccttcgagttacgggataatcctatgtattacctcagaaggtttatgtcttcgcaggatttctcgtgagccttgtaccactcccagcctagccgcctacccgccgcaagttaggagggcgactggcccgtccaacaggcgatcagcccgcggaagatcccgttagaagtcccactccgtaagcacatccgtatgactcgcgatccggagtatcaatcacctgagctcaccatagtctaatagaaagcacccgaaaccaaagtaattcaagcacgtgtcatgacaattgtactggggtctctattttaccctcctacaagcctcagagtacttcgagtctcccttcaccattttccgacggcatctacggtcaa

SEQ ID NO: 680358 - DNA, 408 bp, Homo sapiens
  misc_feature (5)..(5): n is a, c, g, or t
  misc_feature (11)..(11): n is a, c, g, or t
  misc_feature (21)..(22): n is a, c, g, or t
  misc_feature (24)..(24): n is a, c, g, or t
  misc_feature (27)..(27): n is a, c, g, or t
  misc_feature (33)..(33): n is a, c, g, or t
  misc_feature (304)..(304): n is a, c, g, or t
  misc_feature (315)..(315): n is a, c, g, or t
  misc_feature (322)..(322): n is a, c, g, or t
  misc_feature (358)..(358): n is a, c, g, or t
agggnaagaantactcgtccnncngangagttntatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcanaaatggggcanagggacnccctttgggcgtggcttcctggtgatgggaagggtnttgtgttttaatgccaataaatgtgccagctgggcagaatgttaaaaaaa

SEQ ID NO: 680359 - DNA, 348 bp, Homo sapiens
  misc_feature (5)..(5): n is a, c, g, or t
  misc_feature (11)..(11): n is a, c, g, or t
  misc_feature (21)..(22): n is a, c, g, or t
  misc_feature (24)..(24): n is a, c, g, or t
  misc_feature (27)..(27): n is a, c, g, or t
  misc_feature (33)..(33): n is a, c, g, or t
agggnaagaantactcgtccnncngangagttntatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcaccggctggactctgtgcagggcctttgctatgggacgatgggtgcacccgacgatagtctgggttggagaaggaccggtt

SEQ ID NO: 680360 - DNA, 147 bp, Homo sapiens
gaacccggccgaagcccggttctctgctctctgcccgcccccctgccgccgtcgtaagacaggctccgtacaccgagcgacggggttgtctacctcgccccggggcggcaacttctacgggtactaccggtcgacgtcgtgtgtacc

SEQ ID NO: 680361 - DNA, 911 bp, Homo sapiens
agcgaggctggtccggtcgaggttctttgatcggagcagccggccggccctcactcggagcagccggccggccctcactcggagcagccggccggccctgcactcggagcagccggccggccctgcactcggagcagccggccggccctgcactcggagcagccggccggccctgcactcggagcagccggccggccctgcactcggagcagccggccggccctgccggacccgggcactgaggggcttagctacccgtggccagcggctgtggagggtgtactgggtcccccagcagtgccaggcccaccggcgctgcgctcgtatttctcgccgggcctcaagctgccttcccgtggtgcagggctcgggaccttgctagctccgcctattgccttgagcctccccacttccctctagttgggctccttgtgcggtccgagccatccatcgaggagcgcctatcccctgctccacggcgcccaagtcccagtcaatcaacccaaaagggctgaggagttgcgggcgcacggacggcggaactggcaggcagctccatctgcaaccccgactgcgggattccacttgaggtgaagccaactggggctcctgagttctggttgcgggaccgttggaagaaacctattattgatttaagccccgggagaatgtaaatacaccaatcggatactacaagtagtctagactcaagggttttgctaaaaagacaatcaaaaacagcaaacccatgatgtcttagcacttcaaagggtttggtgaaattgcaacaaatggaacacccctgatatactagagactcctgagtagaagacgtatggagaaacattggtgtcaacctctagggatttataaaccgcaacaaatcaagagccctgcttacaaacagaaca

SEQ ID NO: 680362 - DNA, 367 bp, Homo sapiens
agggccatggatgggtgtaggtctgtggcctgttaggaaccaggccacacagcaggaagtgagtggcaggtgagtgagagaagcttgtctgtatttacagccactccccattcctcacatgactgcctgagctctgccttctgtcagacgagcttcaacattagattctcataggagtgcaaaccctattatgaactgtgcatgcaagagacctaggttgtgtgctccttatgagaatctaatgcctgatgatctgtccctgtctctcagcactcccagatagactgtctagttccaggaaaacaagctcagggctcccggaagggctcccggagggttaaggggtcccggagggttaagggctcgg

SEQ ID NO: 680363 - DNA, 722 bp, Homo sapiens
agcggatggaggcggtgaaggcggaagcgtgggagggggccgcggtggcccaggacctgctggctctggggtatggaggtgtcccgggggcggcgtcacggggcgcctctatgcccaagacttcacgtggctgtgcgtgcggttggcggcggagctggcgacgctggtgcgccctctagcacgcagctacgatggcgtggctgctggacggtgctgagcgccggcgagggccctggtgcggaggaggagctttctgcggcagttgggcagcctgctgcgggagctgtactggccggatcgtgcgctctgcgtgcgggtgatggtgcgagtgcgcttcgggaagccggtgccggactgcgcctgctgcgctttctctgctcagagctccaagccacccgggctcctgtgcctccgctctctgctggatccgagtcctaagccaccccttggtgaaggggtacgtggagggagccggcatggtccaagaactggaccttagcctccaagccctggggctgtccagagctgcaccaggaaccaccgacaggcagctgctgcaggagattgcatgctaaagatctcagagctgcagccttctctgcccccagggtccctgaaagcccctcctcagctgctcgcgtagatgcacccagatggggaagcgtggacgtctctgtccaaaaagcctcagagatcagtaccgctgctgcgctgacttcttc

SEQ ID NO: 680364 - DNA, 678 bp, Homo sapiens
  misc_feature (477)..(477): n is a, c, g, or t
gagcatatggcaaatctacttttagttctttaaggaatctccatatttttttccataccagcagggtagtgttcccttttcaccacagccatgccaacatctattatttttggattttttaattatgaccattcttgcagaagtaaggtggtattgcactgtggttttgatttgcatttccctgataattagtgatactgagcattttatatgtttgttggccatgtgtatatcttcttttgataattgtctatttatgtccttagccaactttttgatgtgattatttgtatttggttggattttttttttttttgtcttgtgatttgtttgattgccttgtagattctggatattattcctttgttgaatgcttcgtttgtgaagattttctcccactctgagggttctgtttactctgctgattatttcttttgcggtatagaagctttttagtttaattaagttccacctttntatttttggttttgttgcatttgcttttgggttcttgggcatgaagtctttgcctaagccaatgtttagaagggtttttctgatgttaccttctagaatgtttacagtttcaggtctcagaatttaatctttgatccatattgaattgatgtttggctagggggagagattaggaactgttcatcttctactgtgccttgg

SEQ ID NO: 680365 - DNA, 229 bp, Homo sapiens
gctgggtgatctagaggatcccgtgtcccatgcatagttcggacatcacagttacaagtctcgatagcatactatcttaaaagattcattaaggggatgggtacggtggctcacgcttgtaatcccagcacttggtggaggccgaggtgggcagatcacctgaggtcaggagcttgagaccagtctgaccaacatggagaaaccccctctctactaaagatacaaaaaa

SEQ ID NO: 680366 - DNA, 85 bp, Homo sapiens
cactgggaactgggccaggcctgcggcacgcgtatcacggcttcctaaacacctcttatcaccggcaagaggtttatgtgcgaca

SEQ ID NO: 680367 - DNA, 140 bp, Homo sapiens
ctggcgtggtggtggagggagaaaagagttccactggcagcagatttgggcttgatgtttctgatttatttccaggacgacctggagttctcactttcatctgttgaatcttggctttcacttttcattctcttgagcta

SEQ ID NO: 680368 - DNA, 178 bp, Homo sapiens
tgaattttttttttttctatctggtccatctgctggattcatttctccaatttcatgtccattttggtgtgggagtcggggtaaggggtactcttgtcaaaaggcacattggggcatgtgtgtttgctagctcccttggccatgaaaatattttatgatattaaaaaaaattttttga

SEQ ID NO: 680369 - DNA, 908 bp, Homo sapiens
tccgatttatcgttattaattatcaaaatcatgaccagtgtgtaaacttacttgtgaaaatatacagcaactgtggggcttataacacatgagcaaagatgactttaacacgtgcactgtccacatctgtggggtctaaaggtcaaaaacaaagatcacagacaagacgttactaaacggacccctgcagtaggtcccgaattgcagaatcatccaatccccagctatggtcagcacggagatattcagcagaaagaaacccagcaaagtcctctctgagccgttagagtcaacaggcttttcatacacactatggagagcccagccccaataacccttgagaacacggtcccatgtctgtggctaacacggctctcaccgttggcctcaacaccccggggccatgctccctctgcttcttccatccccaccacaacgaaaaagggtatgaccgccgttaatattaatagtaagagaagaacttttgaggccgcaggacagggccgcagaaagcaagctctctgggtagtgccttatgctcacccacctgaggccctgtccaagtgccaaggagcttcccaatcctagagaactggctggtccttaggaaagtattgtctgtgttacgagaaaagggctttccatgaaatttaaggtccccatgcgaatttgttacactttccccctaaaagagaagaacaacccccggtgggcccggcaccccacgggaatgaaagagcatttccccacctcttccgggttaacggtgcgtgttggccctcgaccgcaggggtccagtcccctgaacagccgtgcccatgtagacaccgcgcgggggagggcactagaggaacgcgcaggcgatcacgagaggggaagccgcaaggcacctgtcccatatagaccac

SEQ ID NO: 680370 - DNA, 239 bp, Homo sapiens
agccgatactggggtttcgtgccggaatccaatatcgtcgggaaggccttcttcatctggatgaatttcagcgatctcagccgcatcggccggttcaactgattatgtcgctagccacgctagaaaaccggctggatcaccactttggtgacctagcattgcttgaacaggcgttgacccatcgcagccatggtgcgcgccacaacgagcgcctggaattcctcggggattccgtgctc

SEQ ID NO: 680371 - DNA, 536 bp, Homo sapiens
ccccagaacacctagccgaaagaaccactttcccccttctaggttgggacccctgaaaggtatacaccctttatggaatccgataatgctcagccctacaattttgccttgggaaatattgccataggggcctactctaagttcccttatcaaaggtctcgaggaagtagcatctgttaatttcgaaatcttaccatgtataaacagtacacacctcgtgttgatgatacaatatgtgaggaactttctaaactaaggaaatgctgatcgctcacacttatgaatttctaaaacctaggaagacacgcttggagcgattttgaatatacctaagtcccatttaaggtcaagtttccccgtagatgtatcaaaatacacccacctgtaaattaagatttaattcccgaatggactcaatatgttcaaaatccatctgtccactaatatatacctataagtaattaagtgttattttcgcacaatggcaatctcaaacgtgaaaatgtgctctatgaaaataatttgtttaattaaca

SEQ ID NO: 680372 - DNA, 443 bp, Homo sapiens
  misc_feature (237)..(237): n is a, c, g, or t
tcttgcccgctccactcccacctggggaataattcctgaaatccttttctagtaaaatgcccatgctcctctctcccagttatctacagagtttaagacaagaggtgacgtagtgagtaggagattcgtctccagatcagagacatctgggctttagtcctggactagccacttgtcacactgtggtcttgtgcatattcttagactctctaaatcttatttttctcagctgcttanaggaaataatgggagtttctctttcatcacactgttgtagaatcaagtgagatgtaacccttatagcttccagtgtctcagtggctcagactttgtatagagtctcattcaaagaagctcagtccaagcaccaaaaataacttaaaaagtacttcttcaatctttgttgcttctcttgaataacattacaggagatctcttgcgta

SEQ ID NO: 680373 - DNA, 1230 bp, Homo sapiens
gccggaccccgccagcccagccagcccagacccttactccctccccacgccaggacagacagccgttgctcacgagagaaggtggaggaagaaatccagaccctagacctgcgcgcaccatcatggaccattatgattctcagacaaaccaacgattacatgcagccagaagaggactgggaccgggacctgctcctggtacccgggcatgagagaagcagaaagagaaagaccatgcacggccatggtgtaactccacaccatccggaaggcggggaccaacagatcgagcaacactcgacacgaggccttcccgggatggcctgaacgctcagtgactgcatgcaagggagcgtccatatcaaggatgaaacgacattggaccaagcccaagagcgacaggcaacgactgcacacgtcgcacaaaagaatcatcacaaaacgatcaaacaacggaacctggcaatacccacgcaaccccagacacaaaggccgtcaccaacagggaaggaaccaaaccggggaaaacccgcacgacacagcggcggcaagcggaacccgacgaacgccatagaccaccactgcgagccaaatccacacctgcgcacgccagcaaatacatgcaacacaacgggcacaaaaaagaagaaaccaaacacgaaagagaagccaaaagcaagaaacacacacgaacaacaaggcaaacagccacatagcgccacacggtagaggaagaacaaagaagaaacaaaagacaaagacaccacatgaaacccaaaaacaagaaccaaaacaataaccaagacaccagacacacaacatccacagaaagggacacacagacaagagacactcaaagaaaaaacatacagcacacaagaacaacgcaacacaagagcaaaaacgagaaccaaggcaacgcggaacagtaggaaacagaacgaagaccaaaggccctgcaaggaagaagaaaaaacaaaacacaagacaacaccccacagaaagcactgagaagaaacacacgccatacagaaacgctgggcaaaaaaggaacagaaaagactgagaaataaatctacaacaacaaggcaacgagaactagagcagaaaaacacaaaaacaagacaaatgcacgacgctcaagacaagagacaaaaagacaaaacaagaagacaaaacagggagagaaacgaatcaaaaaagaaccaagataacgacggacaaaaacga

SEQ ID NO: 680374 - DNA, 662 bp, Homo sapiens
  misc_feature (546)..(546): n is a, c, g, or t
  misc_feature (554)..(554): n is a, c, g, or t
gtgcaggctggagcgcaatggtgcaatctcagctcactgcaacctctgcctcacgggttcaagtgattctcctgggagatggagaaagtctccattggtttatagttcagaattgaactggtataattgggaatgtctccatttttttggtagtcatgttcttcattctttagctttgtatcttctcaagttgaggaatgtgctaaactgagtagtaaatttaaaaaaggatttaagagagatcattataaaatgaattgcttcttctttgtaagatacaggaagtttagtagctttcttgaagtctcaaatgagaattgagatgttgaagagaacatctactcttttgctatttagtgatgggctaaaggcaatttactaatgaaatgaacaggcaggaaacaggccattgactacagaagtaattaccaaaaaaagtacttctttttattttaagaacttgcaacccatatataaaagaatccttcccagtgaaataagtattagttaaccacaacttgtgatcatgttaaataggaagcattnagttgcanaatttgtggggaggagcacagacagtgctttgaatggttcattcgtaatttgacaaagttgattaggcaataatccacatgcagaagttgtgagattactgctgtgtt

SEQ ID NO: 680375 - DNA, 230 bp, Homo sapiens
gggatgattgcccaacatggtgaaggtactcaatgtccctaatggtaaatttcccaacccctttcccataatttttaaaaagctttattagctccattatgttatgatacttaaatgtcataccaatagcattctgtacgcttccctaggataaaaacttcggatttatatgcatctggaaaagaaatttttccctgtaatttgcaaataaatgaatttctaaaaatcta

SEQ ID NO: 680376 - DNA, 432 bp, Homo sapiens
  misc_feature (194)..(194): n is a, c, g, or t
ggaaaggttcctcccccttgggaggggaaccctgataatttttctcttagggggggcggtccccctttgggggagccctaaggggggggagggtttttttagcccccccctcaaacccccccaattgggggttaagccctttgttttggggggaacccccctttaaaaaaaactttgtttcccctacccggggntcccccgttcccccccaagttacctgggggggttccgggggtgggggattttcctttttaaaaacccccccggtttttggggcctttttttgcaaagccttggtgggcaaatttttttttggttccccccaaggccgggcccgggggccccaattttgagccccaggttttcccttgggaaaaaccccccctttgggggggggaccccggaccccctttaaaaaaatttttggtttta

SEQ ID NO: 680377 - DNA, 169 bp, Homo sapiens
gctcggaaggtagtcgcctctacctataaatcttcccactattatgctacatagatgggtgtgctctttaagctgtacttaagtagctcgtctggtttcgggggtcttagctttggttctccttgcacagttatttctacgtaatacattactgcgaccggtctcgggg

SEQ ID NO: 680378 - DNA, 185 bp, Homo sapiens
aatcctccctcactccccaggtgctgcggcgtgacccctctgtgattacaacccctgctctcgctgctccatgcccacaggtgctgtgcgtcagtgccacatcagcatgctcttgatcactttcttgactttaaaagcgtcctcttccctccctccctccccgggatacagctccccgggataca

SEQ ID NO: 680379 - DNA, 178 bp, Homo sapiens
ggtggcgatctagaggatcccagttcaagaaatcagcagactacaaggcttataaagaaaaacagcaaacctgctctggtctttcaaccttgtccccggtctccagatgcagttacttgcacatcttttatcagtttatttgggtgtttacattccgtatttttaaacatactgctta

SEQ ID NO: 680380 - DNA, 968 bp, Homo sapiens
agcacagagcgctcgccttatgcctgatccagcgcccgtccacaccgcgccgcagcgtcaccatggatgatgatatcgacacgcgactacggtcggtcgacaagcggctccggtcatgtgcaaggccggcttcgcgggcgacgatgccccccgggccgtcttcccctccatcgtggcggcgccccaggcaccagggcgtagatggtggtgcatgggtcagaacggattcctatgtaggtgcgacgaggcccagagcaagagaggcatcctcacccgtgaagtaccccatctgagcacaggcatcgtacaccaacttgggacgacatcggagacaaatctggcaccaaaccttctacaatgagctagcgtgtggctcccagaggagcaccccgtgctgctgaccgagtgccccctgaaccccaaggccaaccgccgagaagatgacccagatcatgtttgagaccttcaacaccccagccatgtacgttgctatccaggctgtgctatccctgtacgactctggcgtaccactaggcatcgcagatgcgactcccggtgacgagggtcacccacactgtgcccatctacagaggggtatgccctccacgcatgccatccatgcgattggactggctggacgggacttgatgacttactcatgcagatcctccccgagcgcggtacagttcacaacagggcgaccgggaatcgtgcggacataaggagaagtgtgctacgtcgcctggactgcagcagagatgccaggtgcttccactcccctggacagagcagactgctgacggcagggacaaccaatgaaagaaagaacgagtccgtaggacttttcactcctctggcagaccaggaccagaaaacctacccctatgtatgaacgacatgaccaccgtctgcgccgacggaccctacgatcgccaccaaaacaacaccaacgagcatacacaatagag

SEQ ID NO: 680381 - DNA, 262 bp, Homo sapiens
  misc_feature (4)..(4): n is a, c, g, or t
cagngacttgttcatgacagagctcctttaggacattataacatgcttcctagattaggacttgcgggttctttatgttctggccaggtaaaaaacattatgctgcatacttgctgatgctgagggccagtcttctttttctgagtataggcaacccctcctcccaggccataactgcccaacaaaacagcccttaaaaatatcccaacattcgtgggtaccatacgttcccatttttatagaccattcgaaccggttggcg

SEQ ID NO: 680382 - DNA, 862 bp, Homo sapiens
  misc_feature (468)..(468): n is a, c, g, or t
  misc_feature (556)..(556): n is a, c, g, or t
  misc_feature (689)..(689): n is a, c, g, or t
  misc_feature (742)..(742): n is a, c, g, or t
  misc_feature (816)..(816): n is a, c, g, or t
  misc_feature (824)..(824): n is a, c, g, or t
  misc_feature (854)..(854): n is a, c, g, or t
ctgtcagttcatcaaactcatcctccgtccagttttgtttccttgctggctaggagttgtgatcctttggaggagaagaggcgtttttcagcctttttcagctggtttctctccgtcttcatggatttatctacctttggtctttgatgttggtgacctttggatggggttttggtatggatgtcctttttgttgatgttgacactgttcttttctgtttgttagttttcccttttctgtttgttagttttccttctaacagtcaggcccctctgctacaggtctgctggaggtccactccagaccctgtttgcatgggtatcaccagcagaggctgcagaacagcaaagattgctgcctgttcctttctctggaagctttgtcccagaggggcacccgccagatgccagctggagctctcctgtgtgaggtcctgactgtcccccagtcaggaggcacgggggtcanggacccacttgagggggcagtctgtcccttagcagagctcaagctctgtgcggggagatccactgctctattcagagccagcaggcangaatgtttaagtctgctgaagctgcacccacagccaccccttcccccaggtgttctgtcccagggagatgggagttttatctgtaagcccctgactggggctgctgcctttctttcagagatgccctgcccanagaggaggaatctagagatgcagtctggctacagcggctttctctggctgcantgggctccacccagttcgaactttctggcagctttggttatgctgtgaagggaaaactgcttattcacgcttantaatgacngatgcccttttccaaccaaacttgagtgtnccgggtgg

SEQ ID NO: 680383 - DNA, 208 bp, Homo sapiens
ctatgagaaatctgggccagaggaggactacggtacatgaagattatgattctacgtatgacagctgcattggaaaacagtatcattgataagtgttgtggagacgggtgcacaacaatgtgaatgtactatacagcttctcaactgtacacttaatacatgatcaatgataaattttatcattgggccgggccgcaggtctgtgagg

SEQ ID NO: 680384 - DNA, 135 bp, Homo sapiens
agtcgtggtcgtgcattcgatcaggtgtcaccatcgcgatttgcagcggcacttcgggacgcgtctgcggctctgatctttccaccagcgcttcaggccttcgctgccttcgtccgccatcgcctgattcatcag

SEQ ID NO: 680385 - DNA, 204 bp, Homo sapiens
aaaagtagtattatcatagaggatagctccatgcataatattgcatggagcttccagtgggacaggatgtggagatgggagacagtgatattgatgaacctgaccctgggtagggagggtctctggatagccctgacctaggttaatgtgtatgtgtctgtcttagtttcaaaaaaaactgtttaaaaagtataaaaaaaaaaa

SEQ ID NO: 680386 - DNA, 323 bp, Homo sapiens
  misc_feature (175)..(175): n is a, c, g, or t
  misc_feature (277)..(277): n is a, c, g, or t
gccaattttgcattttttataaagatggggtctctatatgtttcccaggctggtcttgcactcatgcctgtaatcccagcacttcgggaggccgaggcgggtggatcatttgaggtcaggagttcgagattagcctggccaacatggtgaaaccccatctccactgaaaatacanaatttagccgggcgtggtggcacgtgcctgtaatcccagctactcgggaggctgaggcaggagaatcacttgaacacaggaggtggaggttgcagtgagccnagatctcgccacttcactccagcctgggcaacagagactccgtctg

SEQ ID NO: 680387 - DNA, 888 bp, Homo sapiens
  misc_feature (176)..(176): n is a, c, g, or t
  misc_feature (215)..(216): n is a, c, g, or t
  misc_feature (888)..(888): n is a, c, g, or t
aggcactaggaagaagaacttccagcccaggagaaataagcatctgctttgtctgccgagctcagaggagagcccagacccctcccgcagccagagggctggagcctgctcagaggtgctttgaagatgccggaggcccgtctctgctgttggcatctgtgttgctgggcctggtnctgctggtggtgctgctgctgcttctgaggcactgggcnngggcctgtgccttatcggctggaacgagttcatcctgcagcccatccacaacctgctcatgggtgacacccaaggagcagcgcgttccgtgaaccaggttgctgctagcttgcggaagcccgggaacgcccaagagcgtgttggaggccattgacgaccttatctgcgagcagaaaggagtgggccatgaaacgtggcctaccaaggaaaggcaagatcgtggacgccgtgattcagggagcaccagccctccgtgctgctggaagcttggggggccctaccgtgtggctactcaggttgtgcgctatggcccgcctgctgtcaccaggggccgaggctgcatcaccatcgaggatcaacccccggactgtgcccgccatcacccagcgggatggggcatttccgctggcgttgaagcgacaaggtcacccttgtggttggaagccgtcccaggaaaatcattcccccaaggttgaagaacaaggtttgaatgtggaccacactggagcatggtcttcattcgaccactggaaggcccgggtacgtgcggacaccgcttctctgggaagaaatgtgggctgctgcgaagcggcactgctctggctgcaacagtgatctgccggtggcaagatccttagacatgtcgggagaacgtttttgtcacccaaattn

SEQ ID NO: 680388 - DNA, 137 bp, Homo sapiens
atactgtatatgattctcctgatcggtaactcattcagtttccatatgcgaatccagtgctatctgctgtattcagaactcttacatcggttttccaaaccccgatttgaagctactacccgtcgtagcttctaggg

SEQ ID NO: 680389 - DNA, 327 bp, Homo sapiens
acacttgaaacgtaagacagagggtgcagtgagacagatcgtgccactgcactccagcctggatgccagagcgagactccatctcaaaaaaaaaatttgagaatccaaagataggctgtaagctagatctttaaatacttgaaatatacttggtaaagatcacagaaaaacactctctaaggagaggttacagaatgttcaaaagcccaggggtgggataatgctgggggatttcagggaaattaaaggagactagtgtcactgtaacttaggtactcaagaaataggacaagcacagcaggagttagatcataaaggtcattatag

SEQ ID NO: 680390 - DNA, 207 bp, Homo sapiens
taaaacctttccggaaaattttaagcgggggccaagggcccccccccaacctccccccaggttgcccgttgagccagaaaaaaaaatttgccctttaaaaacccagcccaaggagggccccggggggggtcctcccttgcggcgggccccaaaaacttttggcttcggttcttttacaaaaatttttcctttaaaaacccaaatttt

SEQ ID NO: 680391 - DNA, 153 bp, Homo sapiens
gctgatcctagaggttcccgggccagatagctctcttggggttggggtggtggtgcttggcagggaagcctctctctctctcttcccggctctcgtccccttccagcgatctctggcttttttcctctggatggagggcaatcctaataagaa

SEQ ID NO: 680392 - DNA, 157 bp, Homo sapiens
  misc_feature (16)..(16): n is a, c, g, or t
acggactgatcacganccgggccagttcgtcgagcgaggtctgcccctccatcacgcggcgcatgccgtcctcggccagtgtcggaatctttggcacgcgcggtattccggacttcgcgaaaggttgcacggcgggcgatcagtccgttcgcatgtt

SEQ ID NO: 680393 - DNA, 753 bp, Homo sapiens
tgtaccctgctcttattctccttcattcctgcagcctcctttgccctgtgacctgcatgtactgggacggcacctaaagaggataccgggaccgctcctgaagccgcgagatgatatcaagcagatgcagcctgaccattagggccaaggccaaattgcaaaaaaaaaaagaagtttgcctttatatctactccaatccacgatctaaacttgggaggtcaagtcctgtggacagatcagaagacatagttccctccttctgggtgctccagatccatacataacactgatcgtctgggaaggaggatgaggatggcaggatgggtcattccatgctacatgacagggagagccacatgtagatgcccaaggcaccagctagccatccatatggacatgaaaaggactgatcagaggacagtgaattgtgcataatgagagctgggaaactgggaccatctatgaagaccaatggcgagcacagggatgagaggccacccaatcaagacaatgttcatatgcaaagaggacactggccaaagcgaagaaccacctgcaagaaatccatgctgatgccctagacatgatggaatggaaagacggattagtcccaccccctgagtaacagtgggcgactggaaattaacgaccaacgcaaaggcagaaagacacaccacagatagcacgcaacaactaacaggaaactgagacacacggagaaaaacaggacacgaagaaccaccatacaaaaga

SEQ ID NO: 680394 - DNA, 1189 bp, Homo sapiens
  misc_feature (161)..(161): n is a, c, g, or t
  misc_feature (183)..(184): n is a, c, g, or t
  misc_feature (189)..(189): n is a, c, g, or t
  misc_feature (213)..(213): n is a, c, g, or t
  misc_feature (239)..(239): n is a, c, g, or t
  misc_feature (899)..(899): n is a, c, g, or t
  misc_feature (1030)..(1030): n is a, c, g, or t
caacggaggagagaggtatcaccaagagatctgagttggagtaagggaaaagatacccaatatggtagtgttgtaaaaaagaccaacacgagattatgcaggagaccacgacaaatgtggtatagagagaccgctgaagcgtgaaacttggtgaatcattnaactagggccaccccaggaggnnggctngggcgggacagggtctcccgctgncaggtgcgcggaggcaggaggccggngtggcgtggggtcgcatggctgcaggcttcagcgttcagtgattgtcgctgggcacaggcgcggcgctggtgccacggcagcctgcaccttctccaccagcccggcccactggcgctgcatgtcttccaccaggggctcgaaccagctcttgaggcgggcctggaaggcctcggcctgcaggcgtatctgctgggcctgctcctccagcttggcgcgcacctccgccacctgctccttcacctcgtccaggcggtcgcgggtccggctgcccatctcctccatccgcgcgcgcagccgctcgccccaggcctgggcccgctcctgtagcggctggccggccagggagcccacagtgcggcccgcacgcggccctgttccaccaggggccccaggcgctcgcggatggcgctgaggccgcgctcggcgccctcgcgggccccggcctggtacactgccaggcgcttctgcaggtcatcggcatcgcggaggagccgcttacgcagcttgcgcaggtgggaggcgaggcgcacccgcagctcctcggtgctctggccgagcatggcctgcacctcgccgcggtactgcaccaggcggccggcacacgtcctccatgtccgcgcccagccgggcctgcgccgcctgcagctccttggacaccngtgcccgcgtctcctccgccaccggggtcagttgttcctccagttccgatttgtaggccttcaactccttcatggtctcgtccatcagcgccctcagttcctgggtgacctgggagctgagcagctcctcntgcacgtgctcacacagtgtatgcacccagcgcaggtaatcccaaaagcgacccagtgccagttcccagcgctggccgctctgccactcggtctgctggcgcagctcgggctccggctctgtctccaccgctgctcctcgtccgattacacaccaggca

SEQ ID NO: 680395 - DNA, 938 bp, Homo sapiens
  misc_feature (161)..(161): n is a, c, g, or t
  misc_feature (183)..(184): n is a, c, g, or t
  misc_feature (189)..(189): n is a, c, g, or t
  misc_feature (213)..(213): n is a, c, g, or t
  misc_feature (239)..(239): n is a, c, g, or t
caacggaggagagaggtatcaccaagagatctgagttggagtaagggaaaagatacccaatatggtagtgttgtaaaaaagaccaacacgagattatgcaggagaccacgacaaatgtggtatagagagaccgctgaagcgtgaaacttggtgaatcattnaactagggccaccccaggaggnnggctngggcgggacagggtctcccgctgncaggtgcgcggaggcaggaggccggngtggcgtggggtcgcatggctgcaggcttcagcgttcagtgattgtcgctgggcacaggcgcggcgctggtgccacggcagcctgcaccttctccaccagcccggcccactggcgctgcatgtcttccaccaggggctcgaaccagctcttgaggcgggcctggaaggcctcggcctgcaggcgtatctgctgggcctgctcctccagcttggcgcgcacctccgccacctgctccttcacctcgtccaggcggtcgcgggtccggctgcccatctcctccatccgcgcgcgcagccgctcgccccaggcctgggcccgctcctgtagcggctggccggccagggagcccacagtgcggcccgcacgcggccctgttccaccaggggccccaggcgctcgcggatggcgctgaggccgcgctcggcgccctcgcgggccccggcctggtacactgccaggcgcttctgcaggtcatcggcatcgcggaggagccgcttacgcagcttgcgcaggtgggaggcgaggcgcacccgcaagtccttagtgctttaggacgaacattgactggaccttctcttgggacttgaccaaggcggccttccacttgcctcatttttcccttccaaccggccaatggccgccttggagattttttgacaaaccggacccacctttttttcctcaacaaggtttagttg

SEQ ID NO: 680396 - DNA, 597 bp, Homo sapiens
  misc_feature (566)..(566): n is a, c, g, or t
tcaagagcaaccttcaaagtcagatgacaatgtgtatgccttcagacttctcatggaaaatgttttcccctgcaattctatactccaaagtataagtatagaataaaggcatttcagaccctttaaatctgaaatctttatctcccatgcatcctttctcatatgtgcaacactacacaaggagtaaaccagtaaataaaaagacagatatatggattccctattgcagtccgtacgtcagaagtctcctaaattcaaaaacgggccctgtccatgtggagccaaatgcatcttggaagacattcctagtagggtgcaaacttccagagacctatctcaggttcagtgtccacccaccctacttattcttcagtttgtcttcactagacagttgtactctgtgcctttgcaaaagtcaggatgtatatactctttgagtcaggtgcaaggcaccatttgtcttaaatttattctcattgctgtttcaagtgacctcaaagcaggcagcattttcttgcaattccatctagttattttttatgatcatggaagaacctaccattatngctgttacctgtggaaatgagggaagatgta

SEQ ID NO: 680397 - DNA, 345 bp, Homo sapiens
  misc_feature (19)..(19): n is a, c, g, or t
cccagttacaagtaaaaanaatgaaatgtgcaacaggcataaagaaaatggggaaatgggctgggtgtggtggctcacgcctgcaatcccagcactttgggaggccgaggtgggtggatcacaaggccaggagtttgagaccagcctgggcaacatggtgagactctgtctctaccaaaaatacaaaaaaattaactgggagtgtttgcacgtgcctgtggtaccagccactcgggaggctgaggcaggagggggaattgtttgagcctgggaggtggaagttgcagtgagccaagatcacgccactgcactccagcctgggtgacaaagtgaaaccctatctca

SEQ ID NO: 680398 - DNA, 931 bp, Homo sapiens
catgaataggggtgcagtgagttacacacacattgaggggggacagcgatggtacaggcgcaagccacaggactagtagagagtagaggtgggggccggcagagcaaggaccccaggaccaacattcttggccaagttggactggagagcactgtcccaagggtgccccaacctcagccatcatgcatcccaggagcatggacaccaccagaccaggcgatggtatcatagcatccagtggatcttggagacagatcccagagatggagatcagcatgggagagccgcacatagcttggccctgagtgcgctcgcatcactggttactacttctagccactttcctgctccaacaaatggagagaaagggggtgtgatctggagactcccccattacttcataggaggctgtgatgggagaagagctcagtcacccactagacgcagcactcaggatcacactacccagaaccccagcagtgacagcatgtgtaggcctcagaccagggatcagcgaccatgtcaggacaaggggtgacatgggagaggacggcaacaggactcatcccaggcaccaaagaaccacaccactcgaagacaccagagaagacccacacagagcaactaaagactagacagcgagacacacacacaaagacagcaatagccaacaggactgaacagagcacaagacaaacacaaacaaagcatgcagaagcaaaataacagaaacaaaaacagacacgacaacagcaccaaacatgccaaccggacgcaataacccgcggacccaaggcaaccacagaacacccaaagacagctgaaggacacacaacaaaaccaaggaaaaaaaaaaccaaaacacacacgaccagaaacaaaaaccacacgacagacgaaccacacacagaaaaataaaagacaaccaacc

SEQ ID NO: 680399 - DNA, 165 bp, Homo sapiens
  misc_feature (54)..(54): n is a, c, g, or t
attgcaacattggttcaggctggtgttcagggttccttgttttaggggtatggnagcagcatgtgtttcaagtgctagtggcccagcacagcggggtggatccgctcatatgacaccacttagaataaatcgccagagccaacgacacacagaccacacaacgac

SEQ ID NO: 680400 - DNA, 1512 bp, Homo sapiens
  misc_feature (316)..(316): n is a, c, g, or t
  misc_feature (1098)..(1098): n is a, c, g, or t
  misc_feature (1396)..(1396): n is a, c, g, or t
tttgacgcgaagctcttcagctgatatctaaggacgtagatacaacatacgtcacgaagcctgtggagcgttctgtgggaagccggaggctcggtcagcacgaatggccgcaactagagacatcgtctggggtaaatggcacagaggtgaatgtgtgtaacgcaatgggggaacatgatgtggtacatgtgcaagagtagattgcgacgtctgtaatagttgggaggatcaaagaatgcgtgctatgtatctatcaatatggacacgctatgatgagtggtcgtgacatcgcagctacctaattaattctaaaggntgctcattggacggacgtatcattgtagacgcggagccaaacacacacggacacaccctttgagtccatgtgtgagtcagagtgaactacaggtactgggtgacaattcaaagcagagctcaatggatgggaggactgccaaaacaagcgagcgcaaagtgcggtcaattattcgggcctcggagcatttttctcgagggcgcaacgtcggcagttggcagaatgtgtacacaccttcctttcctaagtggggggcaccgtggtacattcctaggtggactcagcgcccaactcctaccaatgggatggaggctggggcctttgtgacctgtggaaacctgttaatttggggcgtgcatgtagttgtccctttgccgcttctaacctgtgggcaagctccattacttcgcagatagaggccccattgatggtgggatttgcgttcccataggggaacaccccaagccacagcagtttgtaggcaccattgaaattacttttccctttggtgcggattacggccctccaacggacattaggataccggaccccctatttggcgttcaggggactcgaaagagaaagctaggaaacgtttaggagttagggaaccaaagcgcgtgtggggccggtaaaatatgggaattcccaaaacactgggctggtgggatccgcaagcccagaggggattcccctccttggggaaaagcacttcggagaggaatcccacgggagaccccgacactttcttgtgggggattaggttcatactattaaagatncggcagctttggtaatcacccgtgaggaaaacttccggatttgcgttcttctcggaaatttccgacgttcgcaattagctttaaaacacactttttagggaagcggcgcaaccaagcgttgggtggtaacaccgggggcgtttaagccgcaattccgttctgttgtttgtccggaaattataaccactttgtacggggcgagtacagtttttaggagccatttggagttttcgcaaacatctggtttcctctgactttttggcacaccgttgtgacttcctttttgtgaggcaaccanggttccattttgcacatatgcaaaacaggggacacgacaatgatgaaggcggcgcgtaaaaacatcaaaggtcggacagaggagcactccgcacagggaaacctgtgtatacacag

SEQ ID NO: 680401 - DNA, 361 bp, Homo sapiens
  misc_feature (333)..(333): n is a, c, g, or t
gcacagccgcaggccaactctcaactatgttaggtgggtgatggtgcctgaggctactgcctggccttgacggctcacagaggcccctgttcacagtggggggtccatgctctgctggattgtccaggcatccagtaagccaggacatgaacttggctttagagagaggccccagacaccagcaggagctgcctggagcctagagtgcaaggcccctgaggggacagcctcttttccaccctgttcctgctctagagctgcttggtgggaggggatgtgtccaccccagtttccccccagctggcactctgcccagacagcagagcaggaggngcctgagatggtagctccaggagctggt

SEQ ID NO: 680402 - DNA, 808 bp, Homo sapiens
tagtggttcattaacattgaagttatggccaacagcatttcaactcatatttcagagggtggaggttgtggggaggagtgttttcctggagagcctctcaacatagatacacttgtgtggacctaaaatcacccaagctaggagggccagcccatcctggtctgccctgggctgagggctttcccaggagagtgaactttcagtgctaaagccagacagggacagctgctcaccctacctgcctcctaacatctatccacgggttctgcatccaccctttggagtggcacaaaacaaagatgatcccctctttccccaagtagactctgagtgaagacacatcttaggtccacttctcaggctcaatatcctcaatttcttggacctccttcatattgtgcgaggtggcagaggctgcttgctgatcaccaggctcctctcctcttctgcactttccagcctctctcgcaggtaggagtggccacaggagttctagaatgtgagcagaaggcatgtggccacttccaggccctgcctatacacaccttccactcacagtcctccatgctcttgcacaagagggaagctgccctgggtcactgctaggggagggctgacctccatcaggagcccctcctaggtgagcaagccataagcggttgtgctgggtctctgtggttaggggcttacctgtcacagcagtccaatcactttgactggtcacatgacgcaagctcttttgtgaccagtcatctttgaaactttctgcctgttaaactccttttggagtcccgtgtgccgggtgtca

SEQ ID NO: 680403 - DNA, 289 bp, Homo sapiens
attctgagctttgcgattacggcatgactggaaacttagaagagtgggagatacaattctcggagatctgagctacagaagtgcaggactctctctttcctcatcatggtagatctgaagtaataaagaatacagatctcgatctggattatacgatacctgaagatcacctgtcctcttgtatgtccaaattcctagtgatgtgagaggggtctgcatatgtcaaggttgcaatacaacaagcaggctccagatttaggtgacctcgtgactgttagactcttgaaac

SEQ ID NO: 680404 - DNA, 719 bp, Homo sapiens
agcggatctctccgcatctgacaacagacggagcagaggaacgtgtagcgactctaagcgcgtgtgtatgtggccgtgtacggacgttggagacttccaggtagaggccggctaggaaactggcgtaacgcagtctctcttctcatattccatgcaagttgcgatgctatgtgaagagggccagctatcttctgctcttgccatacaagtgtggcagcagctgcctgggaataccatgacgacttcattggggaagaaagtagcacagtggggagtcttcttctgattgtctgtagtagcagggagcctgaagacagtccagctgagtagacgtacactcacggtgcgggagacgtacacgctgcataggaccagttgtgcatgggctcgtcatagatcgccaaaggatgattcctagatataccactcatgccatgcctcaagcccgaaggtccctatgggggctgaatcctggcgaagccctgtcggtggggattccagcagcgaataggcatgcaaagctgtccaacaggagtgttacgcgcttccgcaatcgggcaacaagctatggatcagaacgttctcgttagctcccccacgcgttgcctccagaccgtgcacaggaatgtagaactcccctctaggctcggatgccaatcgacagtggattaatcgattgggcctcgtctcctaagaggaagacgagaacgtagacccct

SEQ ID NO: 680405 - DNA, 138 bp, Homo sapiens
catgaacagatggacacgttctgcctccatccactcaagcgccaactaggcaccattcctccactgacaactgctcaagtgcacagggtctacccacacagacccaccaatgacgccgagcaatatagaggtgcggga

SEQ ID NO: 680406 - DNA, 374 bp, Homo sapiens
cactctttctgaccacagtgtaataaagctggaaatcaactccaatataaaccttcaaaaccatgcaaatacatggaaattaaataacctgctcctgaatgatcattgggtcaaaaatgaattcaagatgaaaacttaaaaattcttcaaactgaatgacagcagtgacacaacttttcaaaacctcgggattacagcaattttgttcttagggggaaagttcttgcccctaaacacttacttcaaaaggactgaaggaccacaaactgatcatcttaaggtcacaacttcagggaaactggaggaaccaaggaccaaaatcaaacctcaaaccccaggaaaatgaagggaaattaccaagatcaggaccggaa

SEQ ID NO: 680407 - DNA, 119 bp, Homo sapiens
tggaccaactgcaggcgcgcgctgtgatgaggagcgacttgatatcatgaaggttctaataactggtccagcggacaccccttatgcaaatggcggctttgagttgcggcttgcagttg

SEQ ID NO: 680408 - DNA, 975 bp, Homo sapiens
  misc_feature (602)..(602): n is a, c, g, or t
ttaatcaagggtgtaaccatcaatcggatcaaggctaaacccctaattgtagggggtgccgaattcttttttctccctgcccagcgtggcaatttctgcaaacgcattgttggagatttatagtcgctccacaataccttctcatgaggggaaccaatgcctgataaatttgcccccgtcgtagtatttcgaatgagtaggaagggttcttcacccgagctccaattgttgtgcgtgaaatttggtactaggaaactatccttcctcctagttggtctgctaactcggatttgggtacatagtctcttgggcctacgttcttggattctctattgttgcatagctaaatttgtccctaagtaaaggttatatcgccccgttctagccgactgaccagcccacaatgggcttaggagaatatgaaaacgggacgatataacacgggtatggactgttcctggttacgacacattgaacagatacatatgccataatggatgcttcgtgtttaaagtgggcatagccacgactgcttcactgaatacaggcaagtccttattcattctaccttgtatactcggagtgtcttttgcctggcacgnctagtatgtcactgttcatagtcaacaatgttgagttcaatatgttggagcaaagaccgagttcaaatagcccaccatgcatatgaaagttctagcactgtttaaatgactacgccttcctatactagtctgaagagataaatcattttgccaaggcacaggcgtcttgctctgttgaagcaagtcagtatccgagaaaactgctgttccctttgttgtgatgaggtagcagacacacaattgaagcacatgtggacacagatgacctgtgcatggacttgtgcccttgcagactaggagacctgcccattgtagtcgtaaagaaatacgtatctagaatcagacattacctccagggttcagtatcacacga

SEQ ID NO: 680409 - DNA, 240 bp, Homo sapiens
ctggagtgcggtggcttgatctcgtactcactagcaaacctctgctccccagttccagcgatactcttgcgtcacagcctcccgacgtaactgggattagcaggcgcccgcccaactaataaattagtagttaatagtaagagacagggtttcaccatagttggccaggctagtactcaaaactacctggacctacgtagatacgcccgcctacgacctcccaaaagtgctgggattaca

SEQ ID NO: 680410 - DNA, 175 bp, Homo sapiens
agcgttttcccttggtctttgggccagggggaaggggcccttttgggtgccagtgggggcgggtttctccctgccaggggggggttccagcccaggggggtttttggcccatcggggactctaagcgttgccccccgttgggaccccagttccagttttttggggggggaaaaaa

SEQ ID NO: 680411 - DNA, 112 bp, Homo sapiens
caggagtcagtgaggagaaggaagagcgccatacgcaacgcctctcccggcgtgcgattcataagcagtggccgacaggttccgatggaacggcagtaggcagcaataatgt

SEQ ID NO: 680412 - DNA, 1548 bp, Homo sapiens
  misc_feature (1)..(1): n is a, c, g, or t
  misc_feature (972)..(972): n is a, c, g, or t
ntgttgtttgttaatcatcgccgctggctcgccggggtcccccccgtgttgtgtacgccttaagttagtagtgctcggcggttgtgctctcttcaaacggggtttatttcgcgcccgcagtaggcccacccatcgtggtggtgtggggcgccgcggaaaaatttttctcggggggcgtcatcatccggcatgtggggaatgtttggggtgggctgtttttccacaagcgagccgcctcttttttttccgttgcgcggatgaggcggttatgggtgtccacccccggggtttgtggggcccgccttagaagtagttgttcgtccgcccctcctttggggggggcaccacctcctcgaattggctccccgccggtggtgagcagcacttgtgtgtggtttgcccgccccgccgattgtggttgtgaaaggaaatgcggcgtttaatactgtgggagattcccacgtgagacacccgccgggggggccttcttttttgggtgtcccgcagctttgggggaggcccccctctgtgggcccaccgcgtcccacaaaggcttgtagtgcgatgtgtatcccaccggcgccccacgtgtgtccccctcttgtttccccacggggggccacctggggcacagagtggtctcagcgctgagaaatgtgttctaagtccgccggtcgcagaaagagttgttttcccgcggcggcaccacagaggtggtcgcccccatcccccagggagagtggtgatatgtggcttcgcggagcagcgagcagcgcgctggtcccacagagagaggagtcgcagagagcgcactcctcagatagtcccacacactatagggcgtctacagacgccacacacgctatttgggggcgcccacagatgagagatatagtgtgagagacccgcagagagagattagagagagagagagacccccacaggatgatagtcgacacagaggatatggtnttgttagtctcggtgtgtgttaggagagattggtatagggagagagcccctcactagagaatcatatagagagaggggacacccacgagagtatatatatactgcacagaggagatagagagagagttttatagatgagagacgttgctcacacagagaggcgacagacggtttctgctctgagagagacgtgttttcccctctcacaatatacgcccacctcgtggtgtactctacagagagtgtactctgcttgcgtgtgcgttgcgtgcgcgttgcgtgcgcgtgtgctctgcgtgtgcgtcgtgctctgcgtgtgctctaagaatgttcccacgccacaaaaagaatccaccccccgcggagttaaaaggcgctccagccccagaaaggttctccttccccagaaaagcccccaggcccagaaaagccagcgccggtctctcccaaagacttccagaaagggtcccaaaagcgtcccagccccggaagcccctgctcccaaggcatctggcccagaaagccataagtggccatccattaaaagttattaaggttttttttgaccctgttgga

SEQ ID NO: 680413 - DNA, 771 bp, Homo sapiens
aagaccggggtatgtaaggactgtaactgaacactcagcgtgagcagctggccaaagctggatgaggaagctgttggccggaggcgagatggttccagtccagctatggagacccgaggccgtgggacctcacagctggactgagggagccacagccaaggccatcagtgacctgagctgatgcatagaggcccgccaccggctgctactctaggggactcaacagagaagcgcactagctacgccctgtcaacaaagtgatcaagtaccgcctcagccacagccctctacactcctcattccttcggaacaccacacctgctaccccgttaggccagccccatagtccccacattactacagtcgtaccaacccatcatcccgggactacttactccaagaagtatggcttacaacctgcgggccattcgcgtctacatgggtagactccgatagtctacaccgtgcaccatataggtgtggcacgtggaggataggaggtccggccagtgaggcagggcttcgtcacaggtgaccttcatcacccatgtacaatggcggaacctcgtgcattgcctggcgcacacggaggtggttgcgactgatcctgacgagaggacaaaaggtgccacttacccaactccctgggcaacacatcattaactgaggccactcgcagtgacctacaggcagatgcccgagacgagaggacccggagcattgcaaaccacaggaccctgtccaaatcacagatcttcacaccacttttca

SEQ ID NO: 680414 - DNA, 926 bp, Homo sapiens
aaggagactgctgaacaagcgacaagagcggaagttcggggaatgggggctcggagcgcggggacaagtttgatgtaatgtatattttacaagtaaaaaaatgtttctcagcctcagaccttgaactgaacacataggactgacagacgtttagatttctttgaccatcacggcacatctgtggctcgaagcgcgagtcgcgtctcatcactctggtaatacccatacactgtagggttaggtcaacgatgggcggattgccttgagatccaggtgttatgagatcagtctgggcaactatgataaaacaactgtatctagtagaaatgcgacaaattaatccaaggctcatagactccatgaccatgccagcccaatgtgctaggcatcgcaggcgctagagtcgatcaggagcgatggacgccttgtctcaaacaagaaatgagaacaacatggatgaaaactcatgatagaacatgttctaattcgcgggaattatgggaacgcattgtgtcgagtgaaaatggtgtggcaagtttttcagcagagggggggcagagacaatgcgggagaacgcgggaacattgggtgacggagcgtgcagtgatttgcgtgttgtgccggaggagtacgtacgggtcctcgtggggacacctagcgaggttcgccgacaaaattagaaggtgcaggaccttcgtggtgcaaccaaccggtttttttgaggcggcgggcttaataagttgtacgccccctgtgtggggcagaaaaagagaaccctcctgggtggatgcacttcggctcaacaaatgttcccccgcgggtaacagtagttccccccaggcgtggcggtggttttaacaacataaaatttctccgggagatataagagcccattggggggttcaaacacggtgccgccacctcta

SEQ ID NO: 680415 - DNA, 405 bp, Homo sapiens
  misc_feature (405)..(405): n is a, c, g, or t
cgggcgccacagcttctctgtgcttcagttatgcccatccatacacaaggggattgacctagatatcaccgggctcagacattctagtgattcttctattctgacagacattacttgtgaagaggcatcattctactgctctcctctcatctcattcaaagaagactgaaatgccagagatacaacttttaaaagtgttttatagctactgatttgtacacatatcagattgggttcactagtttgtctggggtagggccccaggtctggtctcacataaggcactctgagcctcctctatcacttattagttcccttcgcttccctagtgtctgctttctccaggtctctactcctacttctgctcatctgattcaggagggcagccctctttgttctactcan

SEQ ID NO: 680416 - DNA, 207 bp, Homo sapiens
agtaacaggctcagatggtatgttctcttatcctttgtgggagttaaaaattaaaagaattgaactcatggagatagagagtagaacgatggctatcagaggctattaagggttgtggtggagaggaaagagaatggttcatgtggaccaaaacataggtggaatgcataagatgtagtatttgatagccatcttgagcctgtgtct

SEQ ID NO: 680417 - DNA, 244 bp, Homo sapiens
catttaattatatcctattcacacaactattttccatcatcatgatgcaacactaagattataaactacacaagacactggatatacatgcactacattccatcgaaaggaacaaaacatgtacagcactacagacatagagaacccaaatattaatatactaagtgtcttcaaagagctagacctatgtgagactattcaaaccattatatatcatgtatacttgccaacttaatcaccacgt

SEQ ID NO: 680418 - DNA, 541 bp, Homo sapiens
gaggagaagaaaaggagaactaagaagaaaggaaaagaaggagaagaaagaagaactaagaagaaggagaggaagaataagaaggaaagaagaaagaaaaaagtaaaagaagaagaaagaaggaagaaggaaagaagaggaagaactaagaagaagaaagaggaggaaagaacgaaagaacgaataaggaacaacgaaacggagaacgaaacgaactaaagaacgaggaacgaacgaaacaacgacaaacgaacggacaacgaaggacgacaaacaggacacgaaaacaaggacacgacacgaaccagatacgacaacgccggacacgacaacgacaacacgaacacgtataacgacacggacacgacacgaacgaacagacacggacacacgacggacacgaaacaaacgaacacgacggaaacgacacgaacacggaaacgaacggacggacgaacgaaccaaggacgaacgaaacgaacgaacctaacgaacggacgaagaacggacgacgaacgaagagacccaagaacaacgaacg

SEQ ID NO: 680419 - DNA, 973 bp, Homo sapiens
  misc_feature (732)..(732): n is a, c, g, or t
gtctggcactgtgctggcgtggtctgcgggatcccacttatgaatctctccagatggggagctggggcaggataacagccccaagtacagctgtgtcctaatccccagaatctgtgaccacgctgcctcgacgtggcggaagggactctggcgaggtgtgatgagaagtgaatggatcattgtttcttagttgacttcggacaagtgaatgtaccgggtcattggtgagcccaggtgtgagtgagatgcaatgggcatggatcttcgagcccaatgggctagacttctagggtctaatcgaaggattcaaggggagattcgtccaaaattagagcgactcgcgatgagctgtgatataaatggttgtcagaaactgtaggggtacatctttttggtatatctaaaagagaaaaggagccgggtttactccaaggtgtgaccagggcgggtctaaatattcttgaactcctggtagatccagaagggttgagggcatcgagacagtggcgggggagtacctcggtgtgaggccaatattgtgttgtcgagggttaaggtttctggcagaggaagagattaaaccgggatggtgtggatggcacccgttgctattggtggaagtcctggcaaacggggggggactatgtgctggcgtcatgaaagatgggtcgcggaagacatggaagctgtcacctgatgtaattggcattgcccggtcgtggtgtaactganggggtgcgactgtgggacatcaggggggactaagaatgatgagggcgcaaccctgtggtagtggcgcccgggagtggggggggggccttgaaaaatggtggggatactggaggtccggagcccaagggggtctgttgaagaaaagggggccaagatttggggggggggagcctatgtcgaggataacaacggacaagaggtgtgtataaccccccataaatatcgatttattgctcgagag

SEQ ID NO: 680420 - DNA, 486 bp, Homo sapiens
  misc_feature (202)..(202): n is a, c, g, or t
  misc_feature (231)..(231): n is a, c, g, or t
  misc_feature (379)..(380): n is a, c, g, or t
  misc_feature (394)..(395): n is a, c, g, or t
  misc_feature (450)..(451): n is a, c, g, or t
aagaacatccttttccctctcattctacccttttcctctccccgattccttgtagagctgctgcaattcttagaggggcagttctacctcctctgtccctcggcagaaagacgtttccacacctcttaggggatgcgcattaaacttcttttgcccccttcttgtcccctttgaggggcacttaagaatggagaaatccagnttgtggtttcagtgaatacatggctcacnctgtatttattgctaggagaagctctgaggtgtgggggagagatgactcatgtgttcgctcgagggttggcgctgagaacgccctgggctagggggacgttgggagagaggaacatatatgggagagctccgggcgaaatatttgtgnngggtattttctttnntactatcctctgtggggttccacagcgtgtgcaacacgtatcttgactcaaaggnnagaaccccatataagacgggtataaaacaacatta

SEQ ID NO: 680421 - DNA, 522 bp, Homo sapiens
atccgagcaaagtacgagcagcgtttatttttggctccctttaaaaatgcccaggggtgccacttgccaaacagctcttcaaatcagttcaagaaaagaatctgcccaatgtcttacttctgctggcatacagtaataaggaacaaatcaatagccccaccggagaccgggacaggcgcacagctcttcatgtggcctgtgagctgcctaatgtggtgatgacacagctgctagtctggtatggcattgacgtaaaggccaaggatgttaatggtcacacggcgctcttttatgctagaaaatctgcaaatcaagaatgtgtggacattctacttcaacatggatgccctaacgagccctcaagttccatgagtaccccaattcagagaaggaaaagcagctgttctagcattttgagaactgattcccggactgcccttgtatagccagccacactgtcatgaagaaagctggcttcaaatcagtgactttgtagccagtcaaaaacacgtctggttgctc

SEQ ID NO: 680422 - DNA, 581 bp, Homo sapiens
cgcaaacaccagcccggtcgtcggggagccccccgcgacctctgggcgcccccttgcgaccctgggtcctctcgccctcaattgcccacaccgcgtggggctcccctgcgcggccggcaaaaccgcgggggggagcaaaaaccccccgggagcaacgtggaacccagaccgcccccggcgcaccattcggtggaagaggtggcaggcgaaccctcgtcgccccgttacgcaaggcggacccaccacaggtgttctgccccacatgtccaccgctcccaccaaaatgggggagcttgggcaccagagaccaaaagcggcgggatacctcggtaaaagccaatgcgggaggcgctccctcccaaagtaagcggtccggatcgggggtctcccaaatgatcccgggaaaggagacacgcccccaagcagccccctcagaccggcaggcgccgcattttgcccgcccgcaggaggccggcgggaagacgcagtagaagacacgtggcgggggcccgtgcccgggtcgtgcctcagaaccccaccggcagggagcggcaccccaaaccaaacccgcccacaaaaca

SEQ ID NO: 680423 - DNA, 324 bp, Homo sapiens
gagctgtatgttcaatcattcaacaagcatttatttaaaacctgtaagggctcacacaggtgcagtggctcacacctgtaatcccagcacttcccgaaggccaaggcgggtggatcacttgaggtttagaagttcaagaccagcctggcaacatagtgaaaccccatctctactaaaaatacaaaaaattagccaggcatgttggccacgcttataatcccagctacttgggaggctgagggacaagaatcacttgaacccaggaggcggaggttgcaatgagccaagactgggccatggcactccagcctgggtgataaagtg

SEQ ID NO: 680424 - DNA, 849 bp, Homo sapiens
atggtgcccgcgcattcctgcgtttcctatggagtggctcctggtatgtatttcccgccatcctggggccgccattaggcacataggggtgcaccaaactaaagggcgcgcgcccgaattctctcccgcgggaccataagttggtgccccacccagtactattgtctgccggaagcgctccctgttagttgctccccttggggcgatttctgtccatcctgcggggagggaccgccctcgctctttagggcaggcacgccactcacgcccgctcgcgcatgtcgtcggcgcactcctcgtgtggtgtttttcacgaacggcaagctgctatgttcccccggttctgcgcgtcccgtctttgtcaggtataccccttcatgtcctgccggggccacggcttgcactcgaaggcttattgcgtctcctgccacgcgtgcttcaccgtcttgggtagaaatgcccacgtgtaccccaccccggtgccgcgcgcgcccctttatacatgcacgtgcgtgctgcgcccacgcgcttatgtttgccgtgcaagctgtatctcttgcaccacggatgcacgtccccatgggggtccccccgcacgctgggcggtgtgtagctgcgctgttaatgaatatagttgcccgccccgcagttttcgttcatctctccgctggcgaccaatggtgcggctgtgtgtcgtggacccggggtggacacaacacattccctctgtttgcggtacagtcccccgcctcccgttcgggcagccttcgtttccatgaccatcttaatagagagacatctcttcgatttccgtgtattcaaaagcaccccccttccccccacaaaaca

SEQ ID NO: 680425 - DNA, 417 bp, Homo sapiens
  misc_feature (22)..(22): n is a, c, g, or t
  misc_feature (50)..(50): n is a, c, g, or t
  misc_feature (59)..(59): n is a, c, g, or t
  misc_feature (111)..(111): n is a, c, g, or t
  misc_feature (123)..(123): n is a, c, g, or t
  misc_feature (280)..(280): n is a, c, g, or t
gggggttgggggtgggggggtncggggggcgggggtgttggggggggtcntgtcggtgncgttgtggtgcgcggggggggggggggtgtcgggggttcggctggggggtgnttgtgggggggntggtccttgggatgggggggggagggcaggggtggcccagggggggggtggagttggcgtgcggggtgtcggcggggccagggtctccggtgtctgccaggggggggggctggggataggcgggggtgggggggtggggttcagagggcctgggggntgggggaggtggggggcctgtgcacgtagggggagggaaccggcgtgcggggggggaagcgccgtcaggggagtacacctatcccccattctcctcctatccctcaacccgggcatcattacgggggtttcctctta

SEQ ID NO: 680426 - DNA, 254 bp, Homo sapiens
tgtcgatctagaggatccaagttgaacacgaaggaggtggtggaggctgtgacctttgtagagacaccacccatggttggttgtgggctttgtgggctacgtggaaacccctcaaggcctccggacctccaagactgtctttgctgagcacttcagtgatgattgcaagaggcgtttctataagatttggcattaattctaagaaagaaggccttttaccaagttactgcaagaaattggcaggattgaggatt

SEQ ID NO: 680427 - DNA, 141 bp, Homo sapiens
gccctcggagaggcaggatcggagcccttccacccactttaaggcacggagcagaattgggcaggtgtggaagcagcccctggcaggctgccctgcagtgcctctggagcgacccaaggtggctgacagtctgccagttgt

SEQ ID NO: 680428 - DNA, 288 bp, Homo sapiens
aacgggactttcacagcaggaaacagtattaaggtgaggcagggacatagagcatgaccgagtccacggagtatcacactagtcctagtgctatgtaggtgaagaccccctatctctactaatgattttaaaaattaactgggtgtggtggtgcacacctcgtagtcccagctactatgagaggttgactcagtgagaatcgcttgaacccagggaggcggaggttgcagtaagccaagatctcgccactgcactccagcctgggcgacagagcaagactccatcttg

SEQ ID NO: 680429 - DNA, 167 bp, Homo sapiens
ggggtgtaatcggcatataaaaattcagtaaggcccattataaataacttatcgggacagattcaataataaaaataatcgggttaaaataaaaagaaccaccggtttaataacatataaatatctggtaataaaacagggggcatcgataaacaccgggtaccgag

SEQ ID NO: 680430 - DNA, 971 bp, Homo sapiens
ggcagctgaagatgatgaggatgacgatgtcgataccaagaagcagaagaccgacgaggatgagctagacagcaacacaagaggaaaagttaaactaagaacaaaaaaaggccgccgagaactattcaccctccactttcgccggctcagaatctaaacgtggtcaccttcgagatagcagaggcccgcccggccctagcgggggcgagtgccacaccggtagatgaccacgcgactcatccaactcgaccagaaccctaaacgcatgaagaaattagcgaaggtagggggaggagaacataagaagccaaaagttcccaagggccctgcttgtatatttctgtgaaaagtcacttgtaaacacaggaagaatgggttggtcaatggttaccatttcacattcttcatcattttgcgtacatcatgcgtgagggtcagccatttttaatggatctgcggatgaacaaaccagctttcggagcgttcgtcatgtcctacttctggactttacttgttgggtgtgaccatgtaacatggataatctcgagggagaaaaaaagcgcttgtgaaaaaaaggaaaaatgaggaaacagaaaagacgaatgttattccgagcgattccgagtaacttggggggtatgtacgttagcggtactataagaagttggtagtatgagatggtcaaaaagggcagagattaaaaggttcctgatttataccattagaggttctaaggaaggtaggaggccagtatcaataggccggtcggaggaatgtggctgaaacacgtgggtccgacaataacgaggacttccatgggcaacacaaacaaacacgcacaaaaaagcacaaaaaggaacagcatagaagaaccaaagaagagaaaacacaaaagagaggagcaacaaaaaaggaagagaaaaacaagcccaaaaagcacacaagaacaaaaaagacacgaacagagaaaa

SEQ ID NO: 680431 - DNA, 514 bp, Homo sapiens
tccggggttatccctgtttttggggcaaacccctatacccccctttgagggtttggaaacctttgcccgcatctaaactcctgggggaaatgtttatttgtccaaggagggggaaggggccccaattcccaaagggtctttccccgggggtggggggtttttttaatgcaggggggcccccaggttttccccttggaaagggggcggtgggggcaacccaattaatggggggtgggcccccctttggggcccccggggtttcccctttatgcttcggggttgttttttggggggaattgtgagggggaaacatttttccccgggaaacagttttgcccatgttttccccaaggccgaaattacccccccctaaaggggacaaaaggggggggtccccccgggggggggccgctttaaaaaaagggggtcccccggggggcgggaattggggccgagccccccccccttgtttatttgggaaaaggtaaaaaaaaattttcccccctggcccggc

SEQ ID NO: 680432 - DNA, 264 bp, Homo sapiens
tggtcagcaaaaatcttttaaataagagagtaggacccaggtaagttttggtaccctcggtgggcccgtcggcctcgggcacgctcgaacttccggccctgggagcggactatggatggccaagtcagcatatgaggatataaagacttggtttttaacaaaaaacaacatatccattgagatgcactttcttggtggtggttcttctacaataattcccaaaaaacttgtgcaaaacacaaaacaaaagaaaaaaaaaagagg

SEQ ID NO: 680433 - DNA, 235 bp, Homo sapiens
cgggggggggaaaaaattgggggggggccattttttttaaaaagggggccccaaattttaaaagggggggttgtttttaaaacgttaaaaaaaaaaacggggggaaagtttcccaagggccaaccttttttgggttataaaaaaaaggggtttttggggaatggggcccccccccttcgggaggagaaaaaaaaaaaaagggggttccctttaaaaaaaagttttttccccccca

SEQ ID NO: 680434 - DNA, 113 bp, Homo sapiens
atagctgttctagaggatcccgagcctagttaaaagtggagccagaaaagaagagcaaggtatggctatgagaagtaggagggaaattaggcagtgacactttgcatccaggg

SEQ ID NO: 680435 - DNA, 427 bp, Homo sapiens
  misc_feature (398)..(398): n is a, c, g, or t
gagttcagctctagagtagagccacacacagcccgggcgcatgccaacatgccggcctttgattcttctgctgtacggctgcgcgctgacacgggcggggaaactgaggcccgggcggctgggggatggggagccgaggcgagggactgggcaggcacagcccaccgtgcagccccccgaggctgtcctcagtggcctcagtgtgcccggacaccgaatgcagctgggccagagccatggcatcccccgcccgccggctgagtcagacgtgactcagggcggctcctgggccctggcttcagtccagtccccctctgtgtccctgggaaaggccagcagagctgcctctttgggccctccgaggctctcactgcccaggggcctggccaccagatggngtccctggatagccctcgtatgggcactg

SEQ ID NO: 680436 - DNA, 418 bp, Homo sapiens
  misc_feature (234)..(234): n is a, c, g, or t
ctacaacctcaagacataattgggaaaagaaagaataattttttaaataaataaataaatgaaaataagcatatgagataatgttttataaatcaaagaaatgctaattatactataaaatattcatacacatataatacttgtttaaaattacagtaacacctcacattgtgccaaatctcatttttatttttattttatttatttatttattttttgtttttgagacggagntcccctcctgttgcccaggctggaggacagtggcggcaatcttgggctcactgcaacttctaccgtcccaggttcaagcgatcccctgcctcagcctcccgagtagctgggactataggcacatgccaccacgcccagctaattttttggtattttagtagagacaggagttcacccatgttgg

SEQ ID NO: 680437 - DNA, 105 bp, Homo sapiens
aatcgagctcggcccgtcttttgtagacatgatgaccattctcaaccacgatgcatcagtatttattacaaaaattttaatcagaaaaattaaagactggtcctg

SEQ ID NO: 680438 - DNA, 331 bp, Homo sapiens
ttgtagcagtgaattactaataaagtagccaggcatggtggcgcctgcctgcagtcaccgctactggggaggccgaggtgggaggattgcttgagcccaggagttccagactgaaatgagctatgatcatgccacttattccagcctgggtgacagagtaagaccctttctcttaaaaaaaaaaaagtaataatggaaagtggcacactggcaacttgggaggctgaggcaggagaatagctggaactgggagggagatggttgcagtgagctgagatcactgtactccagcctgggcaagagagtgagaccctgtctcaaaaggcaaaag

SEQ ID NO: 680439 - DNA, 194 bp, Homo sapiens
tgttcgagttgcataggtattctctatgagtaccccgaactgggcgctgaagccgctgaacaggccgaacgtcatgacgtacatgagcgtttttgaaccaatatcaagactgtttgaagatgtcgatctgccgacggaagttcgcctttactggaacgtctttgagcatagtgaatgccaaaatcgtggccagg

SEQ ID NO: 680440 - DNA, 860 bp, Homo sapiens
cgcggtggctcacgcctgtaatcccagcactttgggaggccgaggcaggcggaccacaaggtcaggagatcgacaccatcctggctaacacagtgaaaccccatcgctactaaaaatacaaaaaattagctgggcgtggcggcgtgtgcctgtagtcccagctgctggggaggctgaggcaggagaatggcgtgaacccgggaggcggagcttgcagtgagccgagattgtaccactgcactctagcctgggcaacagagcgagactccgtctcaaaaaaaaaaaaaaaaaaagagatcccccggcctaagaacccgggaggctgaggaaggaaaaccgtttgacccaagaattcgaaggttgcgtgacccgaaattgggcccactgcacccacagccgtgggcgaacccagcgagacccccttcctccaataaagcaacaaaggaaaaaggtccccctggaaagaggccttaatttaatgggaacttttaaaattctcccttttggcagacggggacaaacacagctgtccgggagcattttggaccttgaagaccccgggcgcccgggagacataattgtgggccccccagtggacagtgccacacagcattcaactcgtgggagaaaaacgcgtcttcgggagaactgagctcctccaaaaactgggaacctggtctctgaaccccgagaacgaaagttccacaagccgcaaagaaaaaaaagaaaaagatgtgcggccgcgacccaggagtctcaaccacgcgtgggccgcccaagaagacacgtccagggccggacgcggaagggggtcccaaaccgggacggtcgaccggcggccgatcagacgacacccacga

SEQ ID NO: 680441 - DNA, 504 bp, Homo sapiens
agcggaggggggcccgagccacccggtgccgccgcgtcccgccgccgccctacccctacctcgtcacagggatacccagccaccatcccagggtctacaacatccacagccggaccgtcaccgctatcctgccaacatcttactcgtggatcgataggagagactgtccatgtcatgcagcggtatggggtgcaatggaggactgcgtgtcacgccttcccatgggacatcgtatcctggcacatcatcactcattccaccatatatgagacttcatatatgcccgtgtatagaagcgctgtaggcagggaaaggccgaacggaaatgcaccacaaacattgttggggagaccagacgtttgcagcctgttaaaaggggaacgaaacgacggaccccggggagtattaacgataacagacgacaagcttcaatctatattgtccattaaatggtaagaattgataggatgttaccaagtaagatagtaaattatgaataaaagc

SEQ ID NO: 680442 - DNA, 116 bp, Homo sapiens
ggaggggtagagcaggacttgaaagatttaaactggcccttggctctggccactatgcgtgatcctgtagagttccccacgtattcattcgtcatcactcgccccaatattttacc

SEQ ID NO: 680443 - DNA, 1028 bp, Homo sapiens
ggagagaactagtctcgagtttttgatattttttttggcataaaacaagtttaatttccaaaccagggtcacagtcatcgcgttatcccacatttggagcaaggataaaaaaggtgagtaataaaacattttacagtctacatttccagaggaggaacgtgcagttcaccactataaccaccacagacaaacttggggggtggggggagcggagagtcctcaggaagcagaaaagcgtggaatcagggaaagcataaaattaaacctaccagaaaggaagaggaaagggacgggggcacagaaatggaatgaaacacccaatcccaaaagagctgttaagtgaactgggaatgtaaacaagggaccaccccgtgccaagggctaaagcaagccaggaatactaccaagatcaactcacggcccccatgagggacagatcgggggcagcaccaaggccaaccctccataacatttccagccccaaactgggcccgtggacgcccccaaaaaacacaaggtgaggggtgagcgcctgaacgatagagcgaaaaccctcataaggcactgacatcctcacctgagagaaaacgccacggaaatgaaggcagagacaaagcaggccaaagtccctcgagtgaaaccgacaagagcaacgcactcgggacaaaatccctacagtcagcgaacacaaacacacccgtggcaaaccaaggggggaccacaagtgcagccgcaaaacaaggggaggagaaacaacggcactcaggcaacacacgggaacacaccgacacacacgcacccacaacaaaggcgaaacgaagcaaaagcagcacacacgaggacaccccagacacacccaaacacgcacaccatcgcatcatccgacccgcaaacgacccacacccaccacaatacccccaaccccgtctactccgccaacaacacacagcaccatccaggacccgcgcacacacaccaccggcagcgaccccaccaacggaccaccagctccccccacgaccgcccac

SEQ ID NO: 680444 - DNA, 1708 bp, Homo sapiens
  misc_feature (414)..(414): n is a, c, g, or t
  misc_feature (1009)..(1009): n is a, c, g, or t
ccgtgaatgatggctctcacgtaaatctttttgggtgtgaggactcctcctcgtcgtgggacttttcttctggcctccgctggtcgtgtgggtttttcttattaccggcgccgtcgtctcgtcctttctcaggtatttctcagcggagaatgggggcgacatggacctcctcttgtggccgcccctttctgccgcactgtacgcagtgggcgttgctcatacacattatgtcttgcccccccccactggggccggcccttctctgttgtggttgttcctccgtgtgggacaaatcttctataggctctcattttgggcactttgtataggaagtaatccttgctgccgccttcgatatgggggggggtgtcttggttcttcacctcgggggggggacccctgcttgtgtttctnctcttttggcgggtaatccttttctattttctgcccgtcacccataattagaggtggccctccctcccctctcgggtgggggttctcaccccgctggtacccctactggttgtgagtcgtcctttctgctatggccctccacaggggggttgctttctgggcccccgtgttggtggtttgccccgttgttttctcgctcacatcgagtatgtgtttcttcctccccccgcctctatagttcctccgcgtcgttcctcctgtcggtatgctgttccttgatggtcgtctctctcctttgtctcccaacaagttcttatgttctccctatgaacggagaaagagcgttcttcgaggggtattcttcaccacccacagcccattggcgttctcttctcggcggttgtgtttgcgccattttttgtagagcgcccacgtgtcgcgctgggccacgcgggtgtgtcctactcaacaggggcgcctttctctcggggagagactccgctccgctaacagcccacggttttctttcacacggttactcccgctcgtccttcttctggccccccgcgagatagggccgctctcgactcaacgntttgggtcctccctctcacaggagagacatgtccttctttgtggcgacccacacaagagagctcttgtggcgcctctctcgttgagcccacccccctggagagtgggagacccgtttctgtgtgcgcacacacccaagtggccctctccacacagagcgcacgcgcatctccgccacgacactgcggtcgtctccgcacacaccaccacactcccagacggctgtcgcccgggcgcgcgcgctgtggcgccccacagcgagaggctctctctgtgggcacacacactgtctccaatagagaaaggaggggccactggccacacttttggtgtatgtgcccacaggtggtgttctcctgtttaagacccgccgctgcctctcccagagtgccaaatactgctctgctgtgttttgcgtcttcttctctctgtacaccacaaaaaggtataacacgcacacgcccggaaaagccaaataggtgatctcgaataaccttgttttgcgcccataaagggtgttttcaccaaagaacacgtgtctccacttaggaacttaggaccactcatctcggccccgagacccaactccctggataaaaggaataaggagaatcgtgtttgtaacgagttaccggattgtttctttcctggattttaaacttttggttaaattgtgaaattatggaggagattttataga

SEQ ID NO: 680445 - DNA, 230 bp, Homo sapiens
  misc_feature (30)..(30): n is a, c, g, or t
  misc_feature (49)..(49): n is a, c, g, or t
  misc_feature (64)..(64): n is a, c, g, or t
  misc_feature (67)..(67): n is a, c, g, or t
  misc_feature (104)..(104): n is a, c, g, or t
  misc_feature (116)..(116): n is a, c, g, or t
  misc_feature (128)..(128): n is a, c, g, or t
  misc_feature (141)..(141): n is a, c, g, or t
  misc_feature (162)..(162): n is a, c, g, or t
  misc_feature (197)..(197): n is a, c, g, or t
ccctttttccccccgcctttttttaaacanaatttgggtttaatgattnttgtcccttgggccnggnctttgctttccctccccagtaaatatgaaataatttnctttgcccatancagacccaactntaatttcttgggngttggggatttggccttgggnataaatggccccccgtttttgtttttgtgaactcntttgtggggggggtaaaaaaaatcccaaaccca

SEQ ID NO: 680446 - DNA, 277 bp, Homo sapiens
cgtacagttgcgtgtagtctatataaacaacactttttggggtctgatgaacgttggattgggcgcttaaaccgggttcggttcaatcccggaagggcagtttctgctaacaaaagtggccactaagcactcgcatttcacgcccggctccacggcagcgaggcgggcttcttaaccatttaaaggttgagaataggttgagatcggttcgggcccaaagaactctaattattcggtttaacggaataaaaatggcgtgcgcaactggtacgggggg

SEQ ID NO: 680447 - DNA, 180 bp, Homo sapiens
atagatggctaccaaaaccggcacattcaagtacagcatgactatgcttgaaacttaaaaacaaatctacagtgagattaaagcattaaaatcatatctctcaatctagaatacatgttaaaacaaaaacctcaacaggaacgcagaagtgctagctcacatttttaccatatcccagcg

SEQ ID NO: 680448 - DNA, 243 bp, Homo sapiens
aaagcattaaatcttgttggacaggttttaaatataacgtatttcccttacctcttttttgatcatgaataaatgcagtttgtttgactgttccatcaggattaaagacatctgtcttccctcaatttcatgacgtcactcacaggtggcaaggtcgctttcccaacttggaaaattgtatagttacgacgaccagcacgaaaactatcaagtagtttatcctccaccatttttaagatattt

SEQ ID NO: 680449 - DNA, 551 bp, Homo sapiens
ctgtttttccatttccccgcactgctcagagatgggagaactatgtgtgcctttggactcacactcccaggatccagtatgagtcatctggcctcaagttctttctcccaggtgggctccataaacaatcaccttgatttttaatcccccaggaatcgcacggagcccgggaatcgcacgaggatactacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccagccactacccacccataggataaaaaccaaaagcatacatcagctaacttcagcctatactactaaacccacaccccatatcccttatcactataacatcctacacccatcctcacccctc

SEQ ID NO: 680450 - DNA, 611 bp, Homo sapiens
ctgtttttccatttccccgcactgctcagagatgggagaactatgtgtgcctttggactcacactcccaggatccagtatgagtcatctggcctcaagttctttctcccaggtgggctccataaacaatcaccttgatttttaatcccccaggaatcgcacggagcccgggaatcgcacgaggatactacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccagggcctttgtttgcaaaaaaagttccagtttatttggtgtttggttccatggcgggggaccctagggattcatttgtttttttcccttccctttgcattttagatcctgctggaaaccccggccacctgtatcccctattaggaggtaaaaatcaataaaatggccccttcatttgtgttgtagcccca

SEQ ID NO: 680451 - DNA, 280 bp, Homo sapiens
ctgtgtacatgtccataagtctctttactgcatctcggtgactggtagttgaggtctctcatacagcttcagccttctagaatggtaacaaatcagccaattggatacgaaacacagaagactatgtaaaattcacccatcacactttgagactactcactggttggaagaatatagtgttgcagcaaatcctgtatgaaagagagatgtgggcttccttttagagtcttgtgttaggtgctgagaccttttacatgggcttatacagggagagagtctt

SEQ ID NO: 680452 - DNA, 309 bp, Homo sapiens
caagccgtgtgggtgccctcaaggtgtgtgcaccatggaatgggagactggaggaacccagggtggccaaccatgggtccggtccctctggtgtgagccatgagccagctgagcctgagtgcgaagacggagagaaggccgaccacagtcatgacatcaacccccataacctggggacaactcaagaaaaccacacaggaggctgagaaactactggagcaccagggacagtctgtaaagttggatggaccatcaatgggaaatgagagctgcccaccctgggcttacactccttcaattattacataa

SEQ ID NO: 680453 - DNA, 945 bp, Homo sapiens
  misc_feature (667)..(667): n is a, c, g, or t
cagtctcccaacactgaagttccaaaataatccttaccactttgtaaaccatttatagctttggaaaggtggttaacgtggattcccttcggttaattcatttatgccatggttccatggaaccttcctggctggtaccatttggcacatcagggagagttaaccacacatttccaccaatttttacactgggcctaatatttcctttgggtgctgccccttttatggagagcatagtgggcgtttttcctcggagagcttggggattcttcctacaacataagagtgctctctttcctccttccctaaataggcgcacaggggtgctccctctctcactaccaacaggtgaacccaacacactccacacacgggtggttatcttaataaacacaactatactcatctatcacttaatacttcccaccaaggggcggcctacctgcggagaaggacgtcttcagggggcaattgtgcttcacacacaccttgtttaaccacccccctcgggtcggccccccacacagggtttcctcaccccacccacctcggcgtgccacattcatcttcaacccaacaactacgtttatctccccaacagccgaggggcacgcaccaccccttgtggctaggacaacctaaaaccttatcctctgcggcaacagcncatctgcgggtccgtctacacacaacaacactcgcttctatcattatcgataccgccccccccaaactttacacaacccggcgattcgacccacaagccgcctggcgcctccgggcgccccctaacatttggggctgccagagcgaccagcaacctcaaaaactctgggcgggcgcaaccccattctcgcggcaccccccagcgcccaacagccaacctcttcccatcgcccacttccaaaagccaccacccaaccagccaaaaagtgcaggcacaga

SEQ ID NO: 680454 - DNA, 155 bp, Homo sapiens
gcatggctgtcggagtgcatggctggccggactgcatggctggccggagtgcaatggctggcaagttggtgcttgttagcaaaataccttagttccttgacaggtagatttctttctttctctctttctttcttttttttttttttggggggggg

SEQ ID NO: 680455 - DNA, 159 bp, Homo sapiens
tccccctctctaccctcctgtcggtctacctcggagggggtcggcaaaggggacgacagatgtactaggggtggggtactctcggtaacactactcggacagtgactgtgactcttatgacccttcggtgccggcaggacgcggctcccatactcttcc

SEQ ID NO: 680456 - DNA, 580 bp, Homo sapiens
agacagggtctcaccccagagtgcagtggcaggatgacatcacaactcactgcagcctcaacctcctgggctcaagccatccttctagctcaggctcccgagtacctgggactacaggcatgagccaccacacctggctaattttttaaattttttgtagagatgggggtctccctatgttgcccaggctggtatcgaactcctgggctcatgtgatccacctgcgtcagcttcccaaactgctgggattacaggcatgagccattgtgtccagcccccttgggcttctttatcatcaagtacacagaaaaggtaacaggcctcagagaagcccaattctacagagaaaaaaagaatcaaataatgaattaagaaagtatccaggaaaaacatttttaaaaagtcattctttccctaagaattctaccgagtaatacaacataaaatattaataggcacctagttaaataaacttgatttaactctctctcagccaaatataatacagaactggtttgtctgtgtcagtgatttccgatcctagtgctcattaattataagggaggttttgtttcatttt

SEQ ID NO: 680457 - DNA, 287 bp, Homo sapiens
agaccccccggggccaagagactgaagagtctgaggtaggataatgacgtgaacccgggaggcggagcttgcagggagccattatcacgccactgcactccagcctgggcgacagagcgagactccgtcttaaaaaaaaaaaaaggaaaaaaaaaaaaaaaaaaaaaggggttccctggggtttctaaaaaaaaaggggggggagtttaatgggggcgggggggaattttttatggtttggccttaaaaaggtcctttttccaccttctaaacttttttttggccca

SEQ ID NO: 680458 - DNA, 344 bp, Homo sapiens
  misc_feature (167)..(167): n is a, c, g, or t
agaagttatgcacagaggcattcattgaaatgagttttaaaactcacttaaaaataatgagcaactgaaatctcccaaatagatacatagaagtaaaatacagtgaatccatatagtggaacagtaggcagcccttttttgggtgtatagggaaatagagaaacatntctgtgtaacataaactgaaaaagtcatgatacaaagttatattggattatgaacctatccgagttaaaaaatgcattaaagaacctatgcgagttaagaacgcaattacaggctcatgcctgtaatcccagctgaggcaggagagttgcttgaacctgggaggcacagattgcagt

SEQ ID NO: 680459 - DNA, 1237 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttcttttt

SEQ ID NO: 680460 - DNA, 926 bp, Homo sapiens
  misc_feature (17)..(17): n is a, c, g, or t
  misc_feature (473)..(473): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttaaaaaacaagaataaacaacanaaacgatgcagacactactcgcgaaaacgttttgtcggcgcggcgtgttgacccgaactggagaagttttactatacctgctgctttaggggcggccggggccccacattaggaatcaaagtctacaagtggcgactagctagtgagcgtaggagataccccggggtgtataccaagcgtgctggggtttgtgtacgcaataaaaaaagggccgcaggggtgcgacccatggtggtttctggggacacaatgccaggagtgggcgtacttgagcggacatttccgggaatcaatacaccgggagtgtccaaagcggcagcaacgagttgataattgacgccccccgtggggttggtgcacacgatgcgaaaatatctacaccaggggcacactgtgtcatctggacagaagcagccgcctaatgaagcacaagtgcggcgctgtatagtccgg

SEQ ID NO: 680461 - DNA, 220 bp, Homo sapiens
  misc_feature (6)..(6): n is a, c, g, or t
tcatancttggaagaaaatcctcagctcgggggtgttctatttctcagggccaaaggaggggtctcgcttggacctgactggtccgcacgcagaagcagggggatgacagctctgagatggggggacactccttcgttctgacggcagccacagggttttgcatctggggcctgtggtggcctgctggggggtacccgacgtctcgacacttcgtacgtc

SEQ ID NO: 680462 - DNA, 478 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttcttta

SEQ ID NO: 680463 - DNA, 452 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttcttta

SEQ ID NO: 680464 - DNA, 1369 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680465 - DNA, 278 bp, Homo sapiens
ggtatctctagataaagcagtctgttagcaacgcatactctgtcttttgttcatctgggaatttctcaatttcaccttcagcttcggaaggatagttttgctggatattgaattcttggtttacagttttttatttttctttcagcccttgaggatcttatactaccattctccagcctcctcgtgtctcatgcttgaatttggctgttaatcatatagatgctcctttatatgtgatcagtcatttttcacttgctgctgtcaacatttggtctggt

SEQ ID NO: 680466 - DNA, 2407 bp, Homo sapiens
  misc_feature (17)..(17): n is a, c, g, or t
  misc_feature (1217)..(1217): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggtgtgggtagttatgtggacaccctccgaaaagagccggtgtgcttatataagagccaggaggtcgggcaagcctcctctgggagtgtctgggcgctggagcctctgggccggctctgtacagtgcgggctgggcctctgtgttctgtgcggccacagagagactatggagagaggctgtgtgtgaggactttgaaggggccagnaggcagaaggaggtgatatgtctgtgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680467 - DNA, 2344 bp, Homo sapiens
  misc_feature (17)..(17): n is a, c, g, or t
  misc_feature (1217)..(1217): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggtgtgggtagttatgtggacaccctccgaaaagagccggtgtgcttatataagagccaggaggtcgggcaagcctcctctgggagtgtctgggcgctggagcctctgggccggctctgtacagtgcgggctgggcctctgtgttctgtgcggccacagagagactatggagagaggctgtgtgtgaggactttgaaggggccagnaggggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680468 - DNA, 1035 bp, Homo sapiens
  misc_feature (34)..(34): n is a, c, g, or t
  misc_feature (68)..(68): n is a, c, g, or t
  misc_feature (89)..(89): n is a, c, g, or t
  misc_feature (106)..(106): n is a, c, g, or t
  misc_feature (127)..(127): n is a, c, g, or t
  misc_feature (129)..(129): n is a, c, g, or t
  misc_feature (149)..(149): n is a, c, g, or t
  misc_feature (173)..(173): n is a, c, g, or t
  misc_feature (218)..(218): n is a, c, g, or t
  misc_feature (226)..(226): n is a, c, g, or t
  misc_feature (244)..(244): n is a, c, g, or t
  misc_feature (291)..(291): n is a, c, g, or t
  misc_feature (315)..(315): n is a, c, g, or t
  misc_feature (333)..(334): n is a, c, g, or t
  misc_feature (340)..(340): n is a, c, g, or t
  misc_feature (345)..(345): n is a, c, g, or t
  misc_feature (352)..(352): n is a, c, g, or t
  misc_feature (354)..(354): n is a, c, g, or t
  misc_feature (360)..(360): n is a, c, g, or t
  misc_feature (362)..(363): n is a, c, g, or t
  misc_feature (368)..(368): n is a, c, g, or t
  misc_feature (373)..(374): n is a, c, g, or t
  misc_feature (377)..(378): n is a, c, g, or t
  misc_feature (380)..(380): n is a, c, g, or t
  misc_feature (384)..(385): n is a, c, g, or t
  misc_feature (391)..(393): n is a, c, g, or t
  misc_feature (395)..(396): n is a, c, g, or t
  misc_feature (400)..(400): n is a, c, g, or t
  misc_feature (406)..(406): n is a, c, g, or t
  misc_feature (409)..(409): n is a, c, g, or t
  misc_feature (412)..(412): n is a, c, g, or t
  misc_feature (415)..(415): n is a, c, g, or t
  misc_feature (426)..(426): n is a, c, g, or t
  misc_feature (428)..(428): n is a, c, g, or t
  misc_feature (431)..(431): n is a, c, g, or t
  misc_feature (435)..(435): n is a, c, g, or t
  misc_feature (439)..(439): n is a, c, g, or t
  misc_feature (448)..(448): n is a, c, g, or t
  misc_feature (516)..(516): n is a, c, g, or t
  misc_feature (611)..(611): n is a, c, g, or t
  misc_feature (628)..(628): n is a, c, g, or t
  misc_feature (687)..(687): n is a, c, g, or t
  misc_feature (770)..(770): n is a, c, g, or t
  misc_feature (780)..(781): n is a, c, g, or t
  misc_feature (795)..(795): n is a, c, g, or t
  misc_feature (840)..(840): n is a, c, g, or t
  misc_feature (856)..(856): n is a, c, g, or t
  misc_feature (885)..(885): n is a, c, g, or t
  misc_feature (902)..(902): n is a, c, g, or t
  misc_feature (941)..(941): n is a, c, g, or t
  misc_feature (960)..(960): n is a, c, g, or t
  misc_feature (966)..(967): n is a, c, g, or t
  misc_feature (986)..(986): n is a, c, g, or t
  misc_feature (1017)..(1017): n is a, c, g, or t
cccccttctccatcaatctttccaaatccccaanaacctccaacttcctttatcaacttccaaccttntataacttcatatacacaatnctcattcaaccaacttnccacccctttccatcttcatntnctttcttttcaacctttccnttataacttcttcccctatacccnctttcccttctcatcaaccctctcttttccaacccctccaacttntcttcatncctttatcttcttccttnccttaaatacacctacttttatctttttatttttctttttatttatntctaccatcttttcctataccttnacatctcctttcttcccnnctccantccangccccananccaccnanncccanccctnnttnnanccannctactnnnanncctngcccanccngancanctccatccttnangancctncctncattcccangacacacggcaggagtgctgggacctggaccgccaggccagcgacagcctggcccaggcggagcaggnacccagctctgcgggccccacctcttcctcgtcttctgaacgtgcctatggcccaggacagcctggcaggtggcctcgctgcccccagttccccnctctgcccccacactcntctaagttgcttcacactggtcactggcccggcacactgggctattgctttatccctancctgagagcagcccctccccaccatccctccacatgctgcaaggacagactgaagggctgtgagcaggtgtaagggctcccanatccgtgagnntgtgtccgcagcgnctgccactctgggctgctccagcctgcaacttagtggaaggaatnacttcctcctgaggcnacaggcgagaaaggtagggatgggccagnctcccgtctcagctgtngggagacagtaggcaggctgagtggcccagagcactccnggaagtgggactcccctgncttgcnnatgtgcctctccagactgntcctgcacttaccccctccccgcagcacctncttgcccgtctgccacac

SEQ ID NO: 680469 - DNA, 1501 bp, Homo sapiens
  misc_feature (124)..(124): n is a, c, g, or t
  misc_feature (937)..(937): n is a, c, g, or t
  misc_feature (1270)..(1270): n is a, c, g, or t
gctgatacagatagtggtgaatactctcttctcctcgtcggtgcccacatattagtagacctggttcttaatatatgtcataatcatgggggggagaggcccgccttttgacacaccccagcgngggggggccctacaaactatagataaggtggatgaacccaacgtcgtcctttaccaccacggcctctcttcttctgaagaagaggagtagccggcccctccgatgaaacctagtgatgtgtacccgcccttgggagcttttttcctcccgctcccactgcccattgggggtatgaggcgatgtttcctcccttcttccccccccctgtgtggcccccccccatctggggggacttcatcaaaaaaaagagggttgtgccgttcggtgtgtttttctcctgaggccagggggggggcgcccacttgtgttttccgctgctgaattatgcggggttgtttgttaggaagtagcccccttcttcctgcttatccgctcctggggggaagaaggcctcttctgccacaaccagcggggtggtcatcaacaccgcttgtggagagtccccggggggtggcgccacccccgcggagaggggaaacacctcacacaggggagggaggcgcgttgtggcccccacttcgggcgcggaccacaccacctgcttttcttctggggaagagccttctccccccgcggagaagaagtgtgagcaccacaacaggggaggagaccacagcacctgtgggtggggagacgagacgagccacaccaacaagtagtgtcgtcgctcttgggtgagacgccgccccctctgttgtcgcccgcacaaagagagggactactctgtgggagaaaaagggagagagggggagaaagagataaatatgttgggttgagagagctctctgtgtctgtaaaacataaacagagagngggagtttgtgagtactctctgcgagattttgtagagtgggagatacacatatataggcggctcgagaggatgtctcggtgttgtctctctcggagagaaggatataagagacacagagctggtctctctctctcgggtatctcggccacgcgagagatgcgggttctgtgctttttgggagagaatctctctttataggagaggcgctctcctcctctctcgcacatggcgcctctcacagtctgtggcacagacacagcccccgagagttgtttctctcctctcgcttgagatcgcgaatttctctttctcctccacaggatagagagatnttttctctttggcttatatgtttgagaattccacttgccctctttttgttcacatcacacacagagaaggtgagatgtttggagaatcgcttttttttgttttgtgtttgagattaaatgggtttttttaaagagaataaacacacaaaggttttttattagcacttttgaaaaaaggaaagtataaaagtacacagtttaataaaaaggggccttccccccttagaaata

SEQ ID NO: 680470 - DNA, 1250 bp, Homo sapiens
cccgctacggatgtgggttacaacttggaatgcttgaggctgcagaacccctccccttcttgactgagcagtaagggttccctgctgtggtgcaggaacatgtgggcagagccctgggtgtctccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680471 - DNA, 1936 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680472 - DNA, 1874 bp, Homo sapiens
  misc_feature (17)..(17): n is a, c, g, or t
  misc_feature (684)..(684): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggtgtgggtagttatgtggacaccctccgaaaagagccggtgtgcttatataagagccaggaggtcgggcaagcctcctctgggagtgtctgggcgctggagcctctgggccggctctgtacagtgcgggctgggcctctgtgttctgtgcggccacagagagactatggagagaggctgtgtgtgaggactttgaaggggccagnaggcagaaggaggtgatatgtctgtgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 680473 - DNA, 311 bp, Homo sapiens
cttgggaggcgagtggcggatcacctgaggtcgatcgagactgccggccaacatggggaaacccagtctctactaaaactataaaaattagctgggtgtggtggtgcatgtctgtaatcccaggtactcgggaggctgaggcacaggaatcgcttggatccggaacccgggaggtggaggttgcagtgagccgagatcacgccactgcattccagccggggtgacacagcaagactaaataaataaataaataagaggaattatcaatcagtggtagcggttatggaaaaactttatgatttaccggagtg

SEQ ID NO: 680474 - DNA, 164 bp, Homo sapiens
cccccggctaagagcggtctgttgcgtgaactgtgtgtgtgggttgcagacgtggctcagatcccgagttgccgtggttgtggtataggccaggcagctacagctctgattagacccctagcctgggaacctccatatactgcaggtgcagccctaaaaaaggc

SEQ ID NO: 680475 - DNA, 659 bp, Homo sapiens
taccccttcgccccaggcaaccatcatctactctctgcttctatgagttcaacttttcattgcagcactgttcacaagagctaagatacagaaacaatttaagtgtgctgtgatggatgaatgatgagaatgttgtatatatacataatggaatacgattcagaactaaaaatgaaggaaatcctgccacttgcaacaatgtggatgaacctgcagaacattatgctaagtgaaataagccagacacagaaagacaaatgctataggatctcacttatatgtgaagccttaaaaagaaaatgaccaggtgatatggtttggctgtatccccacccaactctcatcatggattgtagttcccataatctccacgcgttgtgggaaggacctggtgggaggtaattgaattgtgagggcggttatccccgtgctgctgctgttgtgatcgtgagttctcatgagatctgatggtttctgatggttttataaggggcttccccctacttcgctttgcacttctttctctcgccgccttgtgaagaaggacgtgtttacttccccttccaccatgcttgtaagtttcctgaggcctcctcagccatgctgaactgcgggtccattagacctctttcctttactaatcagaaaacacccaaaaa

SEQ ID NO: 680476 - DNA, 289 bp, Homo sapiens
tgaatcagtgctgcgtgtggatacaggtgcaagctggcccaggagaatggctgtggggtcatggtgagtcatcgcttacgagagactgatgacacattcattgctgacctgctggtggagctgtgcacaggccaggctagtgaggcatcctggtgagtgaagagaactctctgtgggattggtatttctagctcacccacctagtctgtcgttccaggtgtttgaggtgtgcaggggagcttcaggagagccgaggtttactttcaggcgtgagaggacagccactgag

SEQ ID NO: 680477 - DNA, 297 bp, Homo sapiens
  misc_feature (22)..(22): n is a, c, g, or t
  misc_feature (80)..(80): n is a, c, g, or t
  misc_feature (88)..(88): n is a, c, g, or t
tcccctcctaagtggacctccntttcgagagagagaagggggggtttagtagctactcttgcctcaagcctgagccggcncatacttngaagaggaggaaaaactggattggggaagattctggggcaaaatgaagccaaattgagaacgaggagaaaagaagatgctaaggccgcagataaggaggtcttgagtgttacagctctttttgaatttgtctagcatgctttctgctttttactggaaagtgcccccccccaaaaaaataaaaatttttttttttaaaagaaagattgc

SEQ ID NO: 680478 - DNA, 142 bp, Homo sapiens
caggcagatagcctgagctcacaagtttgagactagcctggggcaacatagcgaaactctgtttctacaaaaacaacaacaaaaaacaacaacaaaaaaaacttgaaaattagcccagcatagagatgtgtgcctgtagtcc

SEQ ID NO: 680479 - DNA, 396 bp, Homo sapiens
tttttcatagtgtcagtagtgtctgcttgttcttgatttctagttttatttcactgtcatccaataagattcttgatatgatttagatatttaaaaatttctttagacctgttttatgattgttgtctatctcctcttaggtgtggtagtatttgttttatgaatctgagtgctctaatttggggtgcatatatgtcagattgttatatcttcttgcttaattgatccctttatcattatatgatgtacttctttaactttattcactgttgatgatttattcttgcttacttttggtttgcatttgcatgaaatatcattttttacccccttaccttgagtatctaagtgccttcaccagttaggtgagtttcttgtaagcaacactgtgttgaa

SEQ ID NO: 680480 - DNA, 130 bp, Homo sapiens
ctgctatttatttgataacatctttcgcttcacccaggctggttcagaggtgtctgcattcttgggccgcatcccctccttgtccatgctgagcccgccccttgtccagctgatcccaaccttgtcccag

SEQ ID NO: 680481 - DNA, 118 bp, Homo sapiens
cacacaacaaatagtgtcaaacaaagtagacaactaagaaaaacatctctttcccccaaatccaatccaaaacaaacagtgcaagatgggaaacgggggtgttggaggataacatcac

SEQ ID NO: 680482 - DNA, 991 bp, Homo sapiens
gtagaaccggctggtagggatagtcagaggcggagtcctgagtagtggtcactgatgcacggactctgtgcccatgaacatatgggatcgctggatctactttgattcgctttaatcttccctcatttgaatgcgtctccgcagatgttcctggtgaaagtctatgctgttgtgcgcccttcgtatgttgtgatgcggtgtgtgccgtcttatgtccatgttggtcgtgcaatatggttcaggctgcgcctgctgctcctgccgttgggggcctcccctgcatctggattgatttgcctgctgtggacacactcgttgcctctgtatacctggaagcggatgtaggagtgtggatcgtccttgccatggattgtgcattccttacatggagttggctcgtgggtcgctgccctgggttccgttttggtggtcgtgccgcgtgcagttcttcccaacgggtttcactgggcgcggacctgatctttagctgtcttcaccctcgagtgcactctatgccacggcgctctgaaggtttcctctttctgggcggtatcgttgatgtcaagcctgcctcgttggatggtgctgtttattcctgagtgaatgtcacttgggagtccatttggcttttcctgggcaaaactgtctgtgtgactggtggtcctttgtgggtgggttcgtcctaaggtgtctccacctctggctggtctagcgccctgatggtgctttgatgtcctgttggggcctctgcttgctcgcttccttggagtggtggtccaggttgttcgcaaagtccgtgctgctgctggccacccatggcggggtcgaaccccgtccatactcggggtcccaacggtttcgccttggttgtgggaccggtacccttccctgttgacaggtaagctttgtggtgggtcaacgcgatgggttgagaccctggttgggcgaccattctctgttggttgccctttggacagatcggggctgaacc

SEQ ID NO: 680483 - DNA, 3460 bp, Homo sapiens
  misc_feature (4)..(4): n is a, c, g, or t
  misc_feature (535)..(535): n is a, c, g, or t
  misc_feature (538)..(538): n is a, c, g, or t
  misc_feature (540)..(540): n is a, c, g, or t
  misc_feature (544)..(545): n is a, c, g, or t
  misc_feature (548)..(548): n is a, c, g, or t
  misc_feature (1040)..(1040): n is a, c, g, or t
  misc_feature (1096)..(1096): n is a, c, g, or t
  misc_feature (1119)..(1119): n is a, c, g, or t
tccntaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcntgntncgtnnagngccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacgcagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcatttnaaaaacacaaagggaaaatgggaaaataataataatactatcagtgatggcatttncccgggctcctaaagcagctgcntccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtcgggggaggggtggttgtgtttttgttttgcttcaatttttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaaga

SEQ ID NO: 680484 - DNA, 2432 bp, Homo sapiens
cggcgcttggcccagtcccgcggtcctcgtcgcgaccggcccgggccgcaggacgccgcgctcgggggagctgagccacctctccgccaggcccgtgcgagcggtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggtggaaggccccagtgcgcctccaggctggtttcccctcttgccccgcaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggccttgccatatgccacatgctctgaagggagagtgcttgcatggactttgccaaatcctgtctgctccatctcagttgaatggaaaaggagggaggtggggctggtagataggtgcatttggtgctagtatccaccaggttttgtgtgcatcccgtaatgagcccacttcctgaaaacatttaaagaaaaaagatatcagctggagatggcagtgcgcacatgtaatcccagctactcgggaggtttaggtgggaggatcactcaaacctgggagtttgaggccagcctgggcaacacagcaagaccctgtcttttttt

SEQ ID NO: 680485 - DNA, 2973 bp, Homo sapiens
  misc_feature (4)..(4): n is a, c, g, or t
  misc_feature (535)..(535): n is a, c, g, or t
  misc_feature (538)..(538): n is a, c, g, or t
  misc_feature (540)..(540): n is a, c, g, or t
  misc_feature (544)..(545): n is a, c, g, or t
  misc_feature (548)..(548): n is a, c, g, or t
  misc_feature (1040)..(1040): n is a, c, g, or t
  misc_feature (1096)..(1096): n is a, c, g, or t
  misc_feature (1119)..(1119): n is a, c, g, or t
tccntaatgacttcttcaaggacatgttccctgacctgccgggggggcctctgggacccatcaaggcggagaacgactacggtgcctatctcaacttcctgagtgccacccacctgggaggcctcttcccaccctggcccctggtagaagagcgcaagctgaagcccaaggcctctcagcagtgccccatctgccacaaagtcatcatgggggccgggaagctgccgcggcacatgaggacccataccggggagaagccatacatgtgcaccatctgcgaggtccgcttcaccaggcaggacaagctgaaaatccacatgcggaagcacacaggggagcggccctacctgtgcatccactgcaacgccaagttcgtgcacaactacgacctcaagaaccacatgcgcatccacacgggcgtgcggccctaccagtgcgagttctgctacaagagcttcacgcgctctgaccacctgcaccgccacatcaagcgccagagctgccgcatggcacggccccgacgcggccgcaagcntgntncgtnnagngccgccagcctgctcttcgggcccggcggcccggcccccgacaaggcggccttcgtgatgccccctgcgctgggcgaggtgggcggccacctgggcggcgcagctgtgtgcctcccgggccccagccccgccaagcacttcctggcagcgcccaagggcgccctgagcctgcaagagctggagcggcagttcgaggagacgcagatgaagctgttcgggcgcgcgcagctggaggctgagaggaacgcggggggcctcctggccttcgcgctggccgagaacgtggcggcggcgcggccctacttcccgctgcccgacccttgggccgccggcctggccggcctccctgggctcgccggcctcaaccacgtggcctccatgtccgaagccaacaactaggctggtccctgtcggctccagcccaccagccctccagtccttctccctccaggcccactctaccctaccccatggatctgaacttttcatttnaaaaacacaaagggaaaatgggaaaataataataatactatcagtgatggcatttncccgggctcctaaagcagctgcntccttttgctggtctgagacgggcatcttttcccaaaaggccaggagcccgggcctccctccctgtctctctggctctcatatagaaacttgcaccggcccatgccacaaagaactgggtgcccaggggcacttaggagctgggtgagtcatgaggggtcagggggtggttggcctggtgcccagccagccacagcaggaggaggtaggggctgggcatgcaccttggttaagccccaccccctatggcaaagtctctgccaacactcctctgagggctcattttccagtctccagtggccccggggtctttttgagaactacccacctgccacatagaaagaaatgctctgttggcagggaggcctcctggaaccagtcaggaaccaggctctggaaggcccgggccatttcttccctgacctgtcctgtgaccttgacaggtcagccctctgtagctcagtgtcacctggctatggaaggggctggtaactgaggtttccgccctccacctctaaacacatacacacctatccccccagagaatcacagagatggtagaagctttgtactccccaagtccatggggaaacagtttatctttctggacttagttttatcacatccagctctatattagcatattagcataggtgagaaatatggccagactagacagagatcaggtcatcaggggagcttccgagcttcagcaaagcccacaggtagctctgcgaactcagaatgctaccctaccttccctgcaggccgctgttcatgtctggactcctgggggcgctatttaatgtttacccccatctccagtgccccctccaaggctgtgcagtgtcttggggctctcagggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaaattcaaggggggccccgttcccaattgccctttatggagagttttttcaatttacggggcccgtttataaaccaacgtttttggtggaaacccccgtgttcaccccatttaatctggttggaagaaa

SEQ ID NO: 680486 - DNA, 2131 bp, Homo sapiens
cctgctgagcagggtcaaacatcgcccattctgaatcctcactttgtaggggaaaaattgaggcacggagagggatcaggctttgctcaggccacatggccagtccatggcaggtgggtatcagaatccaggcctgctcgtgcccttgaaaccacctggctagttccagctggaactgccctctccagccactctcctcctctcccagccacctcctcattcagctgctacctgctggctgtcttctcccacagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggccttgccatatgccacatgctctgaagggagagtgcttgcatggactttgccaaatcctgtctgctccatctcagttgaatggaaaaggagggaggtggggctggtagataggtgcatttggtgctagtatccaccaggttttgtgtgcatcccgtaatgagcccacttcctgaaaacatttaaagaaaaaagatatcagctggagatggcagtgcgcacatgtaatcccagctactcgggaggtttaggtgggaggatcactcaaacctgggagtttgaggccagcctgggcaacacagcaagaccctgtcttttttt

SEQ ID NO: 680487 - DNA, 1187 bp, Homo sapiens
  misc_feature (171)..(171): n is a, c, g, or t
  misc_feature (192)..(192): n is a, c, g, or t
  misc_feature (604)..(604): n is a, c, g, or t
gccacgagctgcgaaagggcgggaaaggcagttggagaagaggtaagcggttactcactccatggctgcagcaaggagaggcggcggcggctcggctgaagaaagaaggtgggagcggagagcgcaggcgtgaaatcttcccaaggctgcagacaccgacggatttgcttngggagccagagtagctgccgncaccagagtccggagccatgagcgggtttaattttggaggcactggggcccctacaggcgggttcacgtttggcactgcaaacatgacggcaactaactcgatcgaacctgacgtacaggggtatattctattacgtgcacacctctggtcactggagggttgaatctttcggggctcccgttcgcataccaggccacaaagttacacccttatccgaaccggacgcatgttcctcatcttgtgccgacgccgagaatctcctggaccgagcaatagacgacgaggcgtatcacgtgttagggaatcagcgaactcttgcgttcgggggcggaactggactattgcttaggggatcggatgctgtcaacaggctcaaactctgagcaagcaacagactgcacaacacccagnccatgggcaaaggcccagtcgtgctttggggctgggacagactaggcaagtctcactaatgctcatgatcgagcaccgttcaccatcgcagccagggcacaagaaacgccagcggggtttgtgttcggcccctccgactagctctgtggctccgagctaccacatcgtggaggcttctcattcactggtggaagcacggccgaacagtccgggttcaaaatgggtcagcaggaagtcagcccagccaaggaccggccagatgccttcaatccgggaacgccagaagcacaacagaaggtgcagccaggcaggggtccaaaccaaaggcaacgacccaggtgggcaaggcgcatggggaaagaaggcaactacattggcaacaggggaactccttgtacccgtaaccaagggggcccatgttgggaaaaggctcactaaggacgagaaaatgggaccaaaaacacgggacgcacaccaacaaaggaacacgaggtgaaaaggcaggacacaaagggacacacaggagggaacagagagtggaagctggcgcggccagcggtcctcgcagtgaaagagaaagaaa

SEQ ID NO: 680488 - DNA, 1640 bp, Homo sapiens
ctagttttagaagtcaatagcatttactagaggacaggcgccactgaaaacttcccaggatttaattcatcaactagaggttttgctgcagagggtttaaagcttacttccagtgctcaagctttttcaaaacagctgaaagacgatgacaagcttatgctgggccaacatcgaagagatgggggccacctcttaacacctggcaacagtctcccctcatcctgattcctgacaacagacaaaacaccggtttctagggtttatctgtttgttttttgagttgagggttcctcagggccttggcattgctagtgatggtcccctttgctgtgtgagaaccccctcaaccccttcctcctccctctggggatgaagtgggagtatttggctccccatttttgacaaaagggctcagtgcagggaggtggaggcctctgaggtttgaagggctctgtgagttagagttgtcacatgttctcctggttcttgaatttgcagcaggtcctgaaaaggaaggctctgctggccccgtgccttcctgaccttctctctccttccctcccctctcttttcttgccaagtttgctttggtttctgagcagcccagagaggaggagggttcgtccccagggagagcccagggctggagtccccaatccctgtgctatgggcacaaagagacttcagctcttcctgttgccttggctttttcctgagcaaaaacacaacaaacaaaaaggccagagaagagcacagactctgtccctctcacaactctccagaagagaccccctgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtcgggggaggggtggttgtgtttttgttttgcttcaatttttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaaga

SEQ ID NO: 680489 - DNA, 263 bp, Homo sapiens
ggtaagaggtgactagaagggaaaataactaggggaggttaggaccataggaggagatacagggtagactagggtacctagcggataggcactaccctagagtaaccataatatacacataacataagggtcctagcagctaaactaaagtagacacacaaataagaacagagggtacctagtaaggtattcacgacagactgacatacctaatagagtacataagaggaggatactaaacccataacataccagccagcagg

SEQ ID NO: 680490 - DNA, 250 bp, Homo sapiens
gaaacgcacaaggaaaaaccaggtatgcccaagtagcaagcaataatattattaaaccaacagggacaaaagttaagacatggagaaagcaaaatattcattcacataatgagaaactaaagttgaagctaatatatcaaccggggaaaagatttaagcgcaagcgatgcttggctatctttcacattcatttcttttcttctgagcgaaggcatatcagatattcttgaacaagtcaatacagctctgc

SEQ ID NO: 680491 - DNA, 1081 bp, Homo sapiens
actgagcaactagcggaatccagtagcaggccctccggacttttttccttgggtaccaggtactcggggccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctgaacctgagcaccccttgctgagctaggaggaaaggaagtcgagcgccgcgaattagtagtagtagtagtagtagtagcggccgc

SEQ ID NO: 680492 - DNA, 806 bp, Homo sapiens
  misc_feature (171)..(171): n is a, c, g, or t
  misc_feature (192)..(192): n is a, c, g, or t
gccacgagctgcgaaagggcgggaaaggcagttggagaagaggtaagcggttactcactccatggctgcagcaaggagaggcggcggcggctcggctgaagaaagaaggtgggagcggagagcgcaggcgtgaaatcttcccaaggctgcagacaccgacggatttgcttngggagccagagtagctgccgncaccagagtccggagccatgagcgggtttaattttggaggcactggggcccctacaggcgggttcacgtttggcactgcaaagacggcaacaaccacacctgctacagggtatcctataactccagcatctggcactggagggttgtaattatagggtgctcccttccaatccagacacaagtaccccattccatccggcactgttctcaccttgccacaccataactccggaccacaacagacgaccaggcttcagcttttggaacagctgactcttgcttacggcggggaactggatcatacttcggaggatcggtgcttcaacagctcgaacttgagcaacacaagctgccaaccccagccatggcaaaccccagaggacttagggcttgagcagaaagcaaacctcactaatgccatatcgagcaccgtcaactccagccaggacacagcaaccaccgagctaagaggtcacgcgccccatacaaccaccttctgtagggatcccagctaccgaccattctggacgcgcttctcatttgcctgcgtggaacccacgggcccaaaacctccggttaccacagttcggctcagcaagcgcacattcagccaa

SEQ ID NO: 680493 - DNA, 979 bp, Homo sapiens
gtttttattttgtaaaggtgatgacttcttataaactcaatttttcagatgactggttagttctttctgttttttcttggctgcagtttggaattgtacattgtaaaatatccaaagatgttgagtactgtatgattcttcacaccaccggatgccactccagccagcaggattgctacacacaccctctgttctcagaagtcatctgcctgggcagccgcctctcagattcctgtcttcgtttcagacacttttctctgaagcatgcccatgtccaccagccaacgtgcccccgtgttcccccccatcagccaagtgattggggctgaaccagactttaaaagagaggaaaaaaaaaaaaaaaaggaaacatgaataaattggaatccagtggtgttggggcttttgtttttattttgtaaaggtgatgacttcttataaactcaatttttcagatgactggttagttctttctgttttttcttggctgcagtttggaattgtacattgtaaaatatccaaagatgttgagtactgtatgatcaagaacttgaagcaaatgggttgtcgggggaggggtggttgtgtttttgttttgcttcaatttttttttttttttttgatgtttcaatttccctgtctgtctgtgggagaactttggaattttttctatttataactctttttttatgtgattgctctacgtaaaatgacactcaacaaagtttgccttagtgattcaagggacaatcttccataacttcggtcgcacgccacatcccgccgagaaaaactctcagctaattttctggcctatttattaaacagtattaattgacttgattaaattatattgagagttgcacttctgtgagatgtgacttctgaaagttcacaggacagcaacaagccagtcttaaggtttttaattgttgggtgtcataaacttaaaataatgtcaaagacaccttaacaaaga

SEQ ID NO: 680494 - DNA, 126 bp, Homo sapiens
cggagtggagagagaaaggatgtgtagcgttttacagattctaaaaggtctgagacctgtagcattaataattttagatgccctccccttctccactcccgggctacccgcagcgtcgatacttcc

SEQ ID NO: 680495 - DNA, 222 bp, Homo sapiens
agcagattatatttctgagttttctattctgctccattggtctatgtgtctgtctttgtaccagcaccattctgttttggttacggtagcttttttgtttgtttgtttttttgagacagagtctcactttgtaccccagaaagtaaatctagttagatgtggtttgtctcggctcactgcaacctccaccccgtgcgttctagcaattctcctgcctcagcc

SEQ ID NO: 680496 - DNA, 185 bp, Homo sapiens
cgccccaaatcattttaggagaatggcacagaccacccactgtttttgtcaatctgtgttcttttcttctgagcaggtccttaaccctggcaaaataaacttctaaactgattgagacttgtctcagaatacttcttggtttacaaggatgatagcaacaatggtgagggtggcatcgataaaca

SEQ ID NO: 680497 - DNA, 898 bp, Homo sapiens
ccactctagacaggcggcgtcgcgcagcatgagggcatcgttgtgggccttgccgatggtctggtgatcctcgtgcatgccgaatccggtcaagtgcacgggctcgccgttgacgaggaggcgggcgccgtcgacacggatagttcggacgccgaagacctgctggtaagtatcgattacctgatcaccgtcgactagggagatttcggcctcgtaaagatacccgtggcctggctgccagagatggaccgacgggatgcgggcatgggcgttcgcactggttccctcagcgaccacgttgccctcggtgtcgaaaattgtcacccgagtcgttaaaggttcagcatcgtgcgaaagaaccgaccaggtgacgattccgtcatttccgtcaatgtcagtggtgatggtgacgtcctcaatgtgggcctgggggcggcgacacagccacacgtcgcggtggatgccggcgtaattgaagaagtcgtgccagtacttctgcttcggggccctcgggagagtcgacgataacccccggcggaatggtctggaaggacaaccgattgtcgacacgaactgtgagccgacatttttttgccccggcagaactgactcggtgatatcggcttcgaaagggaggtacccggcaagcatgtctgacgaacctcgacgtcgttgaccccaaacgggggcgggcatgagtcgcagaatcgaaatggacgacgaacgcgatccatcggggtccagcccggggcggaaatggcggaaccttcacggtgggctaccccgacctggtgaccaacacgtgaacgcgggagggaggggaaccacgggggaagaaaatccctggggaacgaaaggcccgggaaacagggccaacctctcggggggcgccgcttac

SEQ ID NO: 680498 - DNA, 452 bp, Homo sapiens
ggagtgtgagcagaacagttgttaaagaataagaaaatctttcagtcatcattcagtccagtttccctgcagagtgcatgagccactggtataaaatctttgtgaaacgaatcagaaaggatgtccctggtgatccatgaccttttgttagtatagtaatggactggtaagaaattcactctgtgaaagcagtgagcacacgagcttttgccttctgagtgcctattgtgttagcacatcccagcacagttattctgtctttgacatccttaattcctgtaagggctgtctcatcagtgcagtcaatgtctttctgggggaatagtgcaaaacagtgatatttcatcagcatcccaggcttattctggcattaaattttcatcagcagtgaccttggcaaacttgtcaatgaatttctgcactgcttcagtaaacatttagaatttaagaaa

SEQ ID NO: 680499 - DNA, 381 bp, Homo sapiens
  misc_feature (16)..(16): n is a, c, g, or t
  misc_feature (94)..(94): n is a, c, g, or t
  misc_feature (102)..(102): n is a, c, g, or t
  misc_feature (111)..(111): n is a, c, g, or t
  misc_feature (171)..(171): n is a, c, g, or t
  misc_feature (191)..(191): n is a, c, g, or t
  misc_feature (234)..(234): n is a, c, g, or t
  misc_feature (236)..(236): n is a, c, g, or t
  misc_feature (248)..(248): n is a, c, g, or t
  misc_feature (254)..(254): n is a, c, g, or t
  misc_feature (259)..(259): n is a, c, g, or t
  misc_feature (261)..(261): n is a, c, g, or t
  misc_feature (267)..(267): n is a, c, g, or t
  misc_feature (275)..(275): n is a, c, g, or t
  misc_feature (281)..(281): n is a, c, g, or t
  misc_feature (285)..(285): n is a, c, g, or t
  misc_feature (289)..(289): n is a, c, g, or t
  misc_feature (309)..(309): n is a, c, g, or t
  misc_feature (311)..(311): n is a, c, g, or t
  misc_feature (317)..(317): n is a, c, g, or t
  misc_feature (322)..(322): n is a, c, g, or t
  misc_feature (344)..(344): n is a, c, g, or t
  misc_feature (352)..(353): n is a, c, g, or t
  misc_feature (366)..(366): n is a, c, g, or t
ccaatttttttgcagngaaagggtggcgccccgcagccttgggaggcctgcccaggctcccgtggagcttccaacagctgtttggccccgcagntgcccccncttcctttnagacctgcactttcatgcttgccgcatcatgcctccctgtgggggctttgggcatggagnaggcaaaaaagggggtgccnggcctcctgtatttggggtcttcccccagtggatgtttcatgnantttggccccacncactcncaatnantttggntggccccncgcagngggnccanccgccccccaggtggcctcncnttttgntttgntaagtttggagaaaacagaacnataaaccnnatgcaggtggggnccgcccggcctttca

SEQ ID NO: 680500 - DNA, 424 bp, Homo sapiens
tttctttcgcccagtgctgagtgaagtggtgccttcttggctctcgcgacctcctccccaccggttcaagcgattgtcctgcctcggcctcctgagtggctgggattgcgggtgcccgccaccatacctggctaattttgtatttttagtagagatggggtttccccatgttggccaggctggtcttgatctcctgacctcaagtgatccacctgcctcagcctccaaaagtgctgggaatataggcgtaagccactgcgcccagcccaacttgccattttaacagttcttagtgtacagttcagtagtgttaagtatgttcccattgttgtacaatcaatcttctcatcttgcagaattaaaactctgtacccattgaacaacagctgctcatttcccccagccccagactgggcgaaagaaa

SEQ ID NO: 680501 - DNA, 196 bp, Homo sapiens
  misc_feature (122)..(122): n is a, c, g, or t
  misc_feature (163)..(163): n is a, c, g, or t
cccgtctccaccaaaaatacaaaaaagttagccaggcgtggtggcgggcgcctgtagtcccagctactcgggaggctgaggcaggagttgctgggcactcgacacaaggatttctatcagtntgctctcctgcacatcacccaggtctggagtgccaggaggntcaaaaacatagaatcaaagattagccaccttc

SEQ ID NO: 680502 - DNA, 567 bp, Homo sapiens
tttccctagcgtgctaaaagaaatccagttgtatttatattttctgtattatgtattttcatgcaagtttattatgttggtatagaatgagccaaggtcttcttagagcaatgaggtagttccctgccctgtctccatctccctgtctgcactgtctctcccagagttgtttgctggtgccttctttgcagtccccgtgtgcgtgtgtcatgccgcgttggctgacccagccccctgtggtgtcttccccatccctgtgtgacgtgtcgctcttggtagttcctccgtgtttcctttgtttccttaggtgacttgtctttgccccactccctgcagtccgcagcaccctgttgtctccttccctctcctcccgcttctcctcagacgtcatctgttctttctagagttggtccccctttgcccagggtccagggttcctaacagcctgttttttttctttctttttttttttaagtgagacagagtctcgctccttgttgcccaggttgacgtgcagtgatgcggcctcagctcattgcagcctctgcctccggggtccaggtgatt

SEQ ID NO: 680503 - DNA, 1361 bp, Homo sapiens
  misc_feature (375)..(375): n is a, c, g, or t
accgcggcgctgcgttcattggtggacaaagtgattatagttggaagatctaagctttacgaatggggtgacaaatgatcgatcaacagaccctagcaggtctagtcgaagttcatgcgcgtcattagtcaatataccgttatgcttgatcgattagatcagagattacatctggggacagtggcaatgggtatacgaccgatcgtctgaagcagcagtatgtccaggagtgtgattcatgaggattggaagacaaggagagggccacgagaggagattatactagggatagaggatgttctgctaggatagtgtcgcaagtataatgtccaatatgctatcagttgtgagtaacacattgatgtttatggcatnctgctatggagtggtaacgtaagtaaaggaaacaacgatgtgagattgccacatgggaataatgacactatcgtcatatatgatgtggacattcggtcattaggatactgcgtaagatagaattgctcgtctggaacaacacgattacataggccagtacatgggtaagcctgaaggtggtagccgataattttaaactagggagccgaacatcaatggcgatgtagccaaggcattttgaaaaatcagaagaggactctggactagagggcattcttagtccctacggcaagggcctgttactatggcacaatatgagagggggatcaatcaatagtatgacaaactttctggtacccccaaatggaacaagggctgggggcctataactatatcgtattctttacacataattcatatgtaaagacacaagataaagggaacatgagggaaagcaaggcatagaaaagatacccaaggggcataaagacctaacacagacacaatcacaaggaaaatagcgcaaggggcgaaacaacaaagaagaaaatcggggacaaaacaaaatgtaccacgggaacagcagaagcaaaaacacagcccaacgggaacaccaactcagagtggagaacgagcaacaacacaaaaaacccccaaataaacacaatacgggccacagaaaggaggagaaaaaaacaagaaaagagaagcctcaaaaacaaacactactaggcacaccagcgaaacaaaagaagagcaacgacgaaaacagcaaaaaaaacgaacacaagagacaaaaaagcaaacgcaatgtcaaccaacgcagcacgcgccacaaacgagaaggcaacacaaaaaaggttagacgaaccagccacaagcgcgcataaaataaaccacgaaaacaaagacacagagaacaaaaagaaaaacaaaagaaaaaagccaagagccgccccacaaaaccacctcccggagaagaaaaa

SEQ ID NO: 680504 - DNA, 235 bp, Homo sapiens
ggtttgggtgctctgaggatcccccgtatatgtaccaagacaacctggcacataatgaaaccctatctctactaaaaaaaatacaaaaaattagctgggagcagtggaacacagcaatctcagctactcatgagggtgaggcaggagaatcacttgaacctgggaggcagaggtggcagtgagccaaggtcacgaactgcactccagcctgggcaacagagcgggacttcatctc

SEQ ID NO: 680505 - DNA, 747 bp, Homo sapiens
attcaatgaacatttgatgagttgatgcttctgttttagctatgatcttctgggttgtttgtttgtttgtttttacacagaatgttgtccaggcttgagtgcagtggcacaacctcggctcactgcaacctcttcgtcccgagttcaggagaatcgctttaaccctagacgcagaggttgcagtgagccaacatcatgctactgcactccagcctgggcgacagagtgagactctgtctcaaaaaaaaaaaaaaatttatgaaggatttcaagacaaggtcagaagaccatcaaactaaggatgggacccatgtgactgcacaggtcatatgctcatgaagctggccaggatggcaagtccaggacaccaagccaggctctttccggggcaccgtgcacctcttccctggctcaagggtccatctgcgggccagttccggggatttctctgacccgccactccacacaggctgggacgtccaggcggtcttcagagaggtccactagatatcaggggacgctgcccagtactttcccatcaaagaccaggaccacagaacacttccagaaaacgcttccagaaatgctcaatccgtgccagcatggaagatggcctgctattttccagtgaagaccactggtctggaagaaatgtggcgggtgtctacctaggggaatgtcccagtgcgcagatgagatctgactgatcacttcacacattttagaccaaagttacggcttgttgtg

SEQ ID NO: 680506 - DNA, 719 bp, Homo sapiens
  misc_feature (136)..(136): n is a, c, g, or t
  misc_feature (200)..(200): n is a, c, g, or t
  misc_feature (204)..(205): n is a, c, g, or t
  misc_feature (208)..(209): n is a, c, g, or t
  misc_feature (213)..(213): n is a, c, g, or t
  misc_feature (215)..(215): n is a, c, g, or t
  misc_feature (253)..(253): n is a, c, g, or t
  misc_feature (257)..(258): n is a, c, g, or t
  misc_feature (264)..(265): n is a, c, g, or t
  misc_feature (281)..(281): n is a, c, g, or t
  misc_feature (309)..(310): n is a, c, g, or t
  misc_feature (348)..(349): n is a, c, g, or t
  misc_feature (360)..(360): n is a, c, g, or t
  misc_feature (363)..(363): n is a, c, g, or t
  misc_feature (376)..(376): n is a, c, g, or t
taggctaggtacgagccgggtgttagcgagtagtctagttagatcggcctgtaatctccttttgcgcgacacggtctcagctgttccgcctgaggcgagtgacgctggccgccaacgaggtatacgtactgggacnctcgccctcagtctcgtctccggcgcggctacctgccccgttttccctgtgagttgacctgctncggnncgnnggcngncaatggcaggggccgctccgaccacggccttcgggcangcgnngatcgnncccgccgggctcaggnaagaccacgtactgcctgggcatgagtnnagtacctgcgcgcgctgggccggcgcgtggcggtggtnnaacctggaccnggncaacgaggggctngccgtacgagtgtgccgtaggacgtagggcgagctaggtaggggctagggcgaacgtagataggacgcgctagcgcctaggggcccaacggcggcctagctctactgcataggagtacctaggaaaggccaacctaggactaggctagcagtagcccatgctacgaccccctaccgcggacactaactatcctactatcgactagcccagtgccaggtaggagctctagcacgcatacacggcgccttgcgcagcatcttctcccaaactggcgcagtgggacctacaggctagactgccgtaccacctacgtggatactcactacttgcacagaccctgcca

SEQ ID NO: 680507 - DNA, 360 bp, Homo sapiens
tgctttgttttgttttgttttgagacggagtctccagcccaggctggagtgcagtggcgcgatctcagctcactgcaagctctgcctcccaggttcacgccattctcctgcctcagcctcccgagcagctgggactacaggcgcccgccaccatgcccgggctaattttttttgtatttttagtagagacggggtttcaccgtgttagccaggatggtttcgatctcctgacctcgtgatccgcctggctcggcctcccaaagtgttgtgcatgtattatttgattgtgttccaaaagtttattcttctgaattccgtatccttattttccaccaccaaaagtcatcaattcaacatgta

SEQ ID NO: 680508 - DNA, 749 bp, Homo sapiens
  misc_feature (320)..(320): n is a, c, g, or t
ccttatgcccccgttatttaggtttcaaagaaacgatcctgtgtcaaaccccctacttcgtacacatctaatgtttatacacccactatgtaaaactctccccccccaacaaaattttctaatcgacatttttttccccccatgctcggaattacgtgccttgtggacgtctaaccaccccccttggtaaccagttcgctgctaattaacagcatctcccccccctcttttccttagtaacccaacttgtcgcccgtgcatcattaaccattgtggagaggtggaagtcgcctctggagacaccattcttgtgtgcaccncggtataacctcttgagtcagtccggtcctcacaccccccgctcgattaaactctggacttagggagtagcggtataactatcgagtgagacgtagtctcgaggagcacaagcccccgacaagttctgtgtttctcgccgagggcctacatctgcgtgattccactgcaatactactagacaaaactttaatcaccaagccccgtcttggaatctccagcactacattgcggtgcccacatttctctagcaacctctccctctgattgttccccatacatttgcaccacctcgtcctcaaaattaattcataccatcttagtccctccgcttgttcccacacctcctcaacagattgtacgcacgacaaacatcaaaaaaactgatcatcttgcacgtcaccctttttacgcgactacaccacaaaaca

SEQ ID NO: 680509 - DNA, 493 bp, Homo sapiens
  misc_feature (3)..(3): n is a, c, g, or t
  misc_feature (14)..(14): n is a, c, g, or t
  misc_feature (276)..(276): n is a, c, g, or t
  misc_feature (294)..(294): n is a, c, g, or t
  misc_feature (298)..(299): n is a, c, g, or t
  misc_feature (433)..(433): n is a, c, g, or t
  misc_feature (454)..(454): n is a, c, g, or t
agntcggcacaggntgtaatcatcccatcggcctttctggtcttcttcaatctgtatattatcaggaaaagccagtcatttatgttgtaaaatttttttgaagtagtgatgttctctctgctgaacaggtttcaaccaattcttctttatcgttttcaagacagcagtgtctcaaaattggcctaaacaccagaaggattcattactgatcaagtagccgacagaagtatgtccgaacaagagcataccatgtggtggggatgagatggagcaganccacgtgcaggttttttntttnnttttgttctaacaaggtagtcatatggcacctctcaccagggagatgcaataatttgattcaaaaggaactcagacatgaatcacaataaagaagtaaacatgctgaattggaacagaaaatggcatgttgtcnacagagagtggtgcaggggancctctccaggagaggagaaaagagcagaaagggcaagtt

SEQ ID NO: 680510 - DNA, 285 bp, Homo sapiens
ataagtgtattgtattatggctcgaaagactcagtaatagccaaatcggcaatgacactaaagaaatcctctgtgcttaacaatatgcaaatatattacttaccaagagttgccctggtgatgacgatcaagagttcatgttaactatcttttctggaaacttccttttctaagttattgtattcttgaagagcctgggccatgaagagcttgccttagttttgggcagtgaactccttgatgttctggcagtaagtgtttatcttgcctgcaatgagcagcgag

SEQ ID NO: 680511 - DNA, 153 bp, Homo sapiens
ctcccaagaatgaggaacttgagatatacaaggtctaaaacttacagattacttataaattgcaaaatgggaaagttatactttacaatgatagacagagtgacatacaccgacgttaacacgagtgatccaattactacatcctatgggacg

SEQ ID NO: 680512 - DNA, 444 bp, Homo sapiens
  misc_feature (53)..(53): n is a, c, g, or t
  misc_feature (128)..(128): n is a, c, g, or t
  misc_feature (133)..(133): n is a, c, g, or t
tgggatgcagataccgaagttgcttttccaactttcgcctccgctaggattcnagaaagaattcttgtgacttcctgggcagccattgaattcattttccatgagaagatgacagagttagcctgtgntatanggagatcatgtcatccagacctttttgcccatcacattaactttcctggaatattgtgctgcacaggtagacctgaatctgcccaagcttgttgacagctcttgtgtatactgtgttgaagccagacagaaaagtaatggggccacttctgaaacctctcagctgtttgatctcacagcagctaaagggttgtgccaaacattttatttaaagaaaagtaaagcccagattttgaatggggggttttccctaaggccttatagtatagaggcatttgtaatatggagaaaataatttttctcatttaatta

SEQ ID NO: 680513 - DNA, 152 bp, Homo sapiens
gtacgcatcatcctttcttcatcaccaaagtagctatgcccacaggtactaacttctggaatactacactgcagtacttagatacctgtatgaaagtaaactagaatagctacatatttcctgaagcccctagtaggtgtacggggatcctc

SEQ ID NO: 680514 - DNA, 102 bp, Homo sapiens
  misc_feature (21)..(21): n is a, c, g, or t
tgtcatgcagttacggaagtngtaagccttcccatttgtgtagtctgggcaggttaggatttccggggtggcttgaaggtggggcggagcttgggagggact

SEQ ID NO: 680515 - DNA, 112 bp, Homo sapiens
cacgaggcctgatacatctcttaatgttattccccatgcatcaagcaattcttcatcgattccaccacatttagaagccagtccaatactggatactgctcttgtcttcaga

SEQ ID NO: 680516 - DNA, 110 bp, Homo sapiens
agcaccacagcctggccttccgagttggcatgtttgccctggagcacagagaacgtaaagattacactggccatccatgagaggcaacatcaggccgattgtcacagcag

SEQ ID NO: 680517 - DNA, 673 bp, Homo sapiens
tgcgtgcgccgcttgcggatggcttgagcgccgacgcgctggagcggctgctgcggcagccgtgggcggccttcgtggtggcggtgcgggcgggcggtgcagccgcggcccggacgcgtgtgctggccgcctcgccgctgcgcctgtgtcgcgcgcaccagggctccaaagccggggctgcgtgaggctctggcgcagtccacctctgcaggttctggtctacgggcctgaagtttcctgagagccggagaactgtaggacaagtacagtttgacaagcgaacacaagctgagtgtgctgagaactcatggcgttgaccacctgagctatagtgagctatgccaactcttgtacagaacgaccctggctttggccagaaatttgccaacattacaacgaaaggagatggaccccacggtctttgtgcctttcaaaaggcagtgcatcagggctccatatctgcagtactataacagggggaatgcaaggtttggcaatagcctgtaagagatcccattgatttcgctaatctgagaatctggaaaacattggagaagtagggtatacagctcagaacctggtgagaaggctgacgtaccattatagaaatgacatgacgatcagaataagaggctgccccagaagggcaccctatggccagggatctaagagg

SEQ ID NO: 680518 - DNA, 109 bp, Homo sapiens
ccgggtggtgcccaaaaactgggctgggtcacagtttcaacacatacagcaccaggtcatggtcagcagctgtcagcgcctgtggaaggactgattgaggtggccctgt

SEQ ID NO: 680519 - DNA, 216 bp, Homo sapiens
agggcctggggccgtttggctgccctaactttggtagctcagtgtgcatctaaagtgggcctggggaaggaactaaacttgggctgggctgcttggggcttggcataaggtggaaaaggctaccctggggctctgacccccctgtagtatgtgtggagggggcccccccgtttcccccaacttttgctataacaataaactgtaaaggaattttga

SEQ ID NO: 680520 - DNA, 1254 bp, Homo sapiens
agcggggccaaggcccgggcattttgctgcgtcaccagccgccgccggctcaccaccctcgtttgacgcacgcacgttcattctcctgtgctctgcgccacttttcctacacatttcctcttctccccgactggaggagccagtctttcctgtgctggtgcattcttggggcccgaggtcagaagccctgcctgatgacacgcgttcggccctgagaggaaagccggagaaggagggccgggaccggaggagaaaaaaagcgtgaggtcagcgcaccctggaagaacgaaaagtcgaacataccccttaagcaaggacaaggcactggtccggccccaggaaagaagtggcgcccggcggcccagcgacaagatagacagcgcgactggtagcaccccacattggtgcacccaggtgtccaacacaaattgacaaaggccttgagatgtccttggcacaacacgtggagtcacacgactccgaacagcggggaacactaactggtgctttcacactttggacactttaattggtggatgtggaaagaaaccatggtgataggggaatggttgtaaacgtgtgttaacagtttattggagaaaaaagtaatcaaagaagctttatgcatttacagagtttggttcttcagggagggaaacggttgagtaaatatatgtaaacgcccagattttacaattgcaacactttgtgataccattttttacaacttggtcaattggtaatccccaacgaaatgacatctgccccaaaggccaatttcacacacgcaaaaccaggggagcagagcaggtccacaactgtgcaacatgcggatcctgccgtgcaacccgaacacaacagccgcaggaccactcctttgcggcccaagagccaatggggccccaaccagggggtataaaccaaagcagaaggcaaaacaagggaggccaacacagaacatgcattcgtcaaacaaaacacaattgcgggattgggcatgtcaaatcgacgaacgactttgattccgaccatcgtcaaccccacgagcaacactgacgacagttggtgcagcccagacacatgcaactggccagtatcgacacaaacgtcaacaagcctggaatgtgcatgggacgaccaccaccgtggcacccaggcaatacttcgggacagctaaaagagacaccaacagtgtggagcaaatccacgaccctgtggcgattatatgtcagacacaatgaccacgacacatac

SEQ ID NO: 680521 - DNA, 937 bp, Homo sapiens
  misc_feature (744)..(744): n is a, c, g, or t
tggttccagaaaagatttttggtttggttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaatattaccccacacacacaaagagtgttgaggacttgatcgcttaaaaaaaatattgttttaacaaccctgacttcctgtatttatgatagatatgaccattttgggtgtgagtagatggtggcttgggaaatgacctgaagcagtatggtagatttaacagggaaaacaaaaaaccttttgggtggtactttcaggtttttcgtggtttgtgcccagctgacagtccctccttttggatgtggtctggtccttccctatgcagatgatagttggcaccccgtggatacgcttaaagtttttctccctttgtcctttattcccatttcctctttctggtcctttaattcccattttcttttttctttctcccacttccggttcttattttgtctcccatgtgaggttagtgtctcattctcttagagggagcctgccgattttctttatttcaccctacagacaggaactttcgggggcttcaggggctatagggactcctcccgattatttttggcgtgcggagccttgatccttcttaacgggcttatatttttgtacccgggttctgttagcngcgggcattattttggagtatgacgctcttggggtttgtgcttgtgacccctgttttctcctgtgtgggtaggccacagtctctttggtcttcccaggattggtccattggatatgggtgggctgtcttttcaacgctgctcgctggtggtggttgtctcccccgaagatgtttttctacttttgttgtgtgt

SEQ ID NO: 680522 - DNA, 1171 bp, Homo sapiens
ggcgcagagaaggcgggccccgtctgagtgtctggcagtcagagacatgcctggtgctgcccacggcccgagctgcccacggcagcaccatgccctgcactcctggagcgccccaagctttccaactgccatggccagtggcgctgcacctgtgcacaattatcgattgtgagcgtgggagctgcaatgctggcagtgagcgcaacgacagacggtggataacgcattgatggcacaccagacagcttgacacgcgaacgcaacaggagcagaagcgacagccaccacgcgcagcatcgacagagcagacattgtcatttacgcatgtgcacgaccaacgggaaccccacactttcctgcacacgtctggcagcggacgcacacgcctatctctgcgcctcgtagcactgaaacgcacgaaagtccaccatgcatatattcccctgccacgcctcaacaggcaacctcgtcgttaccacgtgcacgcgcaccgacaactcacccgtcgacggtcctcaaacacgcggccgccacgagcctggacctcttgcagcccacccgccgtttggtacactttccacgatccttggccgtttatcccgccatgctaggtcactgcaccctggaaggtcatgatagtccaacagaccacgggaaatactctcaaattcgcttcccattcaagggccaattctgccaagctgggtgaacgtccacccccgtgcggcatgcgaacagacacacactatatatgcacgccccaaggcgacatacgccgctttcagattgatgacaatcggcattggaaccactacaggtcacaacagaagcatagcactagcattgtatgagggaaccgctacacgcgacagggactggtgcacttgtaccgggcaagctctccggggaccctacgcttacgcgcgtgtgtggggcacttatcccactgaccaacggagcattggccgctcatgttacggcctacagtggtgggaacaccagcgcatacaccgacttgtaacgttggtctacacaagctgtgtcatccactgacgtgttgccatgatccgcctggagcatgcgtgtggtcaccgtttagtttgtgtgacaactcggacattcgtggtagcagcctccaagaccttccaaccttcattggtgttacgccaat

SEQ ID NO: 680523 - DNA, 392 bp, Homo sapiens
ggtgtacggacggggagtgatagcggtcgctggggtgtactacggagcggggagttaaaatgggtgcgggtgtgacataaggtcggcatgagaagcagggtgccattctgttgcatcttcacctgtctggaacctcaacaatggtctggtatctttaacaagtttagaacacagtccagtggcttcgcccaatgccagaagccattctgtcagacttctctagaggaggtagtaaaaccagcctgcagttttttattaccggaactcaccatatgatatatacagatgtgatggtgaggcatgtcacctccacagagacaggagaagacagtcacaaggagcagctctaatcccttaggatctgcatgaagcccaggatgtcggaaagggag

SEQ ID NO: 680524 - DNA, 442 bp, Homo sapiens
cccaaaatacctgcccatttgtcaggacacccagccccccagtgttatattttgcctccccggagggggggttcccgggggcactttccgaccagccccttgggtccccaggtttgaagctttcccctgggcccctaaccatcctggcccggggtgcctgtttgacccccgggcctagttggggctttccattttgtttcccccccgggtccccaatgttttcaggggggggcccccttttgggtcccctcctttgccatcacctgaagaccccccccccaaacactgaaagtcccctgggcctgccgccttggtcccccttgggggccgtgtttgactcaactcaactcctttaacggtaaaatttccggcaaaatcccaaggttgggttttgtttttaaccttggaacgcttgcaatccccataaagccttaaaagtcca

SEQ ID NO: 680525 - DNA, 1556 bp, Homo sapiens
tgtgtccctctgccgttatttccccggggattttctgtcacacacccaccccgccgggtttatattttcagagggcgcccccccccttgttgttgttgtttgtgtctattattatcatgtaaggaaaatgcggctatatttaagaggttcccacaacgatctggtgccccggacctcataaatgttgtgacgctggtgtagtttgggggagcaaaccacccccgcgaaatttgtcgatgagaaaaacgcttatatacccgcgcgtatctcccctacagaagaagcgtgagtgtgtctaataagttagtcgcaggcgttcacaacaaatatgtgggttgggtgttatacctccttccctttataagtcgtgtggcgggggccttattattaaaattgtgtggtggagcactagcagtcgtagataggggaggtccccaaccggaattataagaggaaaacaagcgttttttcttttaatcctcgtctgtacaaccaggtgggtgtccaccaccacatgttgtcactatgaagatatttttgggtgggagaagaaaacaacaaaggtgggtggttgttttaataaaaaagagttaatatttccccctgtgtatacacgcacacgacagaagacaccacaaaagcatgaggggtgttttttgggcgcgcccgccaccactgtttctcgtgctctctagtaagagtagtgtagtataagatctggttaagaacaacattatagaaaaaagctgggtgtgtatagtatatacacgagataatagaggatatacgacgccaccccatttctaacaggggaatatataatataagtgcgcggtataaaaaaggggggggcaacaactttctttaaattatgtcggcacaacacggtgtagtcgcacacttttttttcacaacaaattgggggtgttacacagcggagagagatgaatactttatgctctgcacagtatattatgtcgtctacatatatattaaaacacatttatggagaaataaagggagaatatagttaaaaatcactcccgatagagagagataatatatagagataagcgcgcatatctctccccacatataggataaatatgtgtctcacatgtctccccctctgttatattgacacaccggaaatatagagaaatagtgtgtggcctccacagaagcgccacgtatgtatccccctcgagagcacatgaagagaaggtgtgtgtggtttgtgagagaaaccacacacggcgcttgaggaattttctaatttgcgtcttctccttctctctgtgagagcccacagagaggagagggcacaccacaaaagggggtggtggtttccacaaccccccacgcacctgaaggaaagaaacggggcttttttcactttcaacccctccctctttttccctgcccccacaggagctcgggccacactttctgggtgggggcacatgggtccccagagatgggtccaccctggagagaatagtaagaaacttcccacacccaaattttttatttaaattaatatttgtgtttccaca

SEQ ID NO: 680526 - DNA, 435 bp, Homo sapiens
  misc_feature (5)..(5): n is a, c, g, or t
  misc_feature (26)..(26): n is a, c, g, or t
  misc_feature (37)..(37): n is a, c, g, or t
  misc_feature (79)..(79): n is a, c, g, or t
  misc_feature (209)..(209): n is a, c, g, or t
  misc_feature (220)..(220): n is a, c, g, or t
aaccngctgctctcgaaatcccctgncctcatgtganacttctcgcctcggccctcgcaaacgtgctgggattaacagncgtgaagccagcatcccctggcccactaatttttataatttttaagtaagaagattgggtttcgcccacgttaacccgggcctggtcctcgaaacttctgaacctcccagtgatcccacctgccctcagncctccccaaantgctgggagcccactgtccccggccctcgtctccctactttcctttgctcccaaggtaggattagaagtagaaactggagccaggagctatagtgccagctacccgggaggctgaggtgggataattacttgaacctgagaggcagaggttgcagtgagctgagattgcgccactgtgctcccagcctgagctacagagtcaaacttctgtctca

SEQ ID NO: 680527 - DNA, 640 bp, Homo sapiens
  misc_feature (17)..(17): n is a, c, g, or t
  misc_feature (85)..(85): n is a, c, g, or t
  misc_feature (110)..(110): n is a, c, g, or t
  misc_feature (127)..(127): n is a, c, g, or t
  misc_feature (138)..(138): n is a, c, g, or t
  misc_feature (149)..(149): n is a, c, g, or t
  misc_feature (156)..(156): n is a, c, g, or t
  misc_feature (169)..(170): n is a, c, g, or t
  misc_feature (172)..(172): n is a, c, g, or t
  misc_feature (223)..(223): n is a, c, g, or t
  misc_feature (335)..(335): n is a, c, g, or t
  misc_feature (350)..(350): n is a, c, g, or t
  misc_feature (504)..(504): n is a, c, g, or t
  misc_feature (538)..(538): n is a, c, g, or t
  misc_feature (542)..(542): n is a, c, g, or t
  misc_feature (569)..(569): n is a, c, g, or t
  misc_feature (629)..(629): n is a, c, g, or t
gctcgcaaaagagtgtngctcctctctgctggcaggtggtctctgttgctttcagtggagatggtactcctctctgtagctggtnaccccaccgtctccagctatcagcngagagggtactgctctntgcagctggtnatcctgtcccntcgtttntaccatctttatnntntggttattttctgcgcctgctctggctgagcccagggtttttatggacctnagcggcggaagaagctgctgctgctgcattgcgcgccattggcaggcccagaaaaggctccacgagtttccactctggttagaggcgcctggcagcccagcccccagaattnaggccctccctggcntgagggtggggccttactggcggcccccacccccttcctcctgctgccatttatggctgcaggtcttggctccgcctcccctccaagattagcgcagttgctggcgtggcgagaggccaggcagtggaagcagacacccctgcgcttgcagggntggagggtgaagggggctgtccttcctgggatgnccgntggtgcaggctacagagatgccctcgncctgtgcctgggggggcagccacagctgcacctggcgagctcccaccccgccaacttggnagaggcagggc

SEQ ID NO: 680528 - DNA, 217 bp, Homo sapiens
  misc_feature (2)..(2): n is a, c, g, or t
gntgcctgagagcaggtgaggaagaccttaccccgaagcttggcagtggcttcctcaggccatggcatgggggaggcctctgctcgctggcctagggggcagagctctcaagaggtccggtcagggttgtgattttccattctgaagtcaggaaggcccccactagtcctagcctctggtggctcctcagtgctctgtacagccctgctcacttggg

SEQ ID NO: 680529 - DNA, 932 bp, Homo sapiens
accggcggcgggacaggcttgctgttcctcctcctcggctcaccagacggggtttcactgtgtcagaccaggatggacttgatctctcgacctcgtgatccacccgcctcggctcccaaagtgctgggactacaggcgtgagccaccacaccaggcctactgtttcgattttaagaatgaagaaatttcgctctcagagactgaatccctcaagccaaggcttaacagctaacatcgtgcgcacctggacattcacagtcctacagcctacagctctcgaatacctatctgacaatgaccaagttggtaacgtctgcggctctcccaaagccaggatacatacagaacctgaggccctttcctaagcttcagatgctgctagctagcattccagaccccaaccttgcacacaacatgggttcgaccctcaccccagcgtaactggcctgatgaccgctatccatgcgcttcgcctccctactgccacaagtcattctcttcaccaaactgcatcgctcatgacactactagcacacctgacattactactagcactctgaccacgaaaggcttttctgccaactatcccacaacacctgctcgtaccattttcgccacaacagagcaccactgcccaaggcaagtatcttcgcaaccagatgaccgactacaacgtgtacgcccggcagcaggagaatcttacgcccggacagcagcattcgaaaacctcctgtccttcccttgccgtgccctccactcgcggactcctgaaccactcttaccgtccatgcccgccgccctcccagatcaaaacctacatattgcctcttatttatcaccgcctcacctctccacacactccttttacaccctattatcacactcttcccctcccatccaccctcaaccaccacttcgcccctaatcgactc

SEQ ID NO: 680530 - DNA, 346 bp, Homo sapiens
gctcgacggtcaaatgaatagttaaaaatacaaattgaggccaggcatggtggctcatgcctgtaatcccagccagcactttgggagtctgaggcaggcggatcacttgagctcaggagtttgacaccagtctgggcaacatgacaaaacactgtctctactaaaaatacaaaaattaacctggcctggtggcgtgtgcctgtggtcccagctacttgggaggctgaggtgggaggattgctggagcccccgaggcggaggttgcagtgagccgaggtcgcacctctgcattccagcctggttgacagagtgagaccccatctaaaaaaagaaaaaaaagtcgacg

SEQ ID NO: 680531 - DNA, 1886 bp, Homo sapiens
gcgtgacgcgtgggtctgacccacgcgtctgagctgggcatgatgatggccatggtagcacactgcgaggtggcagctgggtgtgcttgggatgaatgcctgtgggatgtgaatgtgcccatgcatgtgtttttaacccatgctccccatgcccatgtccttcatgaatatggactgatgatgatgtggctgtggatgaatgcaatgcccgtggagaaatgtgtgtggtgatgacacatgggctcacatgacatgatggcctgtggcttgcacctgtggatcctcaacgatgcttacgggggggtgggcccaccaaaaggtggggctggcaaacggctggatttgggcgggggaaagaacccaaaaaaaacccgggctggggacctccccaaaaaaccccaaccccccccggcttttatggccgcgactttataacgcggtcattacacgtggtgcgcgtgcgtgggcaaagtcccacacttgcatctgcccggactttatttttagctggtgagcatatgaggcagcaaaaagactacacactgctgggctggggcgctcgaacaacacctcacgaggtggcaggcgcagacacacctgttctgcgaaaacatgtgtggtggagcgaacaagaagaccagatagaggtgaggcagagactaaaaagaaaaatgcatcccgaaaatggaagatcagtgtcgctgtggggatttattcacatttagggcagacgatggacaaacacaggtagaggaagagaggaatcttgtggggtgaggggtggtgtggaaaaatataacagtcgactgcgatattttaattacctattatctggtgcaggggaaagaagacgtggtatgaggggaggtagatagattatataaaatgaacgacggacgcccacgctaatcgtccacctcccacaatcgtcgccacctctaagacaagagcactttatgaggagtcgcaaaaaaccaatcggaccggagcggagggagacgcgagcaaggatggatgtaaatattgatatataatacgacgacatcctacttagctcagtcacagataacttactgggcagagcactattagggggacatgatgggacacccaccgccgcaccagccacccaccgatgatcaacgatcttttatttccacacgacacaaacaagcatgaatactcaacacgacaacgaaccgaagcacgcacgtggaaccgaagagagtctggacggaacgctcgatcgcgtgtggcagcagaacaggagcgggcggggagggggcacggacgaaccacggaggacgacaacgcaaacacagcaccacacacgaacccccgagacacgacgggcgtcggagacggggggcagcgcaggacacgaagacaggcgcaggagcggctcgagcacgataccggcaggcaagcacgagcagacgaaacaagcacaacagcacgcgaccgcagcacagcacgagacaaccaaaagcagccgcagaggagcagacaagcgacaacaccacacacaacaacaagaccaaaacaaaaaagacagaagcagcacaacacaacgtaatccacctgagatgagtaggagggaggcgaggagggggggcggggtagcggtgaggagaaggatgcggagtcagcagactagcgactgtgaatatttagtacaggatactacgagagaggaagtaagatagaggagagagagtaggcgacagtaagagacagtagtggaggctgcgtaggcgagtcgcacggacgtggaggggtagctctgcccagcagactttttttctcccgttttttttcccaccacaacaccaacacaccaccctcagaccactacagtctgagactcgtgttttgtattcaggccg

SEQ ID NO: 680532 - DNA, 363 bp, Homo sapiens
gaaggggcaggtggctcgctcatcatatggcacaggatgctctcacggggtccaggaccagtgtagtacatgactgagtatcctcaacccagaatcgtatctccccagaaagctatcacatacacaacgacattcaggtacacttaaatcccatttcagtttaagcctagcccctaatttttcttatgatatactatatactattcctttttcgaatatgccttataaatggatatatatattttgggttcaagtgattctcctgcctcagcctcccaagtagctgggactacaggcagatgtcaccacgcctagctaatactcgtatacacagtaaagatgaggtttcaccatgttggccag

SEQ ID NO: 680533 - DNA, 3547 bp, Homo sapiens
gctttcttttctccagaggagccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcagaggattcagggagccagggtcctggtgtcaggcctgcagggcctgggggccgaggtggccaagaacttggttctgatgggtgtgggcagcctcactctgcatgatccccaccccacctgctggtccgacctggctgcccagtttctcctctcagagcaggacttggaaaggagcagagccgaggcctctcaagagctcttggctcagctcaacagagctgtccaggtcgtcgtgcacacgggtgacatcactgaggacctgctgttggacttccaggtggtggtgctgactgctgcaaagctggaggagcagctgaaggtgggcaccttgtgtcataagcatggagtttgctttctggcggctgacacccggggcctcgtggggcagttgttctgtgactttggtgaggacttcactgtgcaggaccccacagaggcagaacccctgacagctgccatccagcacatctcccagggctcccctggcattctcactctgaggaaaggggccaatacccactacttccgtgatggagacttggtgactttctcgggaattgagggaatggttgagctcaacgactgtgatccccggtctatccacgtgcgggaggatgggtccctggagattggagacacaacaactttctctcggtacttgcgtggtggggctatcactgaagtcaagagacccaagactgtgagacataagtccctggacacagccctgctccagccccatgtggtggcccagagctcccaggaagttcaccatgcccactgcctgcatcaggccttctgtgcactgcacaagttccagcacctccatggccggccaccccagccctgggatcctgttgatgcagagactgtggtgggcctggcccgggacctggaaccactgaagcggacagaggaagagccactggaagagccactggatgaggccctagtgcggacagtcgccctaagcagtgcaggtgtcttgagccctatggtggccatgctgggtgcagtagctgcccaggaagtgctgaaggcaatctccaggaagttcatgcctctggaccagtggctttactttgatgccctcgattgtcttccggaagatggggagctccttcccagtcctgaggactgtgccctgagaggcagccgctatgatgggcaaattgcagtgtttggggctggttttcaggagaaactgagacgccagcactacctcctggtgggcgctggtgccattggttgtgagctgctcaaagtctttgccctagtgggactgggggccgggaacagcgggggcttgactgttgttgacatggaccacatagagcgctccaatctcagccgtcagttcctcttcaggtcccaggacgttggtagacccaaggcagaggtggctgcagcagctgcccggggcctgaacccagacttacaggtgatcccgctcacctacccactggatcccaccacagagcacatctatggggataactttttctcccgtgtggatggtgtggctgctgccctggacagtttccaggcccggcgctatgtggctgctcgttgcacccactatctgaagccactgctggaggcaggcacatcgggcacctggggcagtgctacagtattcatgccacatgtgactgaggcctacagagcccctgcctcagctgcagcttctgaggatgccccctaccctgtctgtaccgtgcggtacttccctagcacagccgagcacaccctgcagtgggcccggcatgagtttgaagaactcttccgactgtctgcagagaccatcaaccaccaccaacaggcacacacttccctggcagacatggatgagccacagacactcaccttactgaagccagtgcttggggtcctgagagtgcgtccacagaactggcaagactgtgtggcgtgggctcttggccactggaaactctgctttcattatggcatcaaacagctgctgaggcacttcccacctaataaagtgcttgaggatggaactcccttctggtcaggtcccaaacagtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccaacagatggcccccatctttgctagtaatctagagctggcttcggcttctgctgagtttggccctgagcagcagaaggaactgaacaaagccctggaagtctggagtgtgggccctcccctgaagcctctgatgtttgagaaggatgatgacagcaacttccatgtggactttgtggtagcggcagctagcctgagatgtcagaactacgggattccaccggtcaaccgtgcccagagcaagcgaattgtgggccagattatcccagccattgccaccactacagcagctgtggcaggcctgttgggcctggagctgtataaggtggtgagtgggccacggcctcgtagtgcctttcgccacagctacctacatctggctgaaaactacctcatccgctatatgccttttgccccagccatccagacgttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgtccccagcccttggagtttgacaccaaccaagacacacacctcctctacgtactggcagctgccaacctgtatgcccagatgcatgggctgcctggctcacaggactggactgcactcagggagctgctgaagctgctgccacagcctgacccccgaggtggccaagaacttggttctgatgggtgtgggcagcctcactctgcatgatccccaccccacctgctggtccgacctggctgcccagtttctcctctcagagcaggacttggaaaggagcagagccgaggcctcccaagagctcttggctcagctcaacagagctgtccaggtcgtcgtgcacacgggtgacatcactgaggacctgctgttgg

SEQ ID NO: 680534 - DNA, 759 bp, Homo sapiens
agctttatcagaggctgcaggggccctgctctgggtttcctcaggaagcaccaccccctcatcccccactctcacaactggcccatgtgatggatcgtctgtttccctgtgcgggccccatagccccatttcctgtgctggccccggcctggacggggagggggctgagactctgggcccagatcccacctcccccccaccccccaccccctggctcctgtttcctgctagtccagctcttcccctaggaaaggctgctggtaactgggatgggggttggggggaggtaagaagtctctgactcctcctctacctcatcccagttccatcacctgaagtggacctcttgggaccgtctgaaggtaccagctgggcagcctgagaggaccctggagtcgctgctggctcatcttcaggagcagcacgggttgagggtgaggatcctgctgcacggctcagccctgctctatgcggccggatggtcacctgaaaagcaggcccagcacctgcccctcagggtgacagaactggttcagcagctgacaggccaggcacctgctcctgggcagcgggtgttggtgctagagctgagctgtgagggtgacgacgaggacactgccttcccacctctgcactatgagctgtgacaaggcagccaccctgtcacctagctcaatggagccccggatcccaagccctgcattgtaagcccacagtaggcactcaataaatgcttgttaaaggaaggcaaaaaaaaaa

SEQ ID NO: 680535 - DNA, 419 bp, Homo sapiens
  misc_feature (148)..(149): n is a, c, g, or t
acagagtctcgctctctcgccaggctggaatgcagtggcgcaatctgcaaaccttccaccttccggattcaagggattctcctgcctcagcctcctgagtagcctggcttttgccttctttttgaaagtacgtatgaggccgggtgcnngtgtcacgcctgtaatcccagcaccttgggaggccaaggtgggcagatcacctgagttcagaagttcaagaccagcctggccaacgtgttgaaaccacatctcttctaggagtacaaaaattagccgggcatggtggcgcatgcctgtagtcccagctgctcgggaggctaaggcaggagaatcacttgaacccaggaggtggaggttgcagtgagcggagattgcgccactgtactccagcctgggtgagagagtgagacgccacctca

SEQ ID NO: 680536 - DNA, 185 bp, Homo sapiens
gggagtacggaatatgttgtagctttgaaggtccactcttggtttttcttcattccttgcaattaaagctgattccattatggaagcatcaatctgtggacaatagcttcttttttttttttcccaaagcagaaaatccagattctgtcgttcaaattcccacgggaaaagtggtggccctcaaa

SEQ ID NO: 680537 - DNA, 131 bp, Homo sapiens
ctgagacttttcctgtacaagaacttctgaatttagaacagtcttttcttgtttaactttatttacttcttcaattacattctacgagatttgctcttgagattttccagactcaatggactacaatcttc

SEQ ID NO: 680538 - DNA, 198 bp, Homo sapiens
taggatgcgaggtgatctagaggatcccacggggaaacaatcacttagcggggacatcacttagcggggaacaatcacttagcggggaacaatcactttggctaggcaacctagcaaaagtgaacaaataggattacatgaagtgaaaaagcttatgtacagcaaaggaaacaatcaacaaagtgatggttccccgcg

SEQ ID NO: 680539 - DNA, 99 bp, Homo sapiens
ctccattaacgttctctgaatctctctgtcagctgaagtaccctcagaaaaccgacgaccaccaatagcatctatttcatccataaacatgatgcatgg

SEQ ID NO: 680540 - DNA, 127 bp, Homo sapiens
cagactttgtagaatcggggttcctctttctctctgccaggccccatcagagtcacagcttttggaggggttcacagatcctggcagcagctccagtcaagatgtcactggttggcatgatattctt

SEQ ID NO: 680541 - DNA, 320 bp, Homo sapiens
  misc_feature (82)..(82): n is a, c, g, or t
  misc_feature (114)..(114): n is a, c, g, or t
  misc_feature (120)..(120): n is a, c, g, or t
  misc_feature (123)..(123): n is a, c, g, or t
  misc_feature (129)..(129): n is a, c, g, or t
  misc_feature (136)..(136): n is a, c, g, or t
  misc_feature (144)..(144): n is a, c, g, or t
  misc_feature (149)..(149): n is a, c, g, or t
  misc_feature (154)..(154): n is a, c, g, or t
  misc_feature (164)..(164): n is a, c, g, or t
  misc_feature (167)..(167): n is a, c, g, or t
  misc_feature (189)..(189): n is a, c, g, or t
  misc_feature (193)..(193): n is a, c, g, or t
  misc_feature (258)..(258): n is a, c, g, or t
  misc_feature (274)..(274): n is a, c, g, or t
  misc_feature (307)..(307): n is a, c, g, or t
  misc_feature (310)..(310): n is a, c, g, or t
  misc_feature (313)..(313): n is a, c, g, or t
ttttgattccttttggggtgaagcagaccaagttccccccaggccccccagttgtgggggagcctgtattttttttaaaaanatccccatccccctggtcctcccccttcccanggtgcnaanttttanccccaanagtgactntgggnttgtntgtttagttntgngtataaatggaatgttgtgganatgncccccccctgtgccgggtggttcctttcccttttcccctggtcccggctactcatggaagcaggnccagtaagggcccttngattaaaaaaaaaaaagacaataataaaaaggntcnttnatgggga

SEQ ID NO: 680542 - DNA, 295 bp, Homo sapiens
gaactcaaggtacactatttccatgagctgctccttaaaaaaaggcaacaggagcaaaggcttcatgtaatatagcccctcgaacaagttccctgtattaacgcatcggggctctgagaagacactgctctacagagatctggatagttgagcttagcacatttccctatcagtgagccgcagaaatacctcttcacgttccagagagtgggggttccaagcaactaacataccttctaggcttccacttgaaatctagcgagagcgctgtaggcgcgaagcggagatgactcta

SEQ ID NO: 680543 - DNA, 969 bp, Homo sapiens
gcgcgatatgctgcggtacctgtcagacggcagactacgccatccgtcgagtgagatcgtcgctgaaccgtggccatccatggtccgagaagtactgacctgtgagactacaagctggtatcgtgtgacaccactcctcaatcgctcatcaggcattgcgtggacgaacatacgtgagatgaggaaggttgtggtatgcgatgatgcgtactagaatcagtcactcaaacgtggatgaacgatctgagggtcatatgtccctggccaaaggaccgctcatttgagcgcgacttccgatggcccactgtcctgatcgacgaatgaacatggttgagaggttgggctggcgtactctctcttgaggcgagtcctgggtaggcctgcctttgctggggactccccgcgacgtccagtccacccacatgtgcaggttcatcccctgcgtccggcttccgagtttccgaatctcgtgtcccgtccgttgcgcgcgaccgccggtgtggcgcgtgcgtcgtcttgtcaccaccctttacaagtgcaccgttttcgaattcacagcacctgcttgtgcgcctcgaatgggacccggaggcgacgcaggcgcatctcacgcggcacgggtcgctggcgtggcccggaggcgtccacgagcctgtcgtcaaattgcttgaacgcttggaggtctgcggagcctaagcgtaggccgatggtagggtaccgtgcaaaccctcagtggttcaggtggcaccatgacaaccgaacgatcccgtgggacccagctgggttgcaatggagaagaggaagaattgccacggcaccccttttgcccccggaaagccggctgacggctctgatcccaagtccccttggcaccaaattgcttggaaaaccggcaaaggtgaaacgggggccacgcgtgggccagagccagagcgccccctggaacgaaatggcctgggaaggggaacc

SEQ ID NO: 680544 - DNA, 255 bp, Homo sapiens
tggagagcatactcactgccaccacccgcaggaagctttcccacagctatggagcagtgcgctacgctcatgcatgtcccagggaacgcccgcgcagatgagcttcttgtgagctcagaggccttcgtgctgctagacggacatgagctgacgcgtcgttggacccaaggcagcccatgtcctgagaaaacccatcttcggccgctacaaaccagacaccttggctgtagccgttgaaaacggaactggcaccga

SEQ ID NO: 680545 - DNA, 901 bp, Homo sapiens
  misc_feature (27)..(27): n is a, c, g, or t
  misc_feature (261)..(261): n is a, c, g, or t
  misc_feature (351)..(351): n is a, c, g, or t
  misc_feature (396)..(396): n is a, c, g, or t
  misc_feature (436)..(436): n is a, c, g, or t
  misc_feature (438)..(438): n is a, c, g, or t
  misc_feature (456)..(456): n is a, c, g, or t
  misc_feature (527)..(527): n is a, c, g, or t
  misc_feature (574)..(574): n is a, c, g, or t
  misc_feature (754)..(754): n is a, c, g, or t
cctggccctctccctgaatggagtagngctcctgcacctcaacaatgtcagcactggctgcatcctgctgggcggactcttaatctacgatgcctgctgggagtgtggcaccaatgtgatggtgacagtggccaagtccttcgaggcaccaataaaattggtgtttcccccaggatctgctggagaaaggcctcgaagcaaacaactttgccatgctgggacttggagatgtcgtcattccagggatcttcattgcctggnctctgcgctttgacatcagcttgaagaagaatacccacacctacttctacaccagctttgcagcctacatcttcggcctgggccttaccntcttcatcatgcacatcttcaagcatgctcagcctgccctcctantacctggtccccgcctgcatcggttttcctgtcctggtgncnctggccaagggagaagtnacagagatgttcagttatgaggagtcaaatcctaaggatccagcggcagtgacagaatccaaagagggaanagaggcatcagcatcgaaggggctggagaagaaagagaaatgatgcngctggtgcccgagcctctcagggccagaccagacagatcgggggctgggcccacacaggcgtgcaccggtagagggcacaggaggccaagggcagctccaggacagggcagggggcagcaggatacctccagccaggcctttgtggcctctgtttccttctcccttttttggccctcctntgctcctccccacaccctgcaggcaaaagaaacccccagcttcccccctccccgggagccaggtgggaaaagtgggtgtgatttttagattttgtattgtggactgattttgcctcccattaaaaactcatcccatggcaaaaaaaa

SEQ ID NO: 680546 - DNA, 1104 bp, Homo sapiens
  misc_feature (27)..(27): n is a, c, g, or t
  misc_feature (261)..(261): n is a, c, g, or t
  misc_feature (351)..(351): n is a, c, g, or t
  misc_feature (396)..(396): n is a, c, g, or t
  misc_feature (436)..(436): n is a, c, g, or t
  misc_feature (438)..(438): n is a, c, g, or t
  misc_feature (456)..(456): n is a, c, g, or t
  misc_feature (730)..(730): n is a, c, g, or t
  misc_feature (777)..(777): n is a, c, g, or t
  misc_feature (957)..(957): n is a, c, g, or t
cctggccctctccctgaatggagtagngctcctgcacctcaacaatgtcagcactggctgcatcctgctgggcggactcttaatctacgatgcctgctgggagtgtggcaccaatgtgatggtgacagtggccaagtccttcgaggcaccaataaaattggtgtttcccccaggatctgctggagaaaggcctcgaagcaaacaactttgccatgctgggacttggagatgtcgtcattccagggatcttcattgcctggnctctgcgctttgacatcagcttgaagaagaatacccacacctacttctacaccagctttgcagcctacatcttcggcctgggccttaccntcttcatcatgcacatcttcaagcatgctcagcctgccctcctantacctggtccccgcctgcatcggttttcctgtcctggtgncnctggccaagggagaagtnacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccccactgccccggggcccaagttatgaggagtcaaatcctaaggatccagcggcagtgacagaatccaaagagggaanagaggcatcagcatcgaaggggctggagaagaaagagaaatgatgcngctggtgcccgagcctctcagggccagaccagacagatcgggggctgggcccacacaggcgtgcaccggtagagggcacaggaggccaagggcagctccaggacagggcagggggcagcaggatacctccagccaggcctttgtggcctctgtttccttctcccttttttggccctcctntgctcctccccacaccctgcaggcaaaagaaacccccagcttcccccctccccgggagccaggtgggaaaagtgggtgtgatttttagattttgtattgtggactgattttgcctcccattaaaaactcatcccatggcaaaaaaaa

SEQ ID NO: 680547 - DNA, 771 bp, Homo sapiens
aggaccgtacacccggttctaccgacgaagcggctgggtggcagaccttcggaccgcggggctgttcatcccctcgccctccccgcggaccttgcccttttctccctccctgccccctctcacgtcaccctccgggccttctgcccctgctcgcttggttttccttgacgtcgcctgctgctgtcgtcggacggcccactgcctggacgggctgacttttcgacgacgccgacctgacgacggttcaccgacccccttccccaccactacgggtgctgacttacaacttccacccacgacggaccgacccggacgacgtcttcggcacgacactgacacctgactgacaccgcttctgcggttacgactctgtagcctttggactgcacccaccgtactgtagacttacgtcccggacttaccttacgtaccacggacctaccttttcacacggttcacttccccacacacgtacttcgggttttccgcccgttcaccccgtaccacaacgcttttacttaaccctttgacgcttgtactcacctgggcgactaccctgtattagctcggaccacacctcttacctataccttgttggacacaccccgctgctggccccacacgaacggaccccacttttcaacgacggcaacccaccccttttgggacacaccacttttccacccccaccttatggcgacggacccgctttttaccagacctccacgggacccacacggcacccgaccccgacctgcttttcaccccacc

SEQ ID NO: 680548 - DNA, 281 bp, Homo sapiens
caggatccttactcgagtccgctgatccagcaagggcactcgaatggtgtcactcagggtgtaccagagaaaatgaagactgactcccagcaccttcattcataacagcccaacactaggaactacccaaatgtcctgtaatggtgaatggttaaagaacctatgggacatccataccatggaatacgatccagccataaaatggaacaaaccttcactcaggcaacaacttggaagaacctcaaggaaattatgctgagtgaaaaaaaaaaaaggccagt

SEQ ID NO: 680549 - DNA, 494 bp, Homo sapiens
agcaggagcagctagtggtggcagcagccacagagaggagggagccaccaaaggcggatggatcaccaggaaggaccgttgacctcttcagcacgtggggaaggtgtaatccgtctccccagacaagggcccggctccgttggtccccgttgatgatagaatggggtactgatgcaacagttgggtagccaatctgcagacagacactggcaacattgcggacacccctcccaggaagcgagaatgcagagtttcctctgtgatatcaagcacttcaagggttgtagatgctgccattgtcgaacacctgctggatgacccgccccaaggagacagggggagatgttgagcatgttcagcagcgtggcttcgctggctcccactattgtctcccagtcttgatcagctgcacatcactcaggatttaaatggtgcccctggggattttagtggtgatacctaaagcctgcaaaaaggaggcttctcgggcccga

SEQ ID NO: 680550 - DNA, 865 bp, Homo sapiens
cgtgagcattggccacaggtgcagccatatgtcgaacttgattgcaatgccttcttcgaagacatcatggatcggctccgtcgaacccccactttaaacatccagcagctcatggagctggtgagacgctgtgactgtgcatgagaaacccagttcatggtgtaggagcctgctgttgcgcagcctctgtctagatgggggcactccgtgtggggtctgtgctctgggtgcctgagacttggactggtgcccatatcgacatgagaagatcgacgcataaagacacgagggtttggagtctcctcaacagtgctataagaggaagtgacctcacagaccagctcagagatgttaccaagaatatcacagcccccagaggtacgggatgacaagcagcatgtcttgttctgtctcagctcctgtcaaggatctgcggggtgggccctctgctatagctgctctctgtcactggccccttggagtgggagcagcgtccttagtcactgcaggcccaggcgggcaggtggtcccaggacagaggtggggaagttgtcctgaggaagcagaagctaggctgtgctcccgcccgaacccaagggcctccagtggaccagcattcaagatgtgagtgcccgtggtgtgtaaggcactcccatggcaccagtatttattgactgatctgatgaaggcttacctgaccctgcccaggaagagttcactggtcgctctgttgtgccccacagcactttgttatacctctgccacacacttacgcagcgcgttgtaactcatgtgtttacatgtctggtccccccagactgtgagctccttgagggcaggataactacattgtccagctctgtgt

SEQ ID NO: 680551 - DNA, 87 bp, Homo sapiens
aagacagcagcatatatctctgcagctccacctacccccttcatccggatacgcagtattttggcccaggcacccggctgacagtgc

SEQ ID NO: 680552 - DNA, 426 bp, Homo sapiens
tccgtgtgttatcacccaatgcatcaactgacaccaccgcgtacgcgaccagccgctcccacatttttgatcggcgtatcccctgatcaggcgtgttgtttgcggtactcacccggcgcaatgccgaaccgtgacttgaacgccgtcgaaaaataactcgaatccgaaaacccccacgagtaccccaacaccgaaagcttctcctccaccctggattggcgcagggattcagcacacaaatccagacgccggttcttgatgtaccgcgccaccaccaggcccttgcggccaaaggatccggtacagcccgcgcaccgacattcccacctcccgcgccacacatctcggggcacagatccttacgaagcgaaataatgctggtcaatgcactccaggcgtcttgcggaaacactcgctcatgggcgt

SEQ ID NO: 680553 - DNA, 100 bp, Homo sapiens
ctgagctcagtgatctcgattggatcttaactattttaaaaaatgcactgagttgggttaaaaacaaacaacaaaatggatttcaacacagctctaaagc

SEQ ID NO: 680554 - DNA, 126 bp, Homo sapiens
tccttctttattgatgggggttggttctaggacccagtagataaaaaaatccttaaatgttcaagtctctcatataaaatggcatattatttgcacataacccatatgtatcactcatataccacc

SEQ ID NO: 680555 - DNA, 575 bp, Homo sapiens
aactggtctattcttaatcttgaactacactggaattaacccccactgaataagatgagactgcgctgccgtgcgaaccatgtgactttgtcacagcccagaatattgagtgggttcgagacatgtaatcatgatgatggaggtttgaagacccctcattaggattgaatgaattccaaattttgtttggttgcttttgaatattggaacggccatgcacttacacttgtggcgccatgtgggtgtgtgatgatggcaacatgggcattgtgggggtggtgtgagcgggcgggggaggggggggggatggggggcgggtgcgggctgggggcgtggacaagttgtcttgatacggttcgcgcttgacacctgggcggttcacaacgttccttttatccctaccttctccgtgcggtcaggcattctgcctctttttctatctaactttttcatctagttatgccccgcattcgaaccgcttctagtctttctcatctatactattgttttacttcaccttacttattgaggtgctccgcattattgaggcccgccgcgctttttcggatagcacg

SEQ ID NO: 680556 - DNA, 859 bp, Homo sapiens
gggcagtccccgggggccgtgcgcccggcccaggctcggaggtccatgcccagcggcggctcaggctgccgcgccgtggctcccagacctcagttgtccccgattggtaagagcgattgacggtggttgcggacggcgttctgcgagagcagagccattgaggctccagacgtcgtgccgcgggtaccggcagcactcgcacctaccgccgaagggagggctgggacgctggatctcgcgaccgttgccccagaggtcgagtggaccagtgtcgagggctggtggcgtgcaagcgcaggcaaggaagcggccagcacgatggtgcatgctgatggtcctgggtgccgttcgaatcatctgtactgttgacacaagatgtttattttggaaacgtgcttcggagattgtcatcttgtgtgcacgaattgcaagaacgacgataagcggctgctgccagggacgagccgggccgaggcggatgggcgtcatcgcgttgccatggggtaagttccgcgtggggaccaggacgccctcggcgttgacggggctctcaccggggcaaggcaaacgggtacccgggcgagctctgcgctcgcccgggcgcaccactaggggcgcacggaagggggcccaacaggggtgggaggaaaccggcgccctgggggcgggggctaagcgccagaggcgtacgccgtacggacaacacgagcaaaggcgccccggttgccataggaacaaatgcccagtgcagaagcaaacgcccgtggcggcccctggggagaagcttggaccttaggcctcaatccgggccattccgaaagaggttcacaaggggacccatggaaggccaggttaccaa

SEQ ID NO: 680557 - DNA, 123 bp, Homo sapiens
caaagttccccgcgtgctgcaacagaaggcgggctcaagccgctgaccaccaacgcctggggcatggcctatggggcggcgatgctggcgacctattgcgcactacgtgttattcccttcgag

SEQ ID NO: 680558 - DNA, 268 bp, Homo sapiens
taaaatatctcatgaggaaggaaaagatgaacaggttgctaaaacatgagggaggttcagatgaagcttcttcatggagtaaaaaaggtatttaaaagaaaatggagagaaaggactacagagccccgcaattaataccaagtagaagggcaaggcttttagcattaaaatggaaggtgacttacaccagcttaaacgtttacgtttaaaacgtggtacggtgattaaacataacttggacacggcgactctctttaaacaacgacga

SEQ ID NO: 680559 - DNA, 423 bp, Homo sapiens
  misc_feature (423)..(423): n is a, c, g, or t
aatggtataatatctatggagtgtgcgctatatgcagagtgaacgtggagccccagctgccaagtgaaagttgccaccatgggtgataactctcgctcttattctcatttccatactttgtggaactgcagtcaaccaaagatggcatgatttagctgcgcagatttggatgcatatgagcttatagtgctggatatgttatatggtacaactaatgctagacatacagtttatgtatacagatgattctgatgtaaccatgaaagctggcatgactagattagacatgtttcagggtcattatactgtataatggcatggttcctgtgatggcatgtatttgcacatattatgggattgtgaccttcttggaagtaaggaatagactgtttaagcacgttccttttgcggccctattcgtcn

SEQ ID NO: 680560 - DNA, 151 bp, Homo sapiens
tcacttaaaagccagagtgcccgtcatgatttgcgggccggctcttgaaccacttctggctgccccacaattctgtactttgagtatcccagtcattgtttttcgagacaaacatttcaataattctaatttgggcacctccagggttggc

SEQ ID NO: 680561 - DNA, 689 bp, Homo sapiens
gattcgagacagaatttatgtattgaagcacagctaaaggacgctggatgcctacacaaatcaatgataggtatactgggcggtggcttcacaccaactagaaaggagaaacatgtgtagaagcgacttagatcgtaatcggacaacataatattctaatggttgagatgagatgctataaaaggtgatgtacctagcctaacgcgatttgacagagctccagaacttttgttccctcctagtcagagcaggaatgcgtatcgataacggggcagagctattatgcacaggctgttcaatgatccatataagctttccgctgatctttttgtgtgttgcgcttttgatgcacgagctaaacgagtgcgggggggttgttgaagttcactgccttctcaaaaagagagcctatatccgacctgcaaggtgatgtttggcatataactaccatggggacgttgcctcatcggcttacaattttttatattattgtagggacgggagcaaagtatttgggcccggtttgggtacaactgcacggtttgagcggatttttctggataagaaaaaaaaggtccggggccaaagcttgttagcctttgtaacaaggaattttttttgggtgtgggatgctacaaaaaaattccggcaaattttccttagggttggggggaacctttacaaaaagt

SEQ ID NO: 680562 - DNA, 462 bp, Homo sapiens
  misc_feature (281)..(281): n is a, c, g, or t
  misc_feature (300)..(300): n is a, c, g, or t
  misc_feature (417)..(417): n is a, c, g, or t
ctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgccccatggcatccccacccccgcccctccggacggcttacttaccttcataacggcagcttcatctttaaaccaataggaatcgcttcggtnggacggagagtgtcttgantcaggattattttacctcgggaggggagttttctggttacttttaggggaatttatttgaattggggttttgggggtttggaaatttttttttttttttaaagggaaaggaaaaagnaaaccctggggattcccatctgtttttttttttgtttggttgttt

SEQ ID NO: 680563 - DNA, 213 bp, Homo sapiens
atatgtctaatggataatgaaagtgtctgtatttagctatttaacttggttcggggttctctcttgcttacttaaggtgactgcatttccctgagatgaatgctgtgggttttggcagtctctccccaacttggcccctcccctcttagatgaaggtgcatcactaagagaacctgcaccactgtgtctcctaacacggtgtcacggtagaca

SEQ ID NO: 680564 - DNA, 651 bp, Homo sapiens
  misc_feature (167)..(167): n is a, c, g, or t
  misc_feature (170)..(170): n is a, c, g, or t
  misc_feature (249)..(249): n is a, c, g, or t
  misc_feature (273)..(273): n is a, c, g, or t
  misc_feature (311)..(312): n is a, c, g, or t
  misc_feature (315)..(315): n is a, c, g, or t
  misc_feature (374)..(375): n is a, c, g, or t
  misc_feature (378)..(378): n is a, c, g, or t
  misc_feature (386)..(386): n is a, c, g, or t
  misc_feature (466)..(466): n is a, c, g, or t
  misc_feature (506)..(506): n is a, c, g, or t
  misc_feature (569)..(569): n is a, c, g, or t
  misc_feature (648)..(648): n is a, c, g, or t
caccaagggcaggtgggcaggcctccgccctcctcccctactccagggcccactgcgagcctcagccgcaggagccaccagatctcccaacaccatggtccgataccgcgtgaggagcctgagcgaacgctcgcacgaggtgtacaggcagcagttgcatgggcaanagnaaggacaccacggccaagaggagcaagggctgagcccggagcacgttgaaggtctacgagaaggacccatggcgcagtntcactataggcgcaaacactgctntcgaaggaggctgcaacgagtatctttctttgttgtgnngcntcgcatactctagcgagaaggcgcaaaagacgtctcctggcaggtcaccgggaggaggnncancgcagagngctgcaagaatccagtgaagaagaacatgccagaaaggccactaaagcttccctgtggccccctcaccccccagtctggnaaaattaaagaaaaaagtcgcccgaaaacaccaaagtgangagccatagccaatttcccctactatccaaatggctcaaagcccccccagactgagaaagttnaagcagaaaagtcaacctgccacaaagaaaacatccgcagtgtaggcccatatgcaaactccccctaacatcaaaatgnctc

SEQ ID NO: 680565 - DNA, 427 bp, Homo sapiens
  misc_feature (6)..(6): n is a, c, g, or t
  misc_feature (380)..(380): n is a, c, g, or t
cattcnggatctcatatgcccatagttcaaaatatttttttactttatatatcatcagatacatacgtgcacacacatgtaaatatgcatccatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgttaagtagcacgcattcctgtggtcttagttactcatgagtctgagttgggaggatcgcttgaggttgaggctgcagtgagctgtgaatngccactgcacactagcctgggtgacaaagtgagaccctgtttcaaaa

SEQ ID NO: 680566 - DNA, 180 bp, Homo sapiens
acagtggacgggaaacgggcgagttccttgcgtgggcaaggagacacagtgggacaccggtgactggggaataacatggtagaacccaggtccggggatatcatgcttctatgaggaaatctctgggctggaatatggaatccttttttttctgattctgggatggccgaagcttgagca

SEQ ID NO: 680567 - DNA, 412 bp, Homo sapiens
ccttttgttgtttcaagtgcctttttcattgaaaagtaacgtgttagtgatctcctatatatatcttttaggaaccacagtgttcagataagacatttgtctatggattagtctgtgctatgcatattatgatataaaacagtgaagagaataaaatgctaccaaacaagaccctgatttttttttccatttttttcctaaatgaaagtttgtgactgtgggaaaatgagtctggatccttctgggcttgattttgcagctgaaatgtaccatttatagtaggatcttaattgttccagaaaagttttgtaaacatcaagctaggttagaagtttggattatgtaacagattaggctttttgccaactgttattatatgtaactatggagaccggcttacttaagttcttaa

SEQ ID NO: 680568 - DNA, 273 bp, Homo sapiens
tgaaagccacccttttttgtttggtacctgggggctgtgatgtgttatacagacaagtgctttgatatattatctagtgttgcaaacagcttctgtcactccgcggtgtcgccttccactccaatggattgtgtttgctgatgaacagaaagtacaagcttactttataattagggcttttgcgtcctggctgtgtgtgtggcctctttctggactgatctgtcccctttgttttttgcccccatgtcgtactgttctgggaggtggttccaa

SEQ ID NO: 680569 - DNA, 271 bp, Homo sapiens
attaacaattcctttaaccttgggggggggggaaaaaaacccacccaagggggggattttattcccccttttaaaagccgaaccccaaaaccaagggtttttcataagccccaccaccccccaaagaaaaaccgggggttttcccctttttaattccccttgggaaaaaaaaaaccggccccccctggggggatcaaattaattcaaacccttttttccgaaacccaagatgaatccccccagaaaaaccccccggcaaagggttttctta

SEQ ID NO: 680570 - DNA, 620 bp, Homo sapiens
  misc_feature (39)..(39): n is a, c, g, or t
  misc_feature (53)..(53): n is a, c, g, or t
  misc_feature (58)..(58): n is a, c, g, or t
  misc_feature (74)..(74): n is a, c, g, or t
  misc_feature (80)..(80): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (309)..(309): n is a, c, g, or t
  misc_feature (433)..(433): n is a, c, g, or t
  misc_feature (467)..(467): n is a, c, g, or t
  misc_feature (481)..(481): n is a, c, g, or t
  misc_feature (501)..(501): n is a, c, g, or t
  misc_feature (517)..(517): n is a, c, g, or t
  misc_feature (620)..(620): n is a, c, g, or t
cgatcctcgggctgcaggaattcggcacgagtcctgagnccgccagccccggngccgncgcgctgcgcctaccncaccgncgncgncgncatgaacattttccggctgactggggacctgtcccacctggcggccatcgtcatcctgctgctgaagatctggaagacgcgctcctgcgccggtatttctgggacttcatttatttcattgtataacacatctatgaaggttatctaccttgcctgctcctatgccacagtgtacctgatctacctgaaatttaaggcaacctacgatggaaatcatgantaccttcgagtggagtttctggtggtccctgtgggaggcctctcatttttagttaatcacgatttctcttctcttgagatcctctggaccttctccatctacctggagtccgtggctatccttncgcagctatttatgatcagcaagacttgggaggnccgagaccattatncacccactacccctgtcttncttgggcctctatcgngctcttgatcctggtcacttgatcttgcgcttttactttgaggcttctttgacctcattgctttggtggccgcgtagtccaaaccaatctttactgtgacttn

SEQ ID NO: 680571 - DNA, 290 bp, Homo sapiens
  misc_feature (252)..(252): n is a, c, g, or t
ccccccctttttttttgggggggttttttttattttttggggggggggggccccctccccttttttttgggccccccgggggtttaattcccctttttttggggggttccccccccctttttaaaaaaaaaaaaaattttttttttttgggggggggggggggggcttaaaaaggggccccccccccccggggggggggggtttttttttttttgttttttaaaaattttttcggcgcgcgttttttgaaanggggcccaaaaaaaaagggggggggttttcccccccca

SEQ ID NO: 680572 - DNA, 162 bp, Homo sapiens
gatcttactgcgcggttggggggcggcgggcttgtcatgtcgtgctcagatacaggtcttccagtggcaggatgccattctgaccagatggagccgacctgattgtctccgaggcagattccaccatcatgtcgctctagcggtacctgcccagcccgtggt

SEQ ID NO: 680573 - DNA, 839 bp, Homo sapiens
aaatatgaagaatgtggcaaagtctttagccagtcctcacgaccttactacacaaaagatagcttcacactggagagaacctctacaagtgtaaagaatgtggaaaagcttttaacctattctcaaatcttactaaccataagagaattcatgctggggagaaacctacaaatgtaaagaatgtggcagagctttaacatatactcaaaccttaataaacaggagaaaattcatactggagggaaactcaacaaatgtgaaggaatgtgacaaagcttttaaccgatccttaaaacttactgcacataagaaccattctaatggaagagaaaccctacaaatgtgaagaatgtggcaaagtctttaaccagttctcaactcttactagacataagatacattcatcactggacgagaaaaccctacaaatgtcaacagaatgtggccaagccttttaaccagatgcttcaaaaccttactgaccataagaaagatcccatcactgcagagacactcctatccactgtgacgacatgtggcaaaggcttttaaccaagacgtcaaaactaattaaccataggaccaatttattctgcgagcagaacacccagaccaacggtgacgaatcgggggaaaacacaaacaatcagacacgacacgacccatactaacaccatacagacgaaccatcggggagcacaaaccctagcactgtgaaagacacgcgacaaagcacacagacacgaacgcgcaacaacaacacaaatacgagactcccacaacggccagaaaccaaaacaggcgaacgaaacgaccacaccaaacgagcccaagcgcac

SEQ ID NO: 680574 - DNA, 697 bp, Homo sapiens
gaactgttccgggagcgccggtgttagctgtcgggggctttgggcatggcgacttgttctggccctggtggcacattctcgtgtcgcttaatccgcagaaagatgtcgcagttccaaaaaggaggttgcgcagggttcggcaaagcggatttaaaccagtgaaaaatacaccaggagccaatttactcccttggagataggcctaaggtgacgccaatttaacttaaaatcttaattttggacaggaaacccgcatgaattctttacgcatattttcatcccacagttttgggcacctgggtgaccaccgtgggatccaggggcttgggtccaagaatcggtaacacaaggggacctgggacaacttagggcaaagatggggttaatcgccattcggggagagacggtttagggacgctcctcggagggatttggtttgccaaaaaattgaggtttggttggaaacacccactttggagaccaaatcttaacaccgtgttgggggcggacaaacgaccttccttggggcacggtgcgctacattttgatatggccacaccctggaaaaaggctgttcccattcaacgaaacttctttaaacgaaacgtggcatattatccccaattttagagccaggcccatccaataattccactccaggtgcacaaccggacatacactccgggaacatcgggac

SEQ ID NO: 680575 - DNA, 940 bp, Homo sapiens
catggtggcacacctgtaatcctagctactcaggaggctgaggtgggaggattgcttgagcctgggagtttcaggctgcagtgagctatgattgtgtcactgtgctccagcctagatgacagagcgggaccctgtctcaaaaaaagtatatatatatatatatatatatatatggcgcgcgcaatagttcactcatattactcacacaaacatctgttgagaggcggcagaagggcgggacgatactcatggctgagtgtgcagggagttacgaagtaatgacgccgctgcgccccaagctagtgatgaaaaagcgtggttctactatactaaaatatacaaaacacatactatggtggtgtgtgggtggtatcagtgttgtgtatctccgcaagactaatgtagaggagggtgcatgagggcgcaaagaaaaaagcgtgggccgttgacacctgcttgaagaggggcggagtggtcggcagatgacggccggagtagtaggcgaccagggcgcatctactacgccgctgggcaaaacgagatgatgagatctctgctctccagaagaaaacaaaaaacacaccacagaagaccaagacacaactcatttctgtgcggggcccggtacggggcccccggaagaggagaggcagtgtttttgcacaaacaccaagttggggtgtgcggcgcgcgcggggcccacacgtggggtgtaaccgcgcaaaggcgggcgcacaaagcgcgtgccaccgacgaacaacaaactcgggcacaaaaacaagacggcgtagtgaaactccaccaaaacaataaaaaaccgccggggagcaaacccaaaagttgtcgacgaaaaacaacaaaaaggaatatcgagagacccaagacgaggagcaaaacgacaagagggacccagagcgagcgtcgaaaaacaaaatccgcg

SEQ ID NO: 680576 - DNA, 411 bp, Homo sapiens
  misc_feature (137)..(137): n is a, c, g, or t
  misc_feature (160)..(160): n is a, c, g, or t
  misc_feature (197)..(197): n is a, c, g, or t
ccctgcccctttactttgtatccaatcataacagtgcagcaggcattcggggccacactggttcccgcacttggggaaggggtcccccgggccccagcattttttcttttactcttttgtctgggggttttaatttngcaatttcttggtctccacacangggaagaaaacccacccaaccccgtggggctggaccntacaagcaaacactaagagaattcatcaccactggactaatactatagtagaggctcaaaggagtcccagacatggaaacaaaaggttgatatttgccatcataaaaacacatgaaagtataaaattaataagtctcataaaacaattacacgaagaagagaaaggaatcaaatggcaccatgatagaactccatgaaaccacaaagacagaag

SEQ ID NO: 680577 - DNA, 156 bp, Homo sapiens
  misc_feature (4)..(4): n is a, c, g, or t
  misc_feature (44)..(44): n is a, c, g, or t
acangactgggaagcagtgtgatctgccagacttcagatacatncacttcgagctctatgcttggagggtgtggagagagggtctgaggaagtgcccgcggagctcgagctgcactgctgtcagtgcttcacgacgtcattcctttcttcaagtgt

SEQ ID NO: 680578 - DNA, 959 bp, Homo sapiens
  misc_feature (142)..(142): n is a, c, g, or t
gtatcagcaccgtccgagcgtcctcttcaggattgcccctggagtttcttacacccagtctcctcctgccaagttgcaccatcctactagttacagacccgtcatcgcatgctagtgagctgagaagccgtagtccgccagnttgatgtttgcaggactttatcgcagatattcataccatgttccctaacaaaggttgataagttcagaggggctgacactcctacgccacacagtctacgcgtgcgtacctactggccatctcacgcgtggacgatatgcgtaggctatacagtacgactctagtcacgagattactatgccatcttgacatcatgcctcacactcttggagactagcaatccaatctaccattactagctgaccacgaggtcgcgcattagtttcctaattgtatgcctacccgatctacgcatctcgtacacaaatgcttaataccgtagcttgtcttgaggctccaaaatgtctgctcaatcgccagtcagaatctcgtaacgctagtaaatacaagtagacttgccaagggagttgctgctggacttagcgaaagcgcaatgtacgagacaaagggtaattccaagtcttacgtcacagagtcaccacacaggacgcggtcgaaacgaggagaagcatatagcgaatgaagccagcattggatacacggagtgttgccaaacgagatcgtgtactctgggataatttgctcggttgaactattcgtgtagttacggcaatgatcgtattcatgatatctatgatggaagatggcattgtgtgtggtagtatgcgaaactgtggcatctgattcaataattacaaacatttgagtgcacatttgtctcggtaagatgggagctttgtgacttgaaaatgtttgggcattctagttgtatagctttattttacggtataatgaattgactctgagtctccaatat

SEQ ID NO: 680579 - DNA, 918 bp, Homo sapiens
tcaggcacccttgagactcatatatcagagggaccccctgaagctggtggtcactattcatgacaaatacttcaaggagatgaaagaaagctgttatggaacagttccgccacttgccaatgcctttccactgtgaatgcagtgaatgaactcaagttgttataatgacatggcttgctggatgtgcttgcacgcacctgaggtagtgtggacgatccatccttcgtcctgagaatgccactgcagaatgggtggctgatgtgcttggccaatgtgtctctgcacatgcttgatatgaaactcctgctaattgtggacttggtgccaatgtgatgtgccctgtgtccatttgctacttgcatgtgaagaaccatcttggactgatgtctactatcgtgcaatgcacaaaagaagccctatagttgtcttgaacgatgtgacttccatcgactgttgtgcaatactgagcatgcatgcatgctgtgcatgtggacagttggtctgcatccctgtactctgatgtggactactgccttgtgccccccaacattcacagtgcataaatgtggttgtatgaaaatgtcctgagattgtgaccagttttgatttaccacacagcctaaacaaggcgatgtgcaggtagagtgagcagggcatagggttggtgtggatgcatctgatgaccccataagaccacctgttggaccactcctgtcatttgatactatggacctgggccttgggcactagaaaagtccacttgcattaaaccccatacgttctaccaaggtttgatgttcccttgtcattgcgacgaatgccatgcctcatcctccaacaggtaacattagaatgaatttcaataaacccaatagtacaccattgcttgggaagtttccgaaataccctatgtcaggg

SEQ ID NO: 680580 - DNA, 424 bp, Homo sapiens
gatccgctctcgaggtcgtttgtatcgataagcttgatatgtggggggattcgattccattacattccattgctttgattccattccatctcattccattcaatcccattcaagtccattccattcctttccattccattaaattccaatccattccattccattccattagagtccattctgttccattctattggaggcctttcaattccattccattacaatcatgtcctttcaaatccattccattcctttccattcgaatccattccattgcattccattgcattccatttgagtcaattgcattccattcaattccagtccactccattcctctacattcctttcgagtgcattcaattctattccattcaaatccattccattccattcctttccattccattccattcgagtccat

SEQ ID NO: 680581 - DNA, 373 bp, Homo sapiens
ttttttttttttgagactgaatctccctctgttgcccaggctgttagggcagtggcatgatctaggcttactgcagcctctgcctccagtgttcaagcaattctcatgcctcagcctcccaagcggctggggttacagacgtgcaccaccgcacctggctaatttttgtatttttagtagagacggggtttcaccgcgttgcccaggctggtcttgaactcctgacctcaggcgatctgccatcttggcctcccaaagtgctgggattacaggcatgagcaccgccccagccagaaacttttttaatagattgataggttgacaacactggagcaattagtcagtttcactaataaaagataatcacagtcga

SEQ ID NO: 680582 - DNA, 152 bp, Homo sapiens
ctgagacttgatagtctagagacactgatgcagaactatcttcatgcagtcgttcagtagcgaatgcttactggtaggacatctttatttacacatttgagactactatccatgagtcagtcaggatataagctttgattcaagcacacatg

SEQ ID NO: 680583 - DNA, 114 bp, Homo sapiens
attgtctcactctgcgcatggtgggcagttgctcaggatcgagcacactgcgggtgcagcagcgtcgtcacccaggatcagcagccgtttagcatccccggggtggaaatcgat

SEQ ID NO: 680584 - DNA, 370 bp, Homo sapiens
atatagaaatgcatataagtatatatagttcatacaataacataacttatattctgtgttataaaagtatacacgtttagatactaatacctctcatgcctgcatttctccagtttgtagaagcacgtggtcttgttcatttgttttacacagttctttttcactcatgaaacctattattatgggacagacacatttacatgtttcttacccaaataagccactttattttgtgaaatttggaaatattctttgtttaacgttgttcatccagcctgatttttccttccagttcacagggtttcttgtcatattttcaggagaaaactttataaaggaaacttgagcaaataaaggaaatgactacccc

SEQ ID NO: 680585 - DNA, 151 bp, Homo sapiens
tgagatcattatgagagtagaaaacaatctaactgagtttcttggcaaatgagtgaggagtgtattgagttgtagtcttgtttgggtgtaatagcaaacagatgatttttttgcctagcactgtcattaagatactgagtgggttgatgat

SEQ ID NO: 680586 - DNA, 300 bp, Homo sapiens
  misc_feature (28)..(28): n is a, c, g, or t
  misc_feature (43)..(43): n is a, c, g, or t
  misc_feature (161)..(161): n is a, c, g, or t
  misc_feature (167)..(167): n is a, c, g, or t
catgcaactccgcctcccgggcaagcgnttctctgcctcagcntcccgatagctgggatcacaggctgcaccaccagcccgctaagtattttagtagagacagggtttcaccagttggctaggctggtctcaaactcctgatctcatgtgatccacccacntcagcntcccaaagtgctgggattacaggcatgagccaccctgcatgccaaaagctatcatttttaaaaatatcttagggtaattagttttttgttcttttgtggaattttttttttttttttcccgagactccgtctc

SEQ ID NO: 680587 - DNA, 198 bp, Homo sapiens
tccagcatggggattgtttctgcccacctaactcttcaatgtactttgtaatctccccgcacccttaagaaggtactttgtaatctccccaacccttaagaaggttccttgtaattctccccacccttgagaatgtactttgtgagatccacccctgcctgcaaaacatggctcttcaccccctatctgttttaactc

SEQ ID NO: 680588 - DNA, 957 bp, Homo sapiens
  misc_feature (1)..(1): n is a, c, g, or t
naggccactatctatgttactcctaagataatgacacggctggtccacatacaggacgccgtcctgcccgagttttttgggggataaaagtgccaagggcggtgttcacgaggccattggccatcctgggcaaccgtagtggcgccacacctggctgcagattgaactcttaaccgccctccctgaccgatctgctatgtcgggccaggagtcctccccgtgcaacgtctgtcggtcagcccacgtttgacttggggccaagtatctggcagcccgcaaaagtgtgtcgtgggcccagtggtgaggcccgcgggtctcctgtgggcaccgcccccagaagctcgccctctcctagccttcgccccgaatcttcccccgttcagtgaaggcagaacccgtgcttaagttcccccttctaacccctcctattcccttagaatggcgtgccattttggcgcccttcacatccctcctctttgtgctccccccccttaattctctctaaaataataaggggggcgtaatttatatcccccaactttctcccgtcatccaaagaaatttctcttccatagctttgccggtgaaaccccccgccccgagatcgcccccatgttaaaaaagccggctaattttcttcgttgtagaacaatgaacgcctcctgcccagtcgcacgggaccaatatttccgagtatgtctgctaattgggccttggacccctgtgaaaagcctccaatataaaacttagtgatgagtcgggagaggcaccatgaaagttctttgatgaatcaacgaggtgaagatacaactgtaatctcccccaccaccggtttgtttctagccgttgcttttaattaccgagcccccaggtatttaattgggtgcaaaaataatgtgcccccctttgaaaaattgtcccccaaattacattccaaaaaaaacgccaatcataaca

SEQ ID NO: 680589 - DNA, 115 bp, Homo sapiens
ggatttgctggtgcagtacaactaggcttaatagggattaaggctgcataaagacaagactgctggttaaaaaatgaaaaaaaaaaacgttagaagcttgaattcgagcagtagt

SEQ ID NO: 680590 - DNA, 354 bp, Homo sapiens
acagaatttaggccagtggaaatgcacctgatagtcccagctacttgtggaaaatcaggaagatcattcgagcccaggagttcaaggctgcagtgagctattggtcgtgccattgcattccagcctgggtgtcagagcaagattctgtctcaaaaaaaaaaaaagaaaaaagaaattaggatggtttacagttggatggaggagggcagatgcaaagtaggtgttaagtaatgccaggctggcaagaaaccatgagtgggtctggagggcaagattgaccctgagtataaggagcctcgcaaggaaagtgtgagagtagccggtcacaaggggtaagttgcccgccaaatcgaa

SEQ ID NO: 680591 - DNA, 248 bp, Homo sapiens
ctggccctacagaagaagtctgtgaacttctgattgaggcctttatcactttactctcaccttgtagttgactcctaactggtcctcaagcctctcatctttctcccattctgatctctctctactctgaggccagtggtttccttgctatacatttactataagtgtactgccgaacgacagctatacagttacagtcaagctatcttagtggtggtgccacagcagcgccacgagcccggaccatc

SEQ ID NO: 680592 - DNA, 455 bp, Homo sapiens
cttgggaacacgcgttaatttgcttggggaaaacctgggggctgttatatatccggggatccccgtcttttgtccttccacgaggaaatcactcgttggttttgatggtataatgagcctctaaatcttagtgtggcgtgagaggatttagcatctttttctttgatgcccctgtgcgtgcaacaatattaacatcaatacaagctgtagacctcttcccctgttaatgtcttttgttagtttaattcacagatcccagcaatagagcctaagtgggtggaggaaaagttttcctcccctacattccaaacaagctagccattatgcatttacattaagatgaaaatcgatgcaattaaatcacaaaatatggtacctaacgtaaagtaaatttaaacagttttgtattcactagctctcttgaaaaacaaacaaaaaaatactgtgtatctcga

SEQ ID NO: 680593 - DNA, 740 bp, Homo sapiens
agatgcgctggcccaccccggctggcggcggagcctatcgccgtggagctgctggagcgcggataaatgtagcgccgcggcgcgggccagcagctctgcgaggggccggagctgcggcaggagccatgcagtacccagcaccccggagccaggctgtgctgggcagccgtggtgggttgccgctgtactgcgcccacagccagctgctgcaaaccgcacgaccacgaagcgccacttttacgatcgaaggaacactcctgtggccagctgtgggccacgccgcgcagcccaaaggcaacgaaccatacagagacatagacacggaacaaccaagaatcagtcactctcaaacaagaactcagtgatacaccgcataacagggaaagcgcacgagatagtaacgaagaaccaacagccgcggaaatcgacaaccaaaagggcgtaaatcgacgagacaaagtcaagacacaagacacggggacaaggaagaggagtagagaaacagaggaacccaagggggaaacacagcgaggcagcacgccacaatgagaagacgaccgcgtatcccacgagagagaaagacagctgcgagagcagaaagcatacaccaacaaaaccgccgcccccacgcaacagccagtacagcaccgaacgccacggcagtgaggacagcagagaacccacgatcactacggggaagacacagcactaagcgtatgagccagcagacgacgcgactc

SEQ ID NO: 680594 - DNA, 284 bp, Homo sapiens
cgatctagaggactcccctcctttatcaagcagtcgcaaggcatttgttgctatcgggactacaatggccacgtcggtctgggtgttaagtgctccaaggaggtggccaccgccatccgtggggccatctatccctgcgacaagctctccatcgtccccgtgcgcagaggctactgggggaacaagatcggcaagccccctacacttgtcccttgcaaggtgacaggccgctgcggctctgtgcttggtacgccatcatccctgcacccagggcactggcatca

SEQ ID NO: 680595 - DNA, 293 bp, Homo sapiens
  misc_feature (11)..(11): n is a, c, g, or t
ctttggggggnccgggggggggtctatataccctgggcgttttttttgacccgccctttttcccggagccgccttctccccttttttgccccccctgggggccccggcgcccgttcctccccccgggttcggccctgggcccggggtcggcttccgttttccccccggatccccttttgccccttgggccttttttggcccccttttttgtttggttggtcctttaaggcgggttggtcccggtcgggggtttcgggcctttctttaccccccgggttctgggcgggggggga

SEQ ID NO: 680596 - DNA, 151 bp, Homo sapiens
tttcatgatccccacggctcccaaatgtcttcacgaagccagaaaccacaaaccaacacatcaaaccaaccatccagcttcatccagctccagctctgcttctcaaaggggtctcttgctctgccgtctctgtctctcatctctcatgtct

SEQ ID NO: 680597 - DNA, 250 bp, Homo sapiens
taggcagtgttcagaaagcttgtttgaatctcagactcctttgagaattattggaaaatggacccactaaaaaaaaaaaaaaaaaaaaaaaaaaaaaaaaaaaaaaaaaaaaaaaaaaaaaaaaaaaaaaaaaaaaaaaaaccaaaaaccccccagggggacgaaaacctcttttgcacaggaaagtgggggactggcccttgccacaaaaaactcccccccttttgtaccccagtccgtggtcaacccc

SEQ ID NO: 680598 - DNA, 164 bp, Homo sapiens
cactattcatagaggccacggacaccgtactccataatgtggtctgaccagctcagagagagtacagtgggactgttaccttcctgatatggacagtattcttctattggtgcagattaagattgcattagtttttttcttaacacactgcatcatactagttg

SEQ ID NO: 680599 - DNA, 248 bp, Homo sapiens
  misc_feature (27)..(28): n is a, c, g, or t
  misc_feature (96)..(97): n is a, c, g, or t
  misc_feature (118)..(118): n is a, c, g, or t
  misc_feature (155)..(155): n is a, c, g, or t
  misc_feature (192)..(192): n is a, c, g, or t
tcggtaccgatgtgaataggtaggttnnttctactgactagaggtgtcgatctggaagcagcatttttcatttaagactcccaggtccccctcctnnggctgtaaggacatctagggnctgtctattctgtattactactgaggctaaagagttnatggtaccgtacattactgccagccaccatgaatatngtacggtaccataaatacttgaccacctgtagtacataaaaacctattcacaatcg

SEQ ID NO: 680600 - DNA, 306 bp, Homo sapiens
  misc_feature (84)..(84): n is a, c, g, or t
atttcatctcacgccatgggtgtccctaacagtcttcctttaaacatcctgtgtccagcactttgggaggccgaggtgggcggntcacctgaggttgggagttgagaccagcctaacatgggagaaacctcatctctactaaaaatacaaaattagccggtcatggtggtgtgtgcctgtaaatcccagcttcttggggggctgaggcaggagaatcgcttgaacctgggaggcagaggttgtggtgagctgagatcgtgccattgcacttccagcctgggcaacaagggcaaaatttttgtcttc

SEQ ID NO: 680601 - DNA, 426 bp, Homo sapiens
  misc_feature (377)..(377): n is a, c, g, or t
gggtcactcaccacattcttcattgattgcatggccgcctcggtctggcctatgaccggaagaaagtctccaaggccgccatcttggacaggattaaaagaaccggagatggaaactacaagagtggctgagtttggggtccctccaggttccttttttcaaagaaccacgccaggcagcaggttttaatagtcttgtttattcaactactgtaataactgctaccagcgatgctaaacgatgatgatgttaacccaattccatgtacatgtatatcttttaacaattcaaacagtatttgaaagccagacaactctagcctttatgaatgctaagctgtatattatttcttctctatatcctctctctacttctangtgcccattgtcctcctatttcactattatatgatcgcccagcagggga

SEQ ID NO: 680602 - DNA, 992 bp, Homo sapiens
  misc_feature (463)..(463): n is a, c, g, or t
tgcagaaatcaagatgattctccaagcacgcatactgctcagaaggtacaaagaagagtgtctggttccatctgttcggacgctatgccattcatgtagggccccaggggatcctctgcgaactcgatttcatgtacggctcgctttatactgctacctatcttgtggcgaagacacaagcaaggctccaggagagtagtctaagtgggctggtagtccattggatggagaatctgatgcaacgatatcgcggtacatatatagattagttggtgataaaacgaaatatgaagtcaggacgggatgtaaaaaggtcgttgaattctcactggatgcatcgaagtggggtcttgagtctctgtggtcgatgccacgggatggattcgtacgattatatcagggtcgaaatgaggtgtcattcgctagccatatcagacaagtaaatcctatgtggatggaaaanaactaacatgcagttagtcgtctactgtgaaaagtggcagcaagagagggtcggttgtgactaaagatttctaatcagagcccttgaatgcgtatagaaatctcctccacatgtaaattgggggatagttggatgggggattgttatctcaaaatatcaagtaagagcagctgatttatggacagaccacaaagagctaatatcactagtggtatggaagaaaatacttggaagtgagttactcctattgtacatacctcctggcaacggagacctgggcatgccctctgcttcacctctgatatatcaagatagtggtgggacgttctggccatgcctattgggcctgagaacctacttgctgggtatccagttgagggcactgaggaagtctaaaggtccctggtatgcagatgaccatgatgtgtatctagaaaatcccatttgtctcagaccaaaaatctccttagctcataaggcacttcagcaaagtctcacggataccgcccatccatgttccaccatcccg

SEQ ID NO: 680603 - DNA, 1191 bp, Homo sapiens
  misc_feature (203)..(203): n is a, c, g, or t
  misc_feature (222)..(222): n is a, c, g, or t
cagtcaggcgcatcttctttggcgtcgccagccgagccatatcgctcagacaccatggggaaggtgaaggtcgggagtcaaacgggatttggatcgtatagggacgtcctgggtcaccagcgggctggcttgtagactcgtggctgaaagctggcatagttagtgtggccatcgaagtgtacccctgtcattgcacctgcaanatagcatgggttgacatgntgcgcaatatgattccacaccatggcaagattccatggtcaccgtcaaggctgagaagcgggaagcgtgtcagtcaagtggaagatcccatcaccgatgcttccagggagcgagatccctccaagaatcaacggtggggcgattgctggcgcaggagtacgtcgtaggaagtccaactgggcgtctatcacacaccatggagaaggctggggctacatgttgctaggggggagccgaaatggggtcatcatctctagagcccctctgctgatgcccgcatgtgcgtcagtgggtgtgaaccatgagaagtatgacaacagcctctagatcatcgagcaatgcctcctggagcaccaagatgcttagcacccctggggcaaggtcatccatgacaactatggtatcgtggaaggagtcatgaccagagtccatgccatgactgcacccagaagacgtgtggatggcccgtcgggaaacttgtgggtgatggccgggggggtctccagaacatcatgcctgctctactggtgcaggcagggtgtgggcaggcattcctggagtgcacggaacgtcaagggcagggctaccgggaccaatgccaggtgtcactgttggacagaaccggcggcaagaaactggcaaatgatcacaccacaaagggcgtacagagtgaaggggcccccaaagggcacggggaaaaacggtaaacccaagggcggtctccctgataatcaacgaggaaacacactcacgacaatgtgaccagagggggattgcgcaacaaacactgtcacgaaatcgaggtagtgcaatgcgatccaaacgcggagcaaacaacacagataagacgagacaacgagaacacagaagagaaagcacatggggtcactaaacaaccacaggaccacgtgatgaacactaatagcgacctactgacttctaccagcatcctatcaaacacacaacaaa

SEQ ID NO: 680604 - DNA, 133 bp, Homo sapiens
aaaatgcaggtcgagcgcggtggctcacgcctgtaatcttagcactttgggaggccgaggcgggcggatcatgaggtcaggtgatcgagcccatcttatgctaccacggtgaaccttctctctcctaaaatcc

SEQ ID NO: 680605 - DNA, 516 bp, Homo sapiens
acctagcaaagcaaggagctgcaaatcgctccactaatggactccactgggatttcagaggcaaactcccattgtaagatttctgtgtcagaaacttccaccaaactcctgcgtattcctcttgctgtcaagcaggaaaggccaagattctagaatgtgcagttttcaagttcatgtctgcctccacaaggcactcttggagactgtaatgtgctcactgattgggcacattttcagtataagttgatttgcaggtggctgggactgcagcatcaggcagagccctccccagaatccttgacacagggggctgaggttgggcctctgggttcaaaatcctctaaaagctgttggcaaaatgtgtgtatttgctcacctgcgttgttctgaggaatagttttgtagatttccacaactcctcaaagtggcctaggaccctatattatttgcaaactatgcatccgacaaatgtccaatgtctagaatccgtaaggaactcacacaaattcacaagcg

SEQ ID NO: 680606 - DNA, 784 bp, Homo sapiens
  misc_feature (384)..(384): n is a, c, g, or t
aagcggaatacaaggcaaaacccaaaaacccagggggtggggcccggaccctccgtgggagtcaaacggggggcacccgggcgaaaaatggggtcattaagcccgaataaagcaactcatacaaggcgccctcaattgaccacgaaagataacaggaatcttctccgcgcgcgaatcccccctcgataaggccccccctcgtgtgcccgcctccctctgggagacagaaaccttgtgagaacacaatttctacagggccctcccaccggtgcacctcgatcacaaacacagcggggagatggtgacccccgcaacgtggcgcgggaaacccgcccgcggcaggaatcatgacgaagcgccgcatgtgccccaacgagtcaccanagaacaagtttgttccccacacgcacacaaagtgatgcgcgccgcggggctcctgcttaagagcccacacgactccgcgcgggggcaccccccacacgaggagaccacaaactcctctgtagcggtatttgttagcaccatcagacataacacccagagagctcacgaacagtacccagccgcgtatatgcggggttctctgcacagaagcacgaggccctttcctccacacagggtgtgttggaaggacccgccccagtcgtgcccctgggtaggggcattggcctctgatagagcatcctttgggacacgaggcattccggcgttcttcaaggtagtcatgtaattgagccaacccccccttaatcttcttgttacaattggaataaaacggcaccac

SEQ ID NO: 680607 - DNA, 460 bp, Homo sapiens
tctttttgcaaggccctctgaatctgtctgtgtccccctgttagcacaatgtgaggagggtagagaaacaagtccaacctctgtgtcctacccatgacccccttccctcacactgaccctgtgttcccttccctgttctcttttctattaaaaataagaaccctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggatttgcgactgcactccagcctgggtgacagggtgaaacgccatctcaaaaaataaaaatt

SEQ ID NO: 680608 - DNA, 430 bp, Homo sapiens
  misc_feature (262)..(262): n is a, c, g, or t
  misc_feature (278)..(278): n is a, c, g, or t
  misc_feature (314)..(314): n is a, c, g, or t
gaaatctcgttccgtatcgcgtcgaactgattagccgcatcgggcaggaagcagtagacgaaatcgaatcaaaccataaccgccatcgctggactatcgaagagtgcaaggcgatcaaggcagagtaccaacagaaactcaaagacctgcgaaatagcagaagtgaggccgcatgacgttctcagtaaaaaccattccagacatgctcgttgaagcatacggaaatcagacagaagtagcacgcagactgaaatgtagtcgnggtacggtcagaaaanacgttgatgataaagacgggaaaatgcacgccatcntcaacgacgttctcatggttcatcgcggatggagtgaaagagatgcgctattacgaaaaaattgatggcagcaaataccgaaatatttgggtagttggcgatctgcacggatgcta

SEQ ID NO: 680609 - DNA, 258 bp, Homo sapiens
tctcgtgtacagtaaaactgtagtatacacaataagtgcagggggggcaaatgtaataaaataagtagtagatgtgggaggttcttatatccttggtagggtatgctgatagtgtttagatttctgtgcccattataccagtagtgtgttaaattatttaagataaataattactgtaatgtaagagataccatgagttatgtgaaagattataaacccgagtttccatagagaaggggaacattaatgttagagata

SEQ ID NO: 680610 - DNA, 352 bp, Homo sapiens
gggattttacactacatttcctgtgctgagaatggatgcttgtatattcgtacatggtctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtc

SEQ ID NO: 680611 - DNA, 284 bp, Homo sapiens
  misc_feature (147)..(147): n is a, c, g, or t
agtaactgagtggtgtcatcaactgctgcacatgcttaacaattccattgcaaaacaaggtaaaaagactcagataataaaaacaaggcaagaaccgcatcttcatctaccaggaaaaatgtttaaaacaacaaatgaatcttcccngtcaatggccactcctccaaaacactaaagattctcatttttttttgttttcttttttttgggaaacccggtttccgcctcttgtggccccgggctggtagtgtgacaaggggcgtgtgaatctcccaggcctcagt

SEQ ID NO: 680612 - DNA, 315 bp, Homo sapiens
gacctagaggatcccttatgacggaagcatgcttttgataaggtctctataggtgataggctggaattgcggcattcaccactgctttactgggcaatatgtgatcaataatagcagaactgtttgccttccattcttgagatctgactgtatgtttcagttttcattcccttgagaaccattttccagtaaaaatgattctaaggttccacagatcaacagctgaggtacattctgtatcattctgcaggccagcctgggccaagcaatttggcaatcctgcttccgggtcgaacggggtcaccggagcttcga

SEQ ID NO: 680613 - DNA, 682 bp, Homo sapiens
  misc_feature (206)..(206): n is a, c, g, or t
  misc_feature (236)..(236): n is a, c, g, or t
  misc_feature (269)..(269): n is a, c, g, or t
  misc_feature (272)..(272): n is a, c, g, or t
  misc_feature (292)..(292): n is a, c, g, or t
  misc_feature (294)..(294): n is a, c, g, or t
  misc_feature (323)..(324): n is a, c, g, or t
  misc_feature (336)..(336): n is a, c, g, or t
  misc_feature (360)..(360): n is a, c, g, or t
  misc_feature (372)..(372): n is a, c, g, or t
  misc_feature (378)..(378): n is a, c, g, or t
  misc_feature (380)..(380): n is a, c, g, or t
  misc_feature (390)..(390): n is a, c, g, or t
  misc_feature (409)..(409): n is a, c, g, or t
  misc_feature (414)..(414): n is a, c, g, or t
  misc_feature (425)..(425): n is a, c, g, or t
  misc_feature (443)..(443): n is a, c, g, or t
  misc_feature (448)..(448): n is a, c, g, or t
  misc_feature (455)..(456): n is a, c, g, or t
  misc_feature (458)..(458): n is a, c, g, or t
  misc_feature (461)..(461): n is a, c, g, or t
  misc_feature (464)..(464): n is a, c, g, or t
  misc_feature (473)..(473): n is a, c, g, or t
  misc_feature (480)..(480): n is a, c, g, or t
  misc_feature (487)..(488): n is a, c, g, or t
  misc_feature (495)..(495): n is a, c, g, or t
  misc_feature (506)..(506): n is a, c, g, or t
  misc_feature (520)..(521): n is a, c, g, or t
  misc_feature (552)..(552): n is a, c, g, or t
agcgggactagctaccgtggcaggtcttctacctgcgacgcttcttcaagggccacagaaatggattgagtaatgaatgaggcatattctcctcccaccttgtacctcagccagcagaacatcgctgggacgtgcctggcctaaggcatcctaccaacagcaccatcaaggcacgtggagctttcttgccagaactgatctctttnggtgtgggaggacatggggtaccacctaanccaacaagtcaatgagggacttctttttaattnggnaggattttgactggttttgnancaataggtctattattagagtcactatgnnaaaaataggggntacctagataatgccaaagtcagnatttgcctgggntccctngngtgatctgtntggactatgttctttcttntccanttgctcagcanttgggcttccatctagtntttancaagatnntnggngancatgttganttcattnggattgnnctctttnaatttcttggnaaaacacccttaanntttctctttacccttagctgaaagttttacnatagcttctggtgatatcgttggcatgatgtgatatctcttagaatggtgatggatgtgacacctcattaaaagtgagctagaactgtagataatattaaaagaaatgtcaatataagacaaataacata

SEQ ID NO: 680614 - DNA, 1373 bp, Homo sapiens
gagtgggaaagggcggtggcatgatcctcgatatatacagactcaggaagtcgagcctcacgggagtgacggggctatctccgcaggctccgcgaagaaagcaaggctgggaggacccagacgaacggacacaacagacctcagcggccacgacagcctcagccgccaactcatgtcagccggcagagagtgcaggtaagcgggcagcgtacagcatccgcatggggcgtggacattctgacagcacacgacacggtatccctctgtggactgaccatatggctaccctcttacacgaccatttaccagagggcaaagggaagctagatagcggagccggaagatgaggcacccatcgggactcgagacagacggcgacgatataaagctgagcgagccagatgccacatggagaccggatacagcattctccactcaggctaccatccagcaccgagaccagaaaggacccccatacccccagaattctagggagagccgatggacgggagaccgagtcagatcgcgaggtaaccagagaccggacagaacggagcgaacaaggggaaggataggccaagacaggaccaccgacacacataagagatggatacggaaaagaccatcacccagtcacaggagatgagagaacaccgagagggggaccagacacgtacggagaacggcagacccgaacgaaccaatgggcatacgaccacataggatgggggaggataacacggacgcagcaatcataacggacaatagacacagcacagacggactaaaccatggggcagaggattgaagacgcaggaaaaggccagaagaagagacaacacataacaccggacgacgaaaacatggaagataaaccatgcgaaagcacgagaaacagaactgatagacaccatgagatatgtggatcagcaaccaggacaccaaagaaacgccacattggacatggggcacaaaaaacgcaacaacgagactgaaagaaacgaaaagagaaaccaagaacaagcacaggaccttgacgcacccaaggaactacaaagagccgaacatcaacaataaacagagaatgcgaaaacaatacagagggaaaacaaggaaaaacaaacaaggcaagaggaagcaaggatggagcaagggacaacaagacagcagaacgatacacgaaagtatgaagagaacctgaaatgaagcgcacaaaagacaaaaacaacaaagggcacacaggtgcgggcaaagacaagaacgactgaagcaaaacgagataagaacagagaagacgacaagtgaagagatacacgaacggacagagaggtgacagcagacagaaatacagacaaaccatgactacagaagca

SEQ ID NO: 680615 - DNA, 919 bp, Homo sapiens
accaaaaaaaaaaaaaaagggaggtgtattgtcgccccccaaaaaaggcaaatcagtgtggtacgcctaaggtacaattccaagggtcttaaccaaccggcagggttttttaatccttaaaaacctttagtgcctacattatcattggccagtttccatattggggggttggggcaactcttataccagggaactcagtgggaatgttgtctgtccaggccatgtgaattggccacttatttacttctaaaaggttttctaagagtgaccggcttatcacatatgttgtgggttgatattctccatggtggctgacatttgggaagcgaggggtactagttaatcccttctaagacaagaatggttatagttttcccgggtgggatactcttcaaccacacggtctgtgtacttagagggaaagtacagcttaggccctaagtcagaaatcaattagctggccggcattttttggtaccacgtgccgtgtgcatttgcggcttccacaggtgcattgcgttgacacggtgtgagacagacacttctgggccattttccctgtggtggaattaggaacgacccctttccttgtgcttaaggggttaaggggaggagatacctaagaatacgggagggcttatcctaatctaagtggggggggcggtacttagcacgggcagacaggggcgggcctgggctttcacgggttttttccccctaagagtggtatggcggcggttcctatcacgttgcaccctaatagtggctgtgaaccttatttcctaggtacccgaatcccttgctcttcccaggtatggcacacctcgcttttattaagccccaaaggtacggtcgttcacgtgcgttggtgtacaattggcgcccgcgcacgcgattttggtcgcctttcaagtggtta

SEQ ID NO: 680616 - DNA, 115 bp, Homo sapiens
gcggccgcctactactactactgctcgaattcaagcttctaacgatgtacggggacatgtgtacctgtaatataattccatcatatctcaaagtaaagtcattaacagcaaaaaa

SEQ ID NO: 680617 - DNA, 223 bp, Homo sapiens
tcatcaaaccctaccaagtgttctattatatctagacttaataggttaggtgctagtcctttgtatagatacattatgttaggcaaatattttccccagtccatagcttatctatttcatatatctataacaacagaattattgcagagtcaaaacgtttttatatgacagtccaatagtaatagtattactttagtataagttactttatgctatattggta

SEQ ID NO: 680618 - DNA, 764 bp, Homo sapiens
tgggaacgcagaaatctgaggtaccttcaagaccgtgagtctaaggggcccggtgaccccatggggttaacagcatccttgttcggggcgtcaaatggagcatctcgatgcccaagtcattgctgcgtccatcttttaggcacggtggaaattcctggcgacaaggtactgatacaatttggctgcacggaaataggcagcgtagatggcgagcgtggctttctgatactttcccgatgcacatgcgctgcgcctatccaggacaggccgtatgtcttgttggtcaaggtgacaccatccatccctgtgctgcacacttagaatcacactgggctagcgtttatcacaacttacctcgggtccaattgaaaacgagtaatctctgagtaggcggagaccacaggcatacggtgcgtttctctactccagaaactgcctcataaccggttccaatgtgtagcccagattagagaaccagctgtttaatgggcagaacctcacttgcaggctgctgacgaagtttctgtctaaactgcaataatcttgggacttctcgtgggtctcttaaaaatggagctaactagcatgagcatatttattcgttctgtggtcactgctcagagtagtcactttttcaagataaggacctgggttaagtgagcataaaaacagtgacataaaaattaaaagtaaattacctaagtgagaaataaaagcctatgaataatgtaacaaggggaagagctggaagaactaggcagata

SEQ ID NO: 680619 - DNA, 109 bp, Homo sapiens
ttgcagttaggcaatgctcataagttaaaccctggtcggtgaaagcccagagtttacgaaagctacaacaagagtactcctcctcagggatggagatcttctcattaaa

SEQ ID NO: 680620 - DNA, 134 bp, Homo sapiens
tcagcaggatcctaagctatggtcagtataaacaattccatatacctcctcccttttttttttttgagaaaggtgattctctctctgtgcgcccaggtggaattcgcatggttgcaatctcgagctcacttttg

SEQ ID NO: 680621 - DNA, 169 bp, Homo sapiens
actctagacggatccccctggtgtctacatatccgccatgcttgacgatatggactaaaaggaacgagacgtgataatagagggagttcgtagctggctctaacagagttttgattaccattgacctgctggccagaggcattgatgtgcagcaggtttctttagtcat

SEQ ID NO: 680622 - DNA, 699 bp, Homo sapiens
  misc_feature (414)..(414): n is a, c, g, or t
  misc_feature (452)..(452): n is a, c, g, or t
tcctaaggcaaatggttaaaaaaataaagagagccggccaacaaaaaacaaaacgtccaatcttgtaaaatgtgggcaaggtccatgaagattttttttgcatataaaatgtggcaagaaaagattgttggactttgggaagttcccatccctcaagcgcttgtgcaaaaaggaggtgttggttacatcacaagggttttaataggagaacataggttattcttagttgacctaaaaaatttggtatttgtacgcaactaaaaaatttcagttccttataaacccccactacaactgattcggtgttgcttatacagcgcaggctttcctggagccatagattttaacattcgcaaaaggatgtagaccgtctagacaagcataaatcttaggttcgtagaatattatcagtanagagcctatgggctgcctgtgtagaatggacgactcanagggttctaaagaatcagaagtttttcaaacaggagcatgggcatgtgcttcagtagaacaaataattactttcaactgtgtagtcacccacctcacaaagtttccaatgttgggcacaattagtcacgcgttgtaatcccgccctcttgggaggattagctggtagggcctcttacgctcaggtagtagcgggtacagtgaaccgcggttgcatttaagcactcaagcctgggtcaaataggaagc

SEQ ID NO: 680623 - DNA, 234 bp, Homo sapiens
  misc_feature (27)..(27): n is a, c, g, or t
  misc_feature (80)..(80): n is a, c, g, or t
  misc_feature (163)..(163): n is a, c, g, or t
  misc_feature (171)..(171): n is a, c, g, or t
  misc_feature (194)..(194): n is a, c, g, or t
  misc_feature (211)..(211): n is a, c, g, or t
ccaccatacccagccaattttttgcanagatgaggtcacaccatgttgcccaggctggtcttgaactatttgcctcaggnaatcctcttgcatcagcctcccaaagtgctggtattataggcgtgagtcaccacacctggctaaaaactactttatggtgatnaaagatanagcggttacctagaaagggggtngggtgggattgactagnaaaggccacctagagctcgtgcc

SEQ ID NO: 680624 - DNA, 588 bp, Homo sapiens
taagaggcccgtgtaacgacgcagtgcaaacggacgggaatgtatacatcgccagtgtaaacgaccgacatgtaactcgatcggactctgtaaaatgacgagtattgtaatccgactgcctgtgttaaaccgaccgtgatgtagcagatcgcgggtatgtatggtgcgggcctcttgagtcaccgggtgaggtaatccttttgagcccggaaacatcttgctcacttagaacaactggtacctggctcgtaagtcgcaagtagcatctggagcgggtaggaactccaaagcattggatgcttggataaattgggcggcgtgtttgctcctcgtgcatgcaccggtccccacaaggtgagagagtgtctcaccctcaacattctccagaggaacagatttaactatgccccgaacggagattaagtaaagaagatttgcatgcagcggttcattaaaatcgatggcgaagtccgaactgataaaacctacccggctggattcatggatatcatcagcatagacatgacgggagagaagtcccgtctgatctatgacaccgacggtcggttagctgcacatcgtaataca

SEQ ID NO: 680625 - DNA, 244 bp, Homo sapiens
agcaaaaaacataatctcgtatcgtttacaaaaaaagctgccgcatacctttttattattattattattattcattattatctttgagatggagttttactcttattgcccaggctggagtgcaatggcaccatctcagctcactgcaacctccttctcccgggttcaagtgattatcatgcctcaacctcccgagtagctgggattacagacatgcaccaccatgcccagcaaatgttgtgta

SEQ ID NO: 680626 - DNA, 123 bp, Homo sapiens
  misc_feature (108)..(108): n is a, c, g, or t
tgaaaattttttttagggccaggccctgaacaaatcattgaaaggtaattttctttgcgttttaaaaaatttgggttatgaagaaaaagtgatgaaaataaattaaanctgggttccctttta

SEQ ID NO: 680627 - DNA, 839 bp, Homo sapiens
  misc_feature (11)..(11): n is a, c, g, or t
  misc_feature (114)..(114): n is a, c, g, or t
  misc_feature (117)..(117): n is a, c, g, or t
  misc_feature (367)..(367): n is a, c, g, or t
  misc_feature (382)..(382): n is a, c, g, or t
  misc_feature (410)..(410): n is a, c, g, or t
  misc_feature (416)..(416): n is a, c, g, or t
  misc_feature (433)..(433): n is a, c, g, or t
  misc_feature (454)..(454): n is a, c, g, or t
  misc_feature (458)..(458): n is a, c, g, or t
  misc_feature (555)..(555): n is a, c, g, or t
  misc_feature (572)..(572): n is a, c, g, or t
  misc_feature (620)..(620): n is a, c, g, or t
  misc_feature (683)..(683): n is a, c, g, or t
gcgaaggaagncgccgctttttgcttaacagtgcttccccacggttgtcttaggagccaagtccccgaaggcttggcaaacgcgggagccctccggtggcagcgcttgggtgtnggnctccgaggctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggatcaagaggaccacactccagcccaggacaaaagccccacggtagcacattgtccggcaggagaggagcagacccacgtccaagaagatggttntacctttccacgccncttctctgcgaaatgaagccacaccacnacacantcttgaagaggaagccnggaatgggagacggcaacaancccngtccctggaacgctggcctctctggacaagccacccgcttcgcacccctcctcttatgcccgtggcggtggcacggcgctgtatcctgcctgggctntggcctctgctctgtcntccctcttgctctgtctcccctgtttctgagcggcctagatgcctctnggtctggctgaatatcttctacgaagatcacttccccgtccatcagggagacacttcctgganatccgtgtcatgactgtttctctctccaaacctgtttctgctgggttggtcacggtctggtgaccctggagctcttgtcttccatacgtgtctcagccagggaagcttcctcggtctccatgtttcacctcatgcgtggcgtggacttgctagaac

SEQ ID NO: 680628 - DNA, 357 bp, Homo sapiens
caatcattagataagtcatgaaacaacacgatgctatacgacgatgcggagaaaatgtggagaaataggaatgcttttacactgttggtgggagtgtaaattagttcaagcattgtgtgaatgacagtgtggtgattcctcaaggatctagaactagaaataccatttgagccagtaatataattactggtgcatatacccaaaggattctaattcattctactataaagacacatgcacacgcttgtttattgcagcactattaacaatagctaagacttggaaccaatcaaaatgcccatcaatgttttactgtataacaatgttgtgacacttatacaccatgatatactatgc

SEQ ID NO: 680629 - DNA, 384 bp, Homo sapiens
  misc_feature (11)..(11): n is a, c, g, or t
  misc_feature (114)..(114): n is a, c, g, or t
  misc_feature (117)..(117): n is a, c, g, or t
  misc_feature (328)..(328): n is a, c, g, or t
  misc_feature (372)..(372): n is a, c, g, or t
  misc_feature (379)..(379): n is a, c, g, or t
gcgaaggaagncgccgctttttgcttaacagtgcttccccacggttgtcttaggagccaagtccccgaaggcttggcaaacgcgggagccctccggtggcagcgcttgggtgtnggnctccgaggctccggcctgacctctccacggggtccacaggaacgtctccggctgccaggagtcgcaaggggccgagcaggatgaggaaaccacaggcggagtccgggggaagcagcgtggcatcccagcctcaggcctgccaggacggtgttcgggtgagtctcccgagaagtcgtgcccccgtgatctcgaggacaggtccgcctgcgtnccgagggctgttctctcagccgagggttgttcccctcctcttantcccgcncacga

SEQ ID NO: 680630 - DNA, 262 bp, Homo sapiens
accattatgtatgagcttcctccccatctccccattttgcagatgaggaaactgaggcccagacacattcacaaaagtgcaggagagctcatctgactgcagactcagtgtgtaacctgcaccctgtgcaccacctaatggattcagtctggggcacttggcacgggccttcagtttgcatcggaggcgagaggttcgggtggatattccacctgagaatgcttgggttgtggcgacagttggggtccctgcgggggtagtg

SEQ ID NO: 680631 - DNA, 611 bp, Homo sapiens
  misc_feature (283)..(283): n is a, c, g, or t
  misc_feature (288)..(289): n is a, c, g, or t
  misc_feature (307)..(307): n is a, c, g, or t
  misc_feature (316)..(316): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (335)..(335): n is a, c, g, or t
  misc_feature (339)..(340): n is a, c, g, or t
  misc_feature (345)..(345): n is a, c, g, or t
  misc_feature (347)..(347): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (420)..(421): n is a, c, g, or t
  misc_feature (423)..(423): n is a, c, g, or t
  misc_feature (430)..(430): n is a, c, g, or t
  misc_feature (435)..(435): n is a, c, g, or t
  misc_feature (445)..(445): n is a, c, g, or t
  misc_feature (465)..(465): n is a, c, g, or t
  misc_feature (470)..(470): n is a, c, g, or t
  misc_feature (515)..(515): n is a, c, g, or t
ccggttctaggtgccatttccctggattaccgccctcactggaagggccatactcacagtctccttatcccccagtttatctttaacctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttnagttnnttcctatcaagccagtangtgctaacnggcncnatantcctgaatnaaanntcagncnagtgacaagctcctggtcntnanatgtcttctcgttaaggagatgggccttttgnggtaaaggntaaaanganngngttctgncatgnttcactattntagaactgcatgacctttantgtgntagctctttgaatgttcttgaaattttagactttctttgtaaacnaatgatatgtccttatcattgtataaaagctgttatgtgcaacagtgtggagattccttgtctgatttaataaaatacttaaacactgaaaaaaaa

SEQ ID NO: 680632 - DNA, 118 bp, Homo sapiens
ggttgagcggtagtacttttgggagacctgtatatcccaaattcgccgttgccactttatcacccgcctgaatcctgggattctagtatgcaataagagatgccctgtgtgcaaagta

SEQ ID NO: 680633 - DNA, 455 bp, Homo sapiens
ggcaggagacccttgggagctactgcaggcctccagggcatacacataggatgcgatcttcgacgcagggcagggagaggatccttcggggccaagagggaccttggaggtgtaaactgagtgaagtacctatgtattggacacaggcaacggaggacgggtatttggggttagtgtctactgctgactctgttactaattcaccacgggccctaggctcaatcgctccctgtctcaggttctcaggctctagtgggtaaaaggaaggcttggactaagctcccacagtgagagtcgagagagttcagtgcaggccccgcgaaccctctggctggaagtgctgtttgcccgggaagcatgatgatgcccaccgccgcgggcgcccgagtggctgcccagtccggtctgcaggcctcgtcgcctgcggagggggcggcgtggggaccaagcggccg

SEQ ID NO: 680634 - DNA, 282 bp, Homo sapiens
  misc_feature (21)..(21): n is a, c, g, or t
  misc_feature (104)..(104): n is a, c, g, or t
  misc_feature (133)..(133): n is a, c, g, or t
  misc_feature (178)..(178): n is a, c, g, or t
  misc_feature (239)..(239): n is a, c, g, or t
  misc_feature (248)..(248): n is a, c, g, or t
cctcaggctccgtgtccaccntccagcctcttctcctccgacaacgaggactcgtcctacagctcagacgacgaggacccggctttctgctgcagacctgcctnacccaccccgtgcccaccctcctgcccanccgagccctgcgctccaagcagcgccctcaacggcatgcccacgntgcttcctgtccagggccacggtggctggcaccggtgcgctcaggccccagcagcagcagnaaatccaantcaagcgcaaagaggccctgagcttctccaaagc

SEQ ID NO: 680635 - DNA, 197 bp, Homo sapiens
ttccatgcttattattctatactctttgttgttcctttcgcgctctccttcacatcctctctgtctgccttctatctccttcaccgtactgtctgtcaaatgacagtagtcaccctgctactcatccgatcttgcatttaggattaggtccagacttccaggtttggctttcaaagccctgcacaactctaaagcac

SEQ ID NO: 680636 - DNA, 421 bp, Homo sapiens
gatccattgttattgcgatccgatgatgttacagtgattttcgattgtctcgaggtttcatccccgtgaatcaactgaacggtagtaatgatggcgtcctcacaggcattagggagtctcggtattgagggtcatctcgtagtcattttaaacagctgtgaactgctttgttagcattcttcagggtgcctttcggagaaataatacaccttgtacacttcaaataagagggaaagaacttgtccacttgctcattgaaagctgtagctcggatttcaccactttcgtcaaccagttctagggagaaaagcttcccttcccctcggaagttgtccaggtacggatctgacttctgttggtaacacgagcacaaatggtccacttggactgctaggagtgaggctggcaatgggcaagtaga

SEQ ID NO: 680637 - DNA, 322 bp, Homo sapiens
tagtctggccagaatagtgaggccccatctctactgaaagtacagaaaaattggctgggcgtggtggcgcacgtctgtggtcccgggtacttgggagtctgaggcgggagaatcgtttgggcccgggaggcggaggttgtggtgagtcgggattgtcccattgcactccaacctgggcgacaagagcagagctctgtctcaaaagaaaaaaaaaattccatcataaaagaaaaaaaattcaattgtaaattccagttttttcagtgtcaacatccagttgtttatgtccagaaaataaaaatacaattgatttttgtaaaaa

SEQ ID NO: 680638 - DNA, 550 bp, Homo sapiens
  misc_feature (24)..(24): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (145)..(145): n is a, c, g, or t
  misc_feature (181)..(182): n is a, c, g, or t
  misc_feature (192)..(192): n is a, c, g, or t
  misc_feature (228)..(228): n is a, c, g, or t
  misc_feature (247)..(247): n is a, c, g, or t
  misc_feature (284)..(284): n is a, c, g, or t
  misc_feature (396)..(396): n is a, c, g, or t
  misc_feature (479)..(479): n is a, c, g, or t
  misc_feature (488)..(488): n is a, c, g, or t
  misc_feature (499)..(499): n is a, c, g, or t
cccccgggagtcccccgaggggtnccccccaaaatggagggcctgccacatgccccngnccngccctccgaagtattcccaataccccgcctcagtattttaaaatggaaggtgatcccctaagatttggtttgggaccaatagnaaagcatatgcagccacccaagatgcaaatgttttnnaatgatatcnccaaaattttaagtaggaaagtcacccaaacacttntgctttcacttaagtgtcnggccccgcaatactgtaggaacaagcatgatcttgtnactgtgatattttaaatacccacagtactcactttttccaaatgatcctagtaattgcctagaaatatctttctcttacctgttatttatcaatttttcccagtatttttanacggaaaaaattgtattgaaaacacttagtatgcagttgataagaggaatttggtataattatggtgggtgattattttttanactgtatgngccaaagcttnactactgtggaaagacaactgttttaataaaagatttacattccacaaaaa

SEQ ID NO: 680639 - DNA, 120 bp, Homo sapiens
atacaatataaatctgtcagacactacagccatcaaaagagagcatctggaattacagccagcttggaagtatacagcaataatgttgcagatggaatattatttagtagttaaggtcat

SEQ ID NO: 680640 - DNA, 640 bp, Homo sapiens
  misc_feature (40)..(40): n is a, c, g, or t
  misc_feature (122)..(122): n is a, c, g, or t
  misc_feature (168)..(168): n is a, c, g, or t
  misc_feature (171)..(171): n is a, c, g, or t
  misc_feature (174)..(174): n is a, c, g, or t
  misc_feature (191)..(192): n is a, c, g, or t
  misc_feature (195)..(195): n is a, c, g, or t
  misc_feature (225)..(225): n is a, c, g, or t
  misc_feature (240)..(240): n is a, c, g, or t
  misc_feature (249)..(249): n is a, c, g, or t
  misc_feature (260)..(261): n is a, c, g, or t
  misc_feature (272)..(272): n is a, c, g, or t
  misc_feature (282)..(282): n is a, c, g, or t
  misc_feature (290)..(291): n is a, c, g, or t
  misc_feature (300)..(300): n is a, c, g, or t
  misc_feature (315)..(315): n is a, c, g, or t
  misc_feature (321)..(321): n is a, c, g, or t
  misc_feature (339)..(339): n is a, c, g, or t
  misc_feature (374)..(374): n is a, c, g, or t
  misc_feature (486)..(486): n is a, c, g, or t
  misc_feature (569)..(569): n is a, c, g, or t
  misc_feature (578)..(578): n is a, c, g, or t
  misc_feature (589)..(589): n is a, c, g, or t
ctggagtgatgctagcagacccagcttagagctcctctcnctctccaaagcccttcgccccggaggaagctccccagcttcagctcaactcacagcctccccaagcaccaccccgggagtcnccggagggctctcccataaatgagggccgcacatgcccgtcctgcnccnaanaacccaataccgcccannatnaaaaatgaagagaatctaagatttggtttnggaacaataggaaancatatgcanccaaccaaganncaaaagttcanaaatgaaatnaccaaaanncaaagtagnaaacccacccaaacncccccncccccacccaagtccctngcccgcaatactgtaggaacaagcatgatcttgtnactgtgatattttaaatacccacagtactcactttttccaaatgatcctagtaattgcctagaaatatctttctcttacctgttatttatcaatttttcccagtatttttanacggaaaaaattgtattgaaaacacttagtatgcagttgataagaggaatttggtataattatggtgggtgattattttttanactgtatgngccaaagcttnactactgtggaaagacaactgttttaataaaagatttacattccacaaaaa

SEQ ID NO: 680641 - DNA, 752 bp, Homo sapiens
accgatgaggtccaccgacctctaccccagaccctcccatacgccaataggctccctctgcccagttgaagtccccttcgcccacagcattcctgtcatccaggcatcatcccaagggtggccccgtgtcctgcaggtggtcaggagaagtgcagcgctctcctcagacaccagtctgatatgtcaccaggagagagcgggcggtccgtcagctgtatgctcttttcattgtctctgtgggacgtcgtgtctggctcctcaatgaagaccttggaaaaagcacatggttgtagaggcggcattcgccgggcagaaccatgtcccaaggacaactggttagctgaggccaggcgtgacaattcataatacgcgacgcgaccaacttgtcgcaactggctataggcaaagggggcgcgaaggcgacagctaaggtcaccaaactattagtatgtcgacgacttgggacaccgtttctccgtaaatagtgtcaagcagcagtcctttgccacgccgccgttggactcttatgcgttatgaagaggggggtctatgccgctctacaatccattctagaacctcttggatacgggtgatcttgataggctctttccaatagcaacgtgtacttgcttccgttaattctgtctctcgtatgaaccggttgacgtcccagaggacctcgtggtcctcaacttatccgttgcttctctgtgggctgtgccaatggggctgaagtgtgaagtaggccccaa

SEQ ID NO: 680642 - DNA, 116 bp, Homo sapiens
  misc_feature (71)..(71): n is a, c, g, or t
  misc_feature (80)..(80): n is a, c, g, or t
  misc_feature (107)..(107): n is a, c, g, or t
catagaacaggtgccacaggaatatctgctggtttctggagacagatgtagatctgtgataatccaccagnagatattcntgcgggacatagaacaggtgtcacagnagccgtcat

SEQ ID NO: 680643 - DNA, 956 bp, Homo sapiens
gcgcggtacaggtgatctgactctctgaggctcatcttgcaattgttgaaatggtgcccggagttgacaatcatgtctgataccagtcagaatccttgtgactggagcagctggtcccataatagtccagtattcactgctgtactagtgatttgcgcaaatcgtgagtcttgtctttggtcaaggatctacgatcttataattgcattgtgcattgtgggatatcaggcccccgatgaatgggtgtcctggcacggtgtgctaatggagatcctgctagatgagatgttgtcccttggccctgcctgtagatagagtgtcatcgccaaggagcataagaggcaagactgtggccttcacatgacctggagtgtgggcattctggtgcgtgctccatgccactgaatggggtaaggccatggagaggagtcacggatttactgaaagtcgaatggtgatcatctttcaagagtcccagagtgcgaggccttagataaatttacggccacgaagtcagttgaaggttgatctgtgggtcgggtaatccagcccaataccaactgtctgactgcttgccaagtcagctccatgacatccccaaggagaacttcagttgcttgactcgtttggaatcacaacgagcttaaagctcaaatggttcttaaaacttggtgtgacggtaatgatgtacagaatgtcatcatctggggacagcattcctcgagtcaatatccagatgtcagccatgcaggtgcactcgcaggaaggcaagggggtacgaggctctgaaaaaagacggggtccggagactggcgcgacggcaccgagtgcggcggtgcaaaggtcaaccatcacggccattttgggaaccccttggcgtcggcggtggcccagggaggggagggggactggacccagggggcgagcacccggaaaaacggggcccaaagaaaaca

SEQ ID NO: 680644 - DNA, 220 bp, Homo sapiens
gccacataacacaacttctccttaatggcacccaccaattcccgctccgccctggtggtgaaactggaacccggcctcgggaagaatcttattaaggaatcaagcaggtcccggccagccaggtccagacccaggatggcatgggggaaggcctacccctcgtaaatgggcacaatgtgggtgaccccgtcaccggagtccatcacgggcactggttgga

SEQ ID NO: 680645 - DNA, 105 bp, Homo sapiens
tgccctttttttatcaggtaagtttgtgtgtattctaactgattgtattgaacaaatatcctagttatttcagtaaaaatgcctgtggtgagatgaacctcctgt

SEQ ID NO: 680646 - DNA, 244 bp, Homo sapiens
tcccggcacgccgtacgattgcgtgatcattgcggtgcgctcggtcatggccgagatgaagcccgatctcgtgctctccggcgtcaatcgcgggcagaacgtcgctgaggacgtgacctattccggcaccatcgccgcggcaatggaaggcacgctgctcggcattccctcgatcgcggtgagccaggcctatatggcgggcgaccgcaccaagatcatctgggactgcgccctgcagcatgcg

SEQ ID NO: 680647 - DNA, 107 bp, Homo sapiens
tcaaggggttagccttctttgtccttgtcctcgctgtccagttatgatgtccagtttctctatcagttttcgctgtcacctaccattatatgataaacgaggggtat

SEQ ID NO: 680648 - DNA, 264 bp, Homo sapiens
gtagatatgagaagctagactttaaagtgtatgtgcaaaggccaggaatagccaaatcacttgggcaaagaggcacaatagtggagagaatgtatattctacaaattttaagatttattatactatagtcaatttactatggtagggcataagcagacatagatcagtagagccgaataagaagttccagaagtagattcatatatataggatatattaattatttgacagagatgctaatttagttgaagaaatgggctttgg

SEQ ID NO: 680649 - DNA, 216 bp, Homo sapiens
ttattcgtgttgcacttattttctaatccctctgtcttccaaagtactcaacctgggcctctaatttggctctgttctcaactcccaattgcaggaacttgaaatcctcaccaaaagcatcattaaagggatagccaaaacggttttggctgccagcattcgagaaatctttcctttgtgtttgggacttgtctgggccccacgagttgaagcatg

SEQ ID NO: 680650 - DNA, 144 bp, Homo sapiens
tgacagcacagaggaggtatagtttggaatccctttatgggaggtcagcaacaaagaagagaaagaacaacaacacacaaaaagagcaagttcaaatccaaggtgggagatggctcctctgtgtgggtaccgatgctcgcaatt

SEQ ID NO: 680651 - DNA, 151 bp, Homo sapiens
gtagatactatgatgtctatgatgtctatgatgtctcatgatgtctcatgatgtctcatgatgtctcatgatgtctcatggatgtctcatggatgtctcatggatgtctcatgatgtctcatgatgtctcatgcatgtctcatggatcatg

SEQ ID NO: 680652 - DNA, 1491 bp, Homo sapiens
gcagcggcggcttgaggacccggggagacctcacgaatcgacccatcaggacgccagaggctgctatcagatggtgaccaccttctccctctaacacattcttcccgttcttcacaaactggcccatgtcagacgaagtgctcaaggtggtgagcctgactgcccctggctgctgccccctgtgactcccagggtttgctctatcagtggtggctggctggatgtgcggcggtggatggcatccttcgtgcttggaggagctacggagacaaactctccctgtgccccccaatgcaatactaccaatggacttggctagcatgattggacatacaacacgctgggcatctgaaggagccaagacccctcactccaggaacactgattgacgtgacggagaatgtgcggtcagatgtgctggcaggaagtgccatgtcagggactggccattccggaagagccaagatgtggagagaaggtaggcagcaagaatgaaggaagctggccatccggagtggctaggtcgacatggccccaattggcccacacacaagttggcttggtagagacgtagccctgcacgccacagggcagagaccaggagccaatgccaaatggacagcagacgccatggagcagagcccccttggcgacggcttggcatagagaccggaaacctaggatgatagcaaggacaaccaatttgggactcaaattgacactaagcaaagaaccattatccatgggacacaaggaataggatcactggggacattttgggaaaccccttgagcagttggagaaaggagggacccagaaggtaaaccatagggtgcaagggagctgtagctagacgccttgagcgaggagaaccatatggacgaagtatggacggagggtctgggacaaacgagagaacatcaaaaatccaagagaaaaccaggagttggccgaacggacccagcgaaacaacccgtctgaggaccgaagaccaacatacaccaaaggaggcaacgccaagaacggcacggcataagcgggacacccatgaggaggtcacaccccaatggaagataacaaacgaataggatatggacgagactgtgacaatgaggaaccccaggcgcaccggccagcgggcggacacacacgagggtagccggcagatccaaaacggcccccctatcatattcagtcgaccaaatccttacacgtgtgtagcaatgaagataccggaaggatcaaccacagaaaagagcctatgtgtacaactgtgaagtatatgaattcatttcccagcaagcagtgaggagacgaggagtataacagagacgaataaagaaagtagaaggagacacctgtgatgaaacaacaaagtagttgtacaaaaaagagtcatggttagaacaaaatcaaaaagaatcaaattacgtagaaaaaaaacaaatggctgagttagtggacaatagatagaaaaacaatgggtgcgca

SEQ ID NO: 680653 - DNA, 801 bp, Homo sapiens
  misc_feature (1)..(1): n is a, c, g, or t
ncatttgtactggcctgaaagttgttgtcagacgagtgtgaagggaagtgatgtggaccacttctggagctggcccgcaaaatctcctaaaagatcatccacgctctctccctcatttaccaaatgcatagagaacatcaaaagacttcctacaatgttgggttagtcaatgaaaagctactggggtcctaaaccactgtgaatcagaccacctcactcatccttctgtcgcaaatgaaccttgcgtgaatacaaaattaaattttatttctttcttatctcttatttttttctgtctttttttttctttttttttagacagggtctcattctgttacctaggctggagtgcagtgcctcattaaagccttgacctccccagcctaagtgatcctcccacctcagcctcaaccggaggttgggaccacaggtgtgcaccaccaaacttggctaatttttttttttgagagataaagtctccctatgttgcccaggctggtctcaaactcctgggttcaagggaatcttccctcctctgcctctcaaagcactgagattacaggcatgagccccgacattcacttaagttttcttttccacaactggaatttgggattagtgccttacaccacttaacttatatggaccacatcattcattcccgtcctcacttcgtgccttttcaaactctaaagaaacccccttctgccaaccaaacgccaaaacatccataaccactcctgatatggcttacagaaggctatatagttaacaaacaggcgttatacatgctggatcgat

SEQ ID NO: 680654 - DNA, 428 bp, Homo sapiens
gcagcagcaggctggaagtaggagggagagcaggtgccggccctgccaccaagtggagagcgggaggggaggtggggagacgaacatcacagagcagccagccctggttcactccgggcagtttcttctcaagctccttccctaggagcatggtggcacgtgcctggtggtctcagctactggggaggctgaggcgggaggatcgccagagcccaggagttggaggctgcagtgagctatgcgggtgcctctgtgctccatcctaggcaacagagtgagaggctgtaaaaaaggaaaaattccttccctagagctagtatcctaaagcggcagagctagcccagacctcatgggtttccttgtcctgggggtgctttacctgaatctgggggggtgcagggagtgtcgctcccagtccagaggcctga

SEQ ID NO: 680655 - DNA, 1770 bp, Homo sapiens
  misc_feature (1255)..(1255): n is a, c, g, or t
ggtggtaggaggcattgagagggagtcggggtggacgcgaggagccgggggcttagaacagaggtgtagcacagcgtggtagattgatgggaggtctgtagtggtgccagtgagtgttgtctgtcccgggtggagagcaccagggctgaatgaatcggagacatccgagtccatgactatgctgaaatgatcactctcatgcacaacggagctgatcgattgtggtgagtcaaggatctatcgaaggtggtcttggactgcgtcgaggaagacagtcataggatcacaggcagtgtgtatggatagcaataacgtcatcaagagagtagcaatgaatgttctgagggcacagaaaagaagaatgtgtagctccagggagcctcggaacagcgatccgcaatagggcatcatagaggcaagcgtcgggggcaaggcagtcagcaacacagggaggaccgcgacaatcggaccgacagtagtagcgagaaggcgcaggtgggaagttagcgtaaggcgggcagagtggtagggatggcctggtcaagatcatacgagcagagagggagtggcttgaaccgagaatggggtgacaaggggggagtggctatagggctatgggtggaggctaagaatggatggggcaatatatggggcagacgaaaggaaaaagatctatgaagaatatatcaggttaatatatgcaattgtcaataacaaggggagagaaaagtgtttgagcaaaagcaaacaggccaagccgaagggaattcattcccaaagcgacgaacacagcaactagagaagcgttcggtacacgaattacgagacagatgtgatgagagttgaggccccgggggggaacccgaggcgtgggttctagaacggaacaccgggggagttacaccacttgggggggcacccaacaataggacaatagaccattgcgatgcagcgaaacttagatgggacgctaacacaaccattcggtgcggaacagagagaacagcagcacagaaacatcgacaggaaggaacaggtccgcgccccaagaacggaaagacaattgaacttagcacacgaaccaggggggcgactaaacaaggccagaggggcaccataggatacaatggggggcaaccgctccgcccaaacacagaggggcaaccctagcaaggactggaggaataaaactgaacagcacaagaccgggagacgagagacatacacgacagtcagaaaagcacatgagcagagnagaacccacagaacagccgaagcaagcgaagagacaatcagaggaaacgagcacaggaacagcagaccacacacaggaacagagcagggacgaacacaagccggagaggcccgcaggggacgactgagacaggaggcgaaaacataggacgaacaagagggacagagaaggacgaaccgaaggaaacgccgagaggaaacacggcggagaagagcaagacacagtggcggacacggtacagcagaaacagagagagacagaggacgagaaagaagaaaagcagagaagagagacgagggacggcgcaagagcacagaacacgacaaacggcgcagaggcccgaagaaagacacagaagagaggaacaaggacatagagaacaaagagagaagaaagagtaaagagaagaacacgaccaacaatagaaacaagacgcaagagacaagcacaagaaaaagcagaaaagagaacgactaaagacgcgaacaaagaggaagcagcgtcgcgaagacgaa

SEQ ID NO: 680656 - DNA, 846 bp, Homo sapiens
  misc_feature (12)..(12): n is a, c, g, or t
  misc_feature (125)..(125): n is a, c, g, or t
  misc_feature (128)..(128): n is a, c, g, or t
  misc_feature (138)..(139): n is a, c, g, or t
  misc_feature (145)..(145): n is a, c, g, or t
  misc_feature (154)..(156): n is a, c, g, or t
  misc_feature (176)..(176): n is a, c, g, or t
  misc_feature (181)..(181): n is a, c, g, or t
  misc_feature (204)..(204): n is a, c, g, or t
  misc_feature (219)..(219): n is a, c, g, or t
  misc_feature (405)..(405): n is a, c, g, or t
  misc_feature (422)..(422): n is a, c, g, or t
  misc_feature (462)..(462): n is a, c, g, or t
  misc_feature (502)..(502): n is a, c, g, or t
  misc_feature (509)..(509): n is a, c, g, or t
  misc_feature (518)..(518): n is a, c, g, or t
  misc_feature (553)..(553): n is a, c, g, or t
  misc_feature (560)..(561): n is a, c, g, or t
  misc_feature (572)..(573): n is a, c, g, or t
  misc_feature (575)..(575): n is a, c, g, or t
  misc_feature (582)..(582): n is a, c, g, or t
  misc_feature (588)..(588): n is a, c, g, or t
  misc_feature (653)..(653): n is a, c, g, or t
  misc_feature (655)..(655): n is a, c, g, or t
  misc_feature (664)..(664): n is a, c, g, or t
  misc_feature (671)..(671): n is a, c, g, or t
  misc_feature (676)..(676): n is a, c, g, or t
  misc_feature (696)..(696): n is a, c, g, or t
  misc_feature (708)..(708): n is a, c, g, or t
  misc_feature (716)..(716): n is a, c, g, or t
  misc_feature (720)..(720): n is a, c, g, or t
  misc_feature (727)..(727): n is a, c, g, or t
  misc_feature (730)..(731): n is a, c, g, or t
  misc_feature (770)..(770): n is a, c, g, or t
cagagctgctgntaatgtccagcaggcctcacggatgtggagtcagccccaaggtgaatccgtgtgtccctcttgaatgccccagggccaaacctgaagctggtgcggcccaaagccctgctggnccnctgcttcctnntcattnctgttgttnnntgctcctgctgtaaacaaanctccntcctaaactggcaggactgtgangtgccaagtcctcantcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctccaanaggagttcaactgggtntgagacatcaaggggtggtggtgggagccccccttggganaggacccctgggaagggtgtttttcctttgagggggattntgtgccncagcagggntcagcttcctgccttccatagctgtcatggcctcncctggannggaggggaccnngngaccttnaggtgnatggggacacagctcctggcttctcctggtgctgccctcactgtccccccgcctaaagggggtantnagcctcctntggcccncaacngttagggcccaactgtgggntgcaggggaganagccagcncggngtggccnttnnatgaccccccagcctggcagactggggagctgggggcanagggcggtgccaagtgccccatcttgccatagtggatgctcttccagttttttttttttatttaaccccccccttc

SEQ ID NO: 680657 - DNA, 1094 bp, Homo sapiens
atctccaagaaatgggcagacccgagagcatgcccttctggcttacacacatgggtgtgaaaacaactcaattgtcaggtgattcacaaaatggattccactgcagccacccatacagccagcaagagatatgatgtacatagattaaggaagtcagcacttcacattaagaaacatatggcctacaatacaccgaacaccagtagacaatatgatgcccattatcatggattggaatggtgacaacaatgcatgagagacaaagatgctaacacatgcactatggaatatcacaggagactggaaaagtaaaacgataaggattggcaacggccaggaggaaaccacagcatgcaagaaggaatccagaaaaatgcatcctacacaaacaaactcgatccaaactgaacaaaccatagacgccggaacacaaccaggaaagacatacaaaaaggagagaaaaagagaaaatgtaaccatgataggaccgaagaagagaaaacagagagataccacaaaacacaaaaacagcgagagtcacccaaaagacacccaagaaaaacaaaaacaccaggaaacaataaaaaccgaacaaaaagagaaccaggcaacacataacgacagatggacgccccccacacaggagagaacaaaggagcgaaaacacaaaagacaaacagagaggctccgcaaaacagaatagctccaacagggagaccaaaagacggagaccagcacaacagacgcaacaccgaccccaccacgacaaaaagacagaaggcacaatccagaaccaacacaggacaaacacacccgaagaaaaacaagaaaaagatgccaacaggacaacagcaagcaaacgcaaaaaagaagccacacaccgagcacacagacggaacaaacagcgacaaatacaaaacgagcagcacaggagaagacgagagcaaaacgagacgaccccaaaacacacgcgaagagaagaaaacaaaaaggaacaacgaacaaggagaaacgccggaacacacgaacaaccgcagagagcaacaagcaagacacaaaaaaaggaggaggacgagcaaaaagaagaagagaag

SEQ ID NO: 680658 - DNA, 529 bp, Homo sapiens
tcagtaaagagggggtttcaccatgtgggccaggcgggtctcaaactcctgacctcgtgattcgcctgtctcagcctcccaaagtgctgggattacggggtgagccaccacgcccggcccaaagaaagatttataactaaatatatagaaaagaataattcccatgatttggttttggtaaaaagaagtagggatggtttcctatatattttcaattatgaagtcctgaacatattgggggattttaaagggcctcaaggctaattttaaatatactggcaaatacattataataaaataatacaaccaaatcaaaaagcagccatcttaaaaactggaaattcacaaaaggagctggttctgggctacatacagagggccaacatttaacctggaaatgatatttaaccggtttactaccatagggtaatattcacgcacttcctggggtccaatagagggtggtggaatcaatggtgatcctttaaaaacaaaggtcattacaatctccagaattccccctcaaacc

SEQ ID NO: 680659 - DNA, 94 bp, Homo sapiens
gacaggtaataaaaatgtgggttttattagtccactacagtcacaatacaatcgtcatagatttccccttctgtcgtcttctcgcaacagtata

SEQ ID NO: 680660 - DNA, 225 bp, Homo sapiens
atcactcaccagaaaaggcagaagcatcatctgacttcattattagcagtaatattattcccagaattattattcttaccggctgccagtttatgcacaatcctattgtagctctattatgtgtcatcatttactatctcaaacttgccccatgggaggcagagaatgacggatgcagcagagactgcacgattacattacatgtacgcactttttactgtgaga

SEQ ID NO: 680661 - DNA, 827 bp, Homo sapiens
  misc_feature (35)..(35): n is a, c, g, or t
  misc_feature (105)..(105): n is a, c, g, or t
  misc_feature (113)..(113): n is a, c, g, or t
  misc_feature (141)..(141): n is a, c, g, or t
  misc_feature (147)..(147): n is a, c, g, or t
  misc_feature (154)..(154): n is a, c, g, or t
  misc_feature (228)..(228): n is a, c, g, or t
  misc_feature (271)..(271): n is a, c, g, or t
  misc_feature (280)..(280): n is a, c, g, or t
  misc_feature (300)..(300): n is a, c, g, or t
  misc_feature (565)..(565): n is a, c, g, or t
  misc_feature (568)..(568): n is a, c, g, or t
  misc_feature (572)..(572): n is a, c, g, or t
  misc_feature (588)..(588): n is a, c, g, or t
  misc_feature (605)..(605): n is a, c, g, or t
  misc_feature (631)..(631): n is a, c, g, or t
  misc_feature (637)..(637): n is a, c, g, or t
  misc_feature (655)..(655): n is a, c, g, or t
  misc_feature (667)..(667): n is a, c, g, or t
  misc_feature (679)..(679): n is a, c, g, or t
  misc_feature (727)..(727): n is a, c, g, or t
  misc_feature (759)..(759): n is a, c, g, or t
  misc_feature (800)..(800): n is a, c, g, or t
agaactttattggaaaaatgtccaacaagttatancactagcagctgatggggctgccaggtgagagggggagcacctgaggctccatgagaagacattggagtngtgcagtncagcatctgcctctggggtcagacaatncctttnatttgcnggggtaagaggagtccccacagaaacacccctctctgagggccagaggcaagaggtggggcagccggggatgcncagagtcctgaaacaggtgaaagggggcccccatttgggaccnaatggagtngggtacaactagtgactttnccctggaccggggaatggaaggagaaaccccacctgaaacccactccccaggcccaggggcacagactctgaacagacctacctcctggctctgctcacagtggaaagaggatgggtaccaggcctgagattgtgggagttgcaatcccctctgggagtctcgggcagaccaccaccttgggctccccctgaccccatccctatccccagttgttagtgcatctctcttctgggtgtgtttcttcactcaaacgtcgatggtgtnganaganggggactttttctgtnttgtccccactggcctnccctgaggactctgttccggcccctntccctnctccttgggattgttgtnggagtaattgtncttgaagaagtnatactgacggcagaacagcccaattacagcagcccacatgagctacancaccacaatgatgaacacttccccagtttgcngtggccgctctccatccagaacttccactgtgaagtaaccngggcttgaactgtttgaagggagcggg

SEQ ID NO: 680662 - DNA, 131 bp, Homo sapiens
agtaaagactagcaagcagcggaggctgtagtattcagtgaacactatatatcctttacggtcctccatcttcaagaaaagtagaacggactacaggtcttgtagacacacacacctcaccaagctcagac

SEQ ID NO: 680663 - DNA, 223 bp, Homo sapiens
  misc_feature (24)..(24): n is a, c, g, or t
  misc_feature (47)..(47): n is a, c, g, or t
  misc_feature (78)..(78): n is a, c, g, or t
  misc_feature (82)..(82): n is a, c, g, or t
  misc_feature (192)..(192): n is a, c, g, or t
tcgtgaagcccattttcagtcggnacatgaacgtggccaagcggagngtgcgcgagttctagcgcggctggtatcganaggngccgaacactgtgcaccaattccagctggacataacattgtgaaaatgggacgggataaagtccgagaaatgtttatgaagaatgcccatgtcacagaccccagggtggntgatcttctggtcattaagggaaagatcgaa

SEQ ID NO: 680664 - DNA, 157 bp, Homo sapiens
tgtgtaacattttttttaaattagccatgcatagtagcatgtacctgtaatcccagtacacaggaactgaggcagaagaatcactcgagtccaggaatacgaggctacagtgagctgtgatcatgccactgcactcccagcctgggcaaacagagtg

SEQ ID NO: 680665 - DNA, 1068 bp, Homo sapiens
  misc_feature (937)..(937): n is a, c, g, or t
gtgtcccccagtagccttcatgtttatcctagaccctgcaaagcaggtgggcttccacgagagagtgcaatctccctccatagagttgcgcgtgctcctatgccgctaccaatgttgtgtgaactcgttcgctcaggcagattcgaatgctatgacgtcttagcaacaagggaggacgtcagaagagacctagagccgtgaaactggaagtggttcaggtttgcggtcgagagacttgcatcctggaggaggcatctggctggacaagtggtgaagcaggtcagaaaacatctcactattgagcccacgtaaggccacccacatggggcctgagacaatctccagatagcctcgaagaagtcgtctgaccaggatggaggggtatcacgagaagggtcccgtatgggaatacccccaagtatagaagcgaaggcaagcatatggtctgggggaatcgtgggacgacaagtcttaaaagggcaacatccaggagggtgagattgcgcgtgaatcttattgacatactgcgaggcaattgttgggtgggaaattgattattccctctaaagtttcgggccacttgaaagggtggaggagaggcactttaattttgggagtttagacggatgaattaggctgtgggttggagggattgagggaatttgggtggattgggagagaaggatcgtttggaggagataacccccaaaggggtggaagattaaacgctggattagggggtttagagagaaagggggggtttcaatcccggaaggggaacgattctccccctttaagggggccttaagtttctcaagaatcgtattcatgtaggggggaatagctcatgtgataaaaagtacgctggaattttttcacttacaattgtaccccatgtagtatgaaggtttgtcttttgggaaataattacaatggncagattatcggggtggatggatttacggagaaagagagagaatttaatgaaaccatatggtgtgattagaccccctgggtgagtctatttgaaatggggatttttacaggagttggtaaaggctccccttg

SEQ ID NO: 680666 - DNA, 276 bp, Homo sapiens
  misc_feature (142)..(142): n is a, c, g, or t
  misc_feature (246)..(246): n is a, c, g, or t
cgctcggggtggggcctcgcgccctagtgccggccggcctcagcccggctctgcctgttgctccctgcagtgccttcggcatggccctgctctccccgcgtgtgcgccaggcctggcgtccccggagacaacttgccctcgncatagggacgtggggtgcaggcgccaacatcagtggcagcagccagggccgtggtccagtcccacttcgggatggagtgggccggcgccaaaccagtcactcgnggaggaatgcggaggagcgctcattccatt

SEQ ID NO: 680667 - DNA, 276 bp, Homo sapiens
agacgacgttatctggagccactgtaagaggagcatacaaaggaggcgtccaggaacttggcagagcaacagcgccggcaccgcgagcgactcctacagtcaacgagcctggcagacaagcccatctgaaggactagaggcaggagctggatggacatgaccacaacaggattaaccccaagagcttcttcatactgcatgacatcaacagagatgcggacctggatgagcaggagctgctggcactcttcagccaagagtggagaaagtgtacga

SEQ ID NO: 680668 - DNA, 1047 bp, Homo sapiens
tggcaccgcgcgggacggagcttggctgttggtcggtgggttccctgtgcggtggtgtgccatggaggatggagacacatgttggatgcagctccgtgggctgactggggcgatggcctcagcagcgcgagcttgagtgcggccgagcctgctggctgccttcaccatgctgtggtgggtgacgagacgtggcccctgctggcagtcatctggatgtgtgaggagccagcactgtgcctctggcctagcattgtcgtgaagctgggctgaagtgacgcagcaccatgtgaagactggactggtgctgccacctagagaacggacatagagagccagtacccactgaatgtgcgagatcagacggccagggtgtgacttggcaacgtgtgcgccagcaagaatgtgtgtgcttggaggccagctgagcccggaggagcgcacccaccataagcacgtggaaactcaagaaaacttggctgtccgcatctggacgacccatgcatcaaaccgaccaaaacaaagacactgaaaggtattgaacgctgtggcacacatacaatgcttcagtatggagtaggcacctgcactcttgagcacatacctaaacaaacaaccaaagaatttcacacacacacgtatactctaccttaaactcttggcacgacgagtcagtttcgaccttggtacaaataaaaaaaaatttggactccacaaacaacatcgactgagtccaacgaagcgggcaccggcggcttatcccattgtctccacacgacttgcatgtccacgttggtggcacacactgtccttacacccatacatagccaccagcgctggcttggcgcgctgtccttcgacccttccaatctggccttcggcctaatgcaccgaccccggttcaagacacaccttccatcggcgctcttgactcccttgagcccatgagcgaaagccgggagctcttagccagcttgcgaggtagcctctgcattccctgcccacttcgcaagcagcaggtctcgttcccttccacacacccctgcatgc

SEQ ID NO: 680669 - DNA, 251 bp, Homo sapiens
  misc_feature (133)..(133): n is a, c, g, or t
tcacactggttgttgatataatccgtcacactggttgttgatataatccctcacactggttgttgatataatccctcacactggttgttgatataatccctggtcctggacttttatttgtatggagtgtttntaggacatattcaatttaatgtctagtgatcagtcttcaagattttgcacagaaaaggaaaccaaaaagaaaataaaaagacaacttacagagtgggagaaaatagtttcaaatgatg

SEQ ID NO: 680670 - DNA, 154 bp, Homo sapiens
cgatcctctccgaccctaaagccaaaccatcagccatcagcactcaccatccatcaccatccaccattatcaccaaccatcatcaacgtcatcaccatcaccaacaccagagcatcaccaacatcaccaccatcatccccaccatcatagccac

SEQ ID NO: 680671 - DNA, 440 bp, Homo sapiens
agaatccctcaaatatgcaagtggtagatggtaggctctgcctcacgggctatctaggggagcaacagtcggtccagagtggacgagagggggacagtagcttcgtcagagctttgtcacaaaaggagatggaggggaagattcaccggacagctggtgaggatcatgttcctgggaacgaaggccacgaggagcccaatcattggagattctgagctggggccacgatcaagagtctcacagaaagcatgtccttcaccaattgcctgtgacatctactgtgcctactgaggccacaggaccctttggtcctgccctggcatgacctccctggcggtgttcctacagacgagaagaggctctgtgcccagatgccaggttgggcctggctgtcttctcctagagcaggtggagcaagaggctggttatcctaacagtgt

SEQ ID NO: 680672 - DNA, 672 bp, Homo sapiens
tccgcaccccgggtagtgtagtgtagagtgagagagagagagagagagagagagtgagagagagagagacccactgaccgccttttagacttactgtctttttttcagagccccatttcgtgtgtcacccctagtcaacccctctctcttcttaccttgctcgttaacttcaccatgttttttacaaccgttccccaccctgtctttttacttaagagattcctgtttttctctttctttcggaaattcttggaccccgtcgattctttccctaagctttctcccttcccttgtgtgaactttttttctgctttttaattgtcccgttccgctttctaataaccctcccctattacttttctttccctcccagaaacccttcattccccccttttttttaccagaaaattgatttttctccctatttgaccttttgtctcttttttttaaatgctcgaactttcaatcttctacccttttttgcacatccacctccaaaaccccttgtttttgtggtcttcctctttttgtttaacttttctgttggggttcaccttttttttttttccccccttgttgattctttttctttctttgttttttaaggtttttaacccttttggccctgtcccctctccttcccctcttttttccccgttttacattcttgcg

SEQ ID NO: 680673 - DNA, 682 bp, Homo sapiens
tgggacccgcggttgtttaaaaccctgagggaccctggaggggggcccccactctctaccttcttccctccgcagtttgtgacctccgagatggcacaaagtgtgtcgctgtttttgggagggcctcccgaggctattggcagagctgtgcgcccagttaatgcgcccggaaaggctcaccgactggcggctcattggccagaacacctggaagggcgccaaacgccgccgcccggtgccccctcggcgggagaactcacttggcgcatttttacgctgctgactgcttcgcttaaacagaccctgtggactgttccacaaccactaccattttgacagcacgcacgtggacgcaacacctttctagcgctccgagttaaacaccttctcctgtgcgccaacatctgccgagctgtgcgttcttaaccagcggcaagtgcgcccctctcttacgctaacagacccacacaacccttgaacagactaagtgcgtcactccctcaagcctctcatatactataaccctctttgcggctccccagtgcgtgcaccgtgttaaaaagctggccattgaaggcactcatgcatctcaacacacccgggcaggcctcttatgcgctccagtgtcgcgaacgcattgccggcgctcaaaaaggccaccctctggccagtcccgttcacg

SEQ ID NO: 680674 - DNA, 302 bp, Homo sapiens
tgctcgactgtggccgtgtatcatacccatcatgtggtactgatatactctggtagatcaacaccctcgtccattcagcgtatatttcttctattgtgcttctttgcgggactcgaatacgataacttatgtactgttccatgtcatgtctgtatcatacagttagtgttgccagtgaaacgttcccagatacaaagaattgtgcttttaattccatttcacaatctgtttttttttttttgtgtcttgtgtctgaccaaaatttctttcgtgcacatgaggccagtataggcaacgttcac

SEQ ID NO: 680675 - DNA, 1715 bp, Homo sapiens
caattataccctagtccatccccttaacacccttccctcacatcagcccgaactgatatttcgctattcgccttacacatgtctctccggatccgctccctagcccaaccctacgcgcacgcgcgctccctctgccaccctccctctcaccctcactcgccacctcacctccactcactagcgctacactcaccacctcccccatcatcaccatcacacctactacctcgctacacctccccaccccacacaccccccctacccctactccctccgccacccaccctacaccccccacaccatcacccactcacctcccgcacccacacactacccccccgccaacaccaccatccatccaactcaccatacaccacctagcacaaactccaccgccacccgcacccacacccccaacccacaacacaccctaactccgccctctctcaaccccccaactccactatcgcccaccacacccctaacccccactcccccgcctcccctctacatcccactctccacccacacccacaccttccccataaacctcccccaaaccacctacacccccaaaacaataacatacctctccccccataaacctctagcacaatacaacccaaacaccacccacacctaccaaaacaatctgccgacccccacttaacaccacacaccactacaacaccacacacaaccacaacacaaaccacaccaccacaaacaccacaaacactacaccactctcccccccgcatcacacctacgctcatactcatacatcacactttctaccactcacggcgccgccgtacgcgcccgctcccatcctctgctccttccgcagcctcacatcccccaacttcaaccatacatctgtcgctacctcagcggctcctcgctccacccctatcatcccgctccctcccagcagccggtcgcagacacacagcacgccatcgaggtctcttccatcctcatccaccctctcagcgacaaaacaccacaccacgccccggcgtgctcacgctccaccactcatcgcactctcgcagcaccccgctcgcacgccgctcgccacctctaccgctcctcccacctccactccaaccccctccaactcgcagccaccagccactcactcccgacccctcgcccaccctcgtccatcgccgacgactctcctcgtacactcatcccagctcaagacacaccacagagatcaaccgcgccggcccagcgccacacagaacaaccacggcagactactaactactccctctactcatgctcaccataccacactaatgataccagcaacgagccacacccactccccagaccacccaccacacatacccaccacactaacaccaacaacgatcaaacataacaacaccaccacccaacacccacaccaccacactaccaccacaacccccaccctcccaccccccccccccccctccacacacccacacacccacccgccaccaccacgccagacacacacccagcaccaccccacaccctcccccccacccgcccaccactaccccaaccacaaccccacccaccccacccccctcacacaacccccgacacctgtcccccaccccaacaaccacctaccccccacccccacccacctacttcacccagaccccggacgcacaaaccacataaaaccaagaaacgaccaaccaacacaa

SEQ ID NO: 680676 - DNA, 1171 bp, Homo sapiens
  misc_feature (584)..(584): n is a, c, g, or t
  misc_feature (770)..(770): n is a, c, g, or t
  misc_feature (781)..(781): n is a, c, g, or t
  misc_feature (836)..(836): n is a, c, g, or t
  misc_feature (888)..(888): n is a, c, g, or t
  misc_feature (985)..(985): n is a, c, g, or t
  misc_feature (990)..(990): n is a, c, g, or t
  misc_feature (1005)..(1005): n is a, c, g, or t
  misc_feature (1033)..(1033): n is a, c, g, or t
  misc_feature (1073)..(1073): n is a, c, g, or t
  misc_feature (1076)..(1076): n is a, c, g, or t
  misc_feature (1104)..(1104): n is a, c, g, or t
  misc_feature (1171)..(1171): n is a, c, g, or t
gagaatgcttgaacccgggaggcggaggttgcactaagccgagattgcgccattgcactccagcctggtgacaagagcaaaaatacatctcaaaaaaaaaaaaaaaaaaaaatgggggttttccaattttttgccaaaaggccccattaaaaaaatttccaattccagtggcgagcaccatacttttgtgtcaaccggcacattcaccattggttgtcacgtttcgtggccggcccaggggccacatattttcttccaacatataattaaaaccgactatatttggaaaaccccaagacgccaaacttttcccttggacaagtgtgaaaacgattcctctttaagaaatgtggaaccaccggaaggttcgcccatttttccaccaattctaaatccatatatgcgtcttcggcacattacttaacgttgtgtccaattaaggacagagagaaagagaattaaagcagcggtcgtctggattggggcacacagcgcagcaccgtccgaattaactcttctgggtgcgcgcgagataacaattggacatcttattatttagaggaacttccttaaaagagatctcnctcctcaaaagagggtgtggctcgatgctttttgcgaccgaacgcgacttttccaggacaaggggctgccaacgagtgtgtacactctctactttactacaaacttctgtcgtcgtttctttctaatacccaattaaatcaattcaggggcgggagcggagaattaaggacttccaattaccattntaaaaattacngtctcgcacaacaacaacacacaaaaaaaagaaattgtgtgcgcggggccgcccngagcccagaagaagagtatttacaacacccatctctgctgtgggcgccgggngcgccaaatagggatgagtgagcaactgtggcgcacagcttctcgccccaaaggagagccccgtgcgctcgagagtcgcgtggcgtgtccgcccccnaaaanagaacccggcagcgnggcgctgcgttctcgagaacttccctgngtgctttcgggcttttccgttcgcaacggtcccagtctcnccncgctgctccgctgcggtgcctcggcggnaacacacaacagaaaggcgccaatcgaatcacgctgccccatcatagcaagctagacagaacaagan

SEQ ID NO: 680677 - DNA, 162 bp, Homo sapiens
ctggtccccgccagcgcgctttcctgtactgcaacgggctaaggcacactgctggcggaagtgatggcgcagggtgctggcatttgagaaaccgcaaagctcggcaatctgctcaacgctcagccggctgtgggtcaagtgctgcgtggcgcgctgaaggcg

SEQ ID NO: 680678 - DNA, 725 bp, Homo sapiens
  misc_feature (11)..(11): n is a, c, g, or t
  misc_feature (24)..(24): n is a, c, g, or t
  misc_feature (38)..(38): n is a, c, g, or t
  misc_feature (50)..(50): n is a, c, g, or t
  misc_feature (67)..(67): n is a, c, g, or t
  misc_feature (86)..(86): n is a, c, g, or t
  misc_feature (88)..(88): n is a, c, g, or t
  misc_feature (94)..(94): n is a, c, g, or t
  misc_feature (98)..(98): n is a, c, g, or t
  misc_feature (109)..(109): n is a, c, g, or t
  misc_feature (120)..(120): n is a, c, g, or t
  misc_feature (144)..(144): n is a, c, g, or t
  misc_feature (146)..(146): n is a, c, g, or t
  misc_feature (149)..(149): n is a, c, g, or t
  misc_feature (179)..(179): n is a, c, g, or t
  misc_feature (205)..(205): n is a, c, g, or t
  misc_feature (217)..(217): n is a, c, g, or t
  misc_feature (226)..(226): n is a, c, g, or t
  misc_feature (234)..(234): n is a, c, g, or t
  misc_feature (250)..(250): n is a, c, g, or t
  misc_feature (269)..(269): n is a, c, g, or t
  misc_feature (272)..(272): n is a, c, g, or t
  misc_feature (330)..(330): n is a, c, g, or t
  misc_feature (381)..(381): n is a, c, g, or t
  misc_feature (402)..(402): n is a, c, g, or t
  misc_feature (424)..(424): n is a, c, g, or t
  misc_feature (437)..(437): n is a, c, g, or t
  misc_feature (443)..(443): n is a, c, g, or t
  misc_feature (460)..(460): n is a, c, g, or t
  misc_feature (482)..(482): n is a, c, g, or t
  misc_feature (489)..(489): n is a, c, g, or t
  misc_feature (514)..(514): n is a, c, g, or t
  misc_feature (521)..(521): n is a, c, g, or t
  misc_feature (525)..(525): n is a, c, g, or t
  misc_feature (530)..(530): n is a, c, g, or t
  misc_feature (556)..(556): n is a, c, g, or t
  misc_feature (558)..(559): n is a, c, g, or t
  misc_feature (561)..(561): n is a, c, g, or t
  misc_feature (564)..(564): n is a, c, g, or t
  misc_feature (572)..(572): n is a, c, g, or t
  misc_feature (578)..(578): n is a, c, g, or t
  misc_feature (581)..(581): n is a, c, g, or t
  misc_feature (583)..(583): n is a, c, g, or t
  misc_feature (597)..(597): n is a, c, g, or t
  misc_feature (619)..(619): n is a, c, g, or t
  misc_feature (634)..(634): n is a, c, g, or t
  misc_feature (643)..(643): n is a, c, g, or t
  misc_feature (649)..(649): n is a, c, g, or t
  misc_feature (686)..(686): n is a, c, g, or t
taactttaaanaaatttttattanaaaaaggttgtaanaaaattggatanttctctactttgtacanaattattctcactctccananaaaggntgcntaacttctcanctggggggggnaagcactaaaatcctgattttaananaanagtagtaaaaatgccttagttatttaagtngaaagcagttcactggtacatggctnttgtacccagtntcaggaatntacaaatnttttttattcaaaaanacaaaaaaaattatctgtnggnatggacaatgaaagcagtaaaccattatatattttgtcaactgaaaccagtaactganggttatagtgattttcagccagcctttttcttcattttctccaactgactnctctgaagttattggggaggnacactgccttgggcttcctgtnaaagttcattaanaaaggnaaagcactagtttaggngttagaacatgccaccccccanaccaccncccattccacccattgcacccattncagggtncttnttttntttaggaatttctgttaatacaactncnncngtngttaaaanaaaggncanancagccgcctccaanaaagcagttctcaaaacctttnttgggttaattattnctttttccnccaaantcacaaaatctccagccatagcatcataaccaacttntgagggactttgcataattttctcaactattaaagatcc

SEQ ID NO: 680679 - DNA, 1122 bp, Homo sapiens
gcgtgagtgtgtgtgtgcctgtgtgtgtgccctgtgttactctatatgtgtgtgtgcctgggggtactgagggctacgtgggggcgaagcagaacttgccatggcagcagcggaggaagaagacgggggccccgaagggccaaatcgcgagcggggcggggcgagcgcgaccttcgaatgtaatatatgtctggagacagctcgcgaagctgtggtcagcgtgtgtggccacctgtattgttggccctgtcttcaccagtggctggagacccggccagaccggcaagaatgcccggtgtgtaaagctggcatcagcagggagaaggtcgtccctctttatgggcgagggagccagaagccacaggatcccagattgaaaactccaccccgccctcagggccagcgaccagctccagagagcagaggggggttccagccatttggtgatgccgggggattccacttctcctttggtgtcggtgccttccccttttggctttttcaccaccgtgttcaatgcccatgaacctttcagaagaggcgcaggtgtggatctgggacagggtcacccagcctccagctggcaagattccctattcctgttcctcgccatctttttctttttctggctgctcagtatttgagctctgtctcctccctgcccacctccagctagaggagaatcagtattgggagtcctgtgctggcctttccttgcttttggaccacccccttacttccatgacccatctctgtctgctgaggcctctctcttgggagggcatggcgaggagtgaccagtctgcttaagatgggagtgcctgctgctgtgtactgctggcccagtagcacagacactgtcagcctggaggacggacagacagacaggtgtccagttctaccaatcctttgctttcccccagatttcttgatttggtgtttaaaggtgggctctccccaactcctctacttgacttaatttaatttttctctacccactgtctaatatgaattttgactcttgaagtgtctctttccatccctcactacctcctttaattacaaattcaaataataataataataataaaaataaaaataaaggtgaaacacgttgctggg

SEQ ID NO: 680680 - DNA, 364 bp, Homo sapiens
gaaaaaatctcacgttgaactgtaatccccagtgttggaggaggggcctgctgggaggtgattggaggggtggacttcccgcttgccgttctgtgtgatagtgagtgagtcctcacgagatctggttgtttaaagtgtgtagcacctcacccttggctctcttcctctttcttcggccagtaagatatgcctgcttccccagtcgcctccaccatgattgcaagtttcctgaggcctccccagccatgcttcctgtacagactgcggaactgttgagtcagttaaacctcttttttataacaaattaatcagtctcagggagatctttgtagcattgtacgaagggacgattaaagatcattaa

SEQ ID NO: 680681 - DNA, 791 bp, Homo sapiens
gggattcggacggagagcgcgaggactcggcggcgtgagcgcgcccgacaggagctagaggcgctgctcaacaagactatgctgcattcgcatgacagatggacggacgctggtcggctgcttcctctgcactgaccgtgactgctgatgtcatcctggagctcggcgcaggagttcctctaagccgtcgggtcagtgcccggggaatgcacacccgcgtgattccttctctgccggggagccccgttgtgctgggcctggccatggtaccctggacagacacatcgatttccattaggagtgtgcacgagggagagtctgaccgggtctccgtatctctgaccacgatggcgcttacctttcagcacttcgaattaaaacgtttattgacctgataagggaccaatagaagattggtcccaagactacattgcctgaggcagacttatggccagcggtggggggaaaacggggttcgtcggacattggtggtcgagggagcagatgccggggtccccccttgggacccaagatctcctgttgtgtgatgcccagtggtggggttaagacatgttgcgccgggatgccacccaggtgaggggcggcgggtcactcgaatttctagagaagacccctggggtgccccgcggctgtgaagagaccatggcggggaaaaagggccccaggagagtcacatccgtgggacccagtgagttcgccatcgtgtcagccacgctcttggggtccaaaagcgaccatgactgtatatagcattgagtcatgaaggatct

SEQ ID NO: 680682 - DNA, 175 bp, Homo sapiens
agaaacaaagagggcaacagaaccaagaatttaagcagttatccaatgaggacaagaccagatcttagcacctgatttccaatcactcaaactccctacaaatagttttttgtttaaaacaatcaacaacaatcaggacaatacacctctactagagaaaatatttcgtcgacgc

SEQ ID NO: 680683 - DNA, 234 bp, Homo sapiens
tccagtacccgagcatgcatgaatgcatgcaggacgacgtgtatacacactactgcggtgcatgcatccctgaacaagttccgagcgacacgtgagcaccgtgctgacctccaaatatcgttaagctggagcctggtcgacgtgtattcaccaatgcggtgcatgcctccctgtacaagttccgtcgacacgtgagcaccgtgctgacctccaaatatcgttaagctggagcct

SEQ ID NO: 680684 - DNA, 706 bp, Homo sapiens
tgcattgcagtgtgcgtgtagttcagaaagttatggaaagtttcatcgataagctaagactcttcaccaggtgaggatccggtggaatgggttatcctcgtttaggtggagaacggtggaacatggtggtgatgtctgggttgtagcccagaacagcaatgactttaaaacagcttatggacaggtatcctcggaaacggttgtggctggagtaggagcaaacagctaaaattagtgcactgaaaggctccagaggcataagactgtgaaatccctgtgcctgtgggtatttcagtagacgtgatgaaacatggtaaaattataggagaactcaataaagagaaatgacagaattgtggtagctcaaggaggtcttggtggtaagaattgacttacaagatttgcttaccattgaaaggccagagacgagtaattcaccttgatctaaaagttatagctgatgtaggcctagtaggattcccaaatgctggaaaagtcctctttcctaagttgtgttgctcatgctaaacctggaattgcagattacgcatttacaacattaaagcctgaactttggacagataatgtacagtgatttcaaacagatatcagtagctgatcttccgggtaaatagaaggagccatatgaacaagggatggggccaattctccagctattgaagaataacagtacttgggggaattc

SEQ ID NO: 680685 - DNA, 757 bp, Homo sapiens
  misc_feature (556)..(556): n is a, c, g, or t
  misc_feature (558)..(558): n is a, c, g, or t
  misc_feature (562)..(563): n is a, c, g, or t
  misc_feature (572)..(572): n is a, c, g, or t
  misc_feature (578)..(578): n is a, c, g, or t
  misc_feature (592)..(592): n is a, c, g, or t
  misc_feature (601)..(602): n is a, c, g, or t
  misc_feature (606)..(606): n is a, c, g, or t
  misc_feature (608)..(608): n is a, c, g, or t
  misc_feature (614)..(614): n is a, c, g, or t
  misc_feature (618)..(619): n is a, c, g, or t
  misc_feature (627)..(627): n is a, c, g, or t
  misc_feature (633)..(633): n is a, c, g, or t
  misc_feature (639)..(639): n is a, c, g, or t
  misc_feature (641)..(641): n is a, c, g, or t
  misc_feature (654)..(654): n is a, c, g, or t
  misc_feature (657)..(657): n is a, c, g, or t
  misc_feature (659)..(659): n is a, c, g, or t
  misc_feature (661)..(661): n is a, c, g, or t
attaaattgtgctcagcaacaaacagaacaaagaaagtgaaattttatttgtgtctttcccagatgtggggattttgaggtacaaacagtaacttatttgagaagatccttcttttatcttgcttgtgccataatccaaacacatttactttaatttggaattgttttacgtggctacttttttgaaatgtgaaggtaaatctttaagtttgaaactgcctgagaaacctctaatagcacactttattgagcaaggaaagcagatagagtgcacacaatacttgtgccagtttttattattgacaggccagttattcatgaaatacacaggccaatagagaagccccaatgaaactattttcatgtgcgtgtgtgtgtgtgtgtgtgtgtgtgtgtgtgtgtgaaatatatatcattcactgagagccaactgtatctctaccacatgtcacatgctcatatatgtcatctgaaagcctcactattatatgtgtcatcactacttaatatctgcagatattcatatacattcccagaaatccttactaggaactgnanggtnnatgtgaaanggatgntggggttaaagctntagaagacnnactncnccaatnaagnntataagcnttgatnggtctngncttacatggtaanttntnangattttttattgtttactcttgttcatataactcaaacaaatgcccttatcacatgaagacagttaccaatataatgtattagtgagagcgtataa

SEQ ID NO: 680686 - DNA, 512 bp, Homo sapiens
  misc_feature (11)..(11): n is a, c, g, or t
  misc_feature (165)..(165): n is a, c, g, or t
  misc_feature (172)..(172): n is a, c, g, or t
  misc_feature (180)..(180): n is a, c, g, or t
  misc_feature (208)..(208): n is a, c, g, or t
  misc_feature (275)..(275): n is a, c, g, or t
  misc_feature (307)..(307): n is a, c, g, or t
  misc_feature (340)..(340): n is a, c, g, or t
  misc_feature (344)..(344): n is a, c, g, or t
  misc_feature (396)..(396): n is a, c, g, or t
  misc_feature (419)..(419): n is a, c, g, or t
  misc_feature (430)..(430): n is a, c, g, or t
  misc_feature (507)..(507): n is a, c, g, or t
ggtggactccngggggatatgcccacccacccactgtcaggcccttacccctcccccaccgcccacttcctgtgcctggggggacactggggcgggggggtggactatgggggagcgggggtggggaggatctggttaaactccagaggaaggaggtgggaaccngggagtntgggggcnaagaggaacagatagaaaaaagaaatanggagggggctactgtctttgcctcctccatcacgaaagctttgccctgagatgtctcccttgaagcncagataggaagtccggcggtgggtcacatccngtgacttggcaatggcgcccgtctttgggtgcnggtnggggaacggtcatgcccctgcgacggggggctggggcagtgcacgccccgcngtgccaggccctccatctcggcnggctgcaggcnggctgttggcatgggcctgagccgggagggcggcccgggccctgcgggtctgggcacatactgaggcatagagctcnggctc

SEQ ID NO: 680687 - DNA, 212 bp, Homo sapiens
tcaggccctgacccgccagaccacgcgctcttaccctgctcctcccggcgtcctggctccgggccccttcttggttcttcactctcgggactccaggcgtgtccccgccgcgccggagcctctgccgggttctcagacgcccggcgcgctgactgcggagcgcgctgggctgctggagtccgccaggcccgttcacagccccgaggacgccg

SEQ ID NO: 680688 - DNA, 681 bp, Homo sapiens
attaaattgtgctcagcaacaaacagaacaaagaaagtgaaattttatttgtgtctttcccagatgtggggattttgaggtacaaacagtaacttatttgagaagatccttcttttatcttgcttgtgccataatccaaacacatttactttaatttggaattgttttacgtggctacttttttgaaatgtgaaggtaaatctttaagtttgaaactgcctgagaaacctctaatagcacactttattgagcaaggaaagcagatagagtgcacacaatacttgtgccagtttttattattgacaggccagttattcatgaaatacacaggccaatagagaagccccaatgaaactattttcatgtgcgtgtgtgtgtgtgtgtgtgtgtgtgtgtgtgtgtgaaatatatatcattcactgagagccaactgtatctctaccacatgtcacatgctcatatatgtcatctgaaagcctcactattatatgtgtcatcactacttaatatctgcagatattcatatacattcccagaaatcctactaggaaactgagggtagatgtgaaaggattgtgggggttaaggctttagagacaactggccccataaggctttacgcattgatggtctggcttaccatggaatttaatgccttattcttttactctgttcattact

SEQ ID NO: 680689 - DNA, 408 bp, Homo sapiens
gggggattcacccgcggaagcccgtctggaagactctgtcccatgccttcctcgttagtaactggtgttgctggcattctccttgacttgcagatgttcactctgatccacctccacggtcacacagcattattcctgtgtgtctgtgtcttctcttctttataagaaaccagccattggattaagagcccacccttcttggccgggcgcggcggctcacgcctgtaatcccagcactttggagggccgaggcaggtggatcatctgaggtcaggagttcaataccagcctggccaacatggtgaaaccctgtatctaccaaaatacatgcaaaaaaattagccaggtgtggtggcgcatgcctgtaatcccagctactcgggaggctgaggcaggagaatcacttga

SEQ ID NO: 680690 - DNA, 217 bp, Homo sapiens
taaggttccatgtccagctctcgagaaaattcaaaataatcattgaacttgattgcacacttctctttcccagtcatagtctaatcgctttagttgtatagcaagaacaggaggtaatttcataatcagcaagcgctacacgtgtatcaacctatattatagcatatcttcacagtatatctcacatattccggcgcgaatgtagcatcatctgtgt

SEQ ID NO: 680691 - DNA, 93 bp, Homo sapiens
gaggctggggctgaaagcaaaagcatgcccagggaggggctgagggcctgtcccagacaataaaggtgccctcagcggatgtgggccatgtca

SEQ ID NO: 680692 - DNA, 341 bp, Homo sapiens
aataacagtgcgcagcatacagcagataaacagaccagttgtgtgacacggtatctgcttggcatcgagatgaacacaagcgtcctgagacatgaacacaacacagaagaatctccagaaacatgacgctaagcggagagacgccttacacaaggacatgtacccatatgatccatatagtatgaacctcttagaacagtgcggaagcatagatggagaaatcagcacaggtggcatggtagcagtggacatagaatggaaaggggcataagagaattttctggggtgagggacgtgttctatttgtcttgatggcatcttcggttacactactgtatttg

SEQ ID NO: 680693 - DNA, 468 bp, Homo sapiens
tctggtatgttctctagtagccccagctactcaggaggctggggctgagaagggaggatcgcttgagcccaggagttggtagctgcagtgagttatgatcatgccactgcactccagccttggtgacagagtaagaccctgtttctaaacaaaaaagaaagcaagcaagaaaagaagaggatacaggtcgggtgccgtggctcatgcctgtaatctcagcactttgggaggccgaggcgggtggatcacctgaggttaggaattcgagagcagcctggccaacatggtaaaaccttgtctctaccaaaaatacaaaaattagccaggcatggtggtgggcacctgtaatcccagctatccaggaggctgaggcaggagaatcacttgaacccgggcgaaggaggttgcagtgagctgagatggcgccatagcactgggcgacaagaacaaaatccgtctcaaaaaaaa

SEQ ID NO: 680694 - DNA, 194 bp, Homo sapiens
ggctgagtccttccaccggtcccggccagtcgtccctgtggaggggttgtggaggagggacgcctctgtgtggtcaggaagtgaaggggccatgtggtcgcatgccaatgtgccacctgcggttgttgtctcacctgtcatctggactcatcgcccaggctgctcgtctgacaccttgagaggcgagagagtgg

SEQ ID NO: 680695 - DNA, 841 bp, Homo sapiens
catcatgccatccaaacctgatgaacgacccggaaacttaggggccacgtgagtccacggccacgggcgcatatgcaaggtctccggaaggctccccaggtgcctggcgctgagttaatatgctggctggatctagcatgtaccagccggatcttaaacttcgagcggaactaccatccaggctacatgtagggacaacgttgtatcactagaatgcaattaccactatagagaggaactcggagcttctggcccactggtcgagcccttgtacaaatagtgggaaaactttggtgtcagggtgaacagacacgaggatgcatgcatgctaaaaaccaagtagtgtgaagcgtgttcccatcattagatgtgtgtgctgatacgcgctactagcacaatgttctggcgaaagtggaaagctccccaattattcctagacgtgtcatcgtgtagaggtccatgttcttcagcacaagagctgaggagatgattaagagtgtcggggagcgccctgatgtcctggatgcgacttggaagccacgatgcaagtggagatatcattacaatgcttatttacgtattaaaggaggaaaacgtccctttggtgtaatcatttgtgtcgcattggttggataagcacttatggataacatgtctattcgggagtgacctagtggaaattacacaggggatgggaagggcggtgcatggaaactagtgagaacaagtgtgggattgctacaaaaaaaaatcccggaggaaacagggttttagataaaacccggatgggtgtagagtatacagggaccaagaggaggcaggaagcgaaaataacccgggg

SEQ ID NO: 680696 - DNA, 685 bp, Homo sapiens
  misc_feature (157)..(157): n is a, c, g, or t
  misc_feature (405)..(405): n is a, c, g, or t
tggattagtaaggtcttgccgtgtgctagaggaattacatctgtaccactgtagggtgcactaattacgtgttgctacacatgggacgacaagcataccttcacgctcttgtcaccacactagcgtaagtcagttactctgataatacagtcgatcntcactatcgtacgaatgtgtacactgcacaattaggccccttcgtcatctggaccgtccttaaactctgtttgagagcattgtaaccttgcgcagggctctagccgcaaggtgcactgtcgactcgtgaagaccggtacatgctggccgagtcacatatgcgaacaatcaaaaatcaattgaaaccttttgcctcgatcataaaagcgaatagtctagtattgatcacctaaatttatctgaataatntcgtcactgtggatcataagtctcgtagatacatctctacgagtaatgtagcgaacgctataaatcgctataccgcgcgtgatcgggatttaatactagggaactatcactaacgctagaacgctctttcattagttcgatggcgagggggaacccccaacaactatgtagattatgtatcctccaactcaatattacatcgaagtggcactagaaggttgcacctaagtattggtattagaagcacctacaatcccccaatggtgatcacacccaatgt

SEQ ID NO: 680697 - DNA, 115 bp, Homo sapiens
cgctcacaacagtcacaggggaaggaaataacattgcactttataaacactgtatggtaagtggaaaatgcaatgtcttaaataaaactatttaaaatgggcagggtaccgagct

SEQ ID NO: 680698 - DNA, 887 bp, Homo sapiens
  misc_feature (1)..(1): n is a, c, g, or t
  misc_feature (111)..(111): n is a, c, g, or t
ncccgttaatatttttccaagggtgtatccccttcaaggcccacactgttttacaaaaagggacgccttctttatataccccgcaaacgctgtatttccctgggccgtctnataatttactggaaagaaccacacagttgtggtcgtgcaacgagtatttacgccgcctgggaataaaaatttgttgcccccccacaacaattaatgtgaatggaggtaggctctcctttttcagaaagacacaccacaatactgctagtgggggcagttaattctctcaagggattcacactcacttatcacctcataagcgtgatgttaggttacacacagcgcattctttttattctgtgcgacctcaccaaccccccgtgcggttaataacatctaaacttttgggggaaatgggcccccctccccttttttcgaaaaacaaatagtcctcctcactctcccttttcgcccctcccacaacattcgtgcacattgttgctcttcttgtctcactcattcataagtacaggttttcttgtatatgccgtatacacttaaccctactataaccaccgtggtgtgccccaccagcaccatgaataatctctccgaggcttcttcaaaataggggccccagtctcgtctcttttgggccccccggggcattctccacaattgtgtagtacaactccctgcctcacgggttgatggagtagttcttttcatccacccccttgcagagggcgcttcctttcagacgccatctcccctgagtcactaattaagatctactgccgcgttgtaccacccacggaggattatgtgttttttcttctcctgacgacaaccacgagacaccctcgtcttaaccaacatttctgtcccacaaaaca

SEQ ID NO: 680699 - DNA, 939 bp, Homo sapiens
  misc_feature (26)..(26): n is a, c, g, or t
  misc_feature (28)..(28): n is a, c, g, or t
  misc_feature (122)..(123): n is a, c, g, or t
  misc_feature (133)..(133): n is a, c, g, or t
  misc_feature (179)..(179): n is a, c, g, or t
  misc_feature (216)..(217): n is a, c, g, or t
  misc_feature (225)..(226): n is a, c, g, or t
  misc_feature (253)..(254): n is a, c, g, or t
gctggcagcgctgctgtgcgtccccncnggggccctgacctgctacggggactccgggcagcctgtagactggttcgtggtctacaatgctgccagctcttagaggtgtcctgtggagtgcnngcgcagagangtgctgcagtacaagtatcttggacgagagctccggaggctggcgnggacggcagggcactcatcaacatgccctggagtggnngcctgtgnngcctgaagcctgcagcctgctgtaccnngagcaacaccagccagctcgccttcctgctctacaatgaccaaccgcctcaacccagcaaggctcaggactcttccatgcgtgggcacacgaagggtgtcctgctccttgaccacgatgggggcttctggctggtccacagtgtacctaacttccctccaccggcctcctctgctgcatacagttggcctcatagcgcctgtacctacgggcagaccctgctctgtgtgtcttttcccttcgctcagttctcgaagatgggcaagcagctgacctacacctacccctgggtctataactaccagctggaagggatctttgcccaggaattccccgacttggagaatgtggtcaagggccaccacgttagccaagaaccctggaacagcagcatcacactcacataccaggccggggctgttttccagagctttgccaagttcagcaaatttggagatgactgtactccggctggttggcagcagccttggtaccaactgcaggtcagtcatgcacaaatgtaggcatcctgcctctagctggtcggatactgggcagggtctggttgtgaccgatagctttccaggaccagcggccaagcttcacagtccggtgccgtccgagggggtgttccaaaggccggacttctgtgtgctttcgaccgggagggacgggtgggcgcgtcc

SEQ ID NO: 680700 - DNA, 201 bp, Homo sapiens
  misc_feature (153)..(153): n is a, c, g, or t
taacatgggctcagtacatctgccacagcacaaagatggcatgggtctctagcgtgatattcgtgctggcagggtcagcagccctgagcgcatccaagccatggtcagaggaaagtgttggcaggctccgcacagccaaagaagtcaggaccncacgagacgggggaagccttccatgagccttcacctctcacgagggtc

SEQ ID NO: 680701 - DNA, 203 bp, Homo sapiens
accgacggcgtgcttattttgtgccccctggcgcgaccagagctgcggcatccgcgggaggaggacaggtaatacggtaagtcagtgctcaagcacatgaacggccacctggagtagtaccaccacgccatctggtggagcatggacccgcaacgccggtacatgctgatggacgaaataataaccaacaacagcggcggccg

SEQ ID NO: 680702 - DNA, 113 bp, Homo sapiens
tccttactaaaattaagtttttttttatctgtcttcatagtcttctgtttccttattaatattctactcttgtttttattacatgaaagtggagtattagaaatatacctact

SEQ ID NO: 680703 - DNA, 303 bp, Homo sapiens
  misc_feature (261)..(261): n is a, c, g, or t
aggtctctgtgttgtcacctggaaatggactttcccctcctcgggatgttatgatgatagatgtaacaagctcagcacagtgcctgtacaggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaattctgatgcgggccgaattttngtcgggttctagcgagtctactcttaataaaccgatctcttt

SEQ ID NO: 680704 - DNA, 280 bp, Homo sapiens
  misc_feature (238)..(238): n is a, c, g, or t
tctttcctgattaaaaaagaagatacacatacctgaaactgtccttcctcttccttcctaccttgaaggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaattctgatgcgggccgaattttngtcgggttctagcgagtctactcttaataaaccgatctcttt

SEQ ID NO: 680705 - DNA, 249 bp, Homo sapiens
  misc_feature (10)..(10): n is a, c, g, or t
gggggggggnttcctgccccaccttaactgagtgattaaccctgtgaattgttctcctggctcagaagctccccaactgagcaccttgtgacccccacccctgcccaccagagaacaacccccttttactgtaattttcctttaccaacccaaatcctataaaatggccccaccccatctcccttcgctgactctctttttggactcagcccgcctgcacccaggtgaaataaacagccatgttgctca

SEQ ID NO: 680706 - DNA, 137 bp, Homo sapiens
cagacaaccatctcatgggccccatccaggacacttctgagtacatcattttcatgtcatcctgttgggcactgatgatggacccttacagttcaggggtcctggacttctaccagtgccactctgacaggctacca

SEQ ID NO: 680707 - DNA, 419 bp, Homo sapiens
acccacgcgtccggactagttctagcccacgcgtgcgccacgcgtcgggccgaggcgggcggatcaccggaggtcgggagtttgagaccagcctgaccaacatggagaaaccccatctctactaaaaatacaaaattagccgggcgtggtggcatgcgcctataatctcagctacgtggggaggctgaggcaggagaatgcttgaacccaggaggcggaggttgcggtgagttgagatcgtgccattgcactccggcctgggcaacaacagcaaaactccgtctcaaaaaaaaaaaaaaaaaaaggccacctcaggggcctctatcgtggggcccgtggggtggcaaagtgcctcctgaattaaaaaggaaggggaaaagatatagcgggaacgcgaggggaagagatgctgagggcgg

SEQ ID NO: 680708 - DNA, 340 bp, Homo sapiens
  misc_feature (4)..(4): n is a, c, g, or t
  misc_feature (43)..(43): n is a, c, g, or t
  misc_feature (117)..(117): n is a, c, g, or t
  misc_feature (121)..(121): n is a, c, g, or t
gctntctgtggttttttttatgtggcattgtgtgggtttttcntgccccttcccaccccaacatttttttaaaggggcctggggggtttttttgaccttaaaagggcttccttaagnggcntgttaaaaaccggggtggattttcctttttacccacccggtacgcggttgaagcaagaggcccccttttggatggacaagttttgcccggggggaataaaaccccctttctttggtaaaagggcccaaatccgttgggggccctttttttgtttgggaagggccttaagcccttcttgccccatccccccaaaaaagaaaaaaaaggggtttcctccca

SEQ ID NO: 680709 - DNA, 350 bp, Homo sapiens
gaatgtaattatggctctagcacaattaattaaaagtgaaacgtagttgtacaagcaggttatcacccatgcatagggcatgataaacaaagcagagctttcccgtcccccgaagtgatatagcgaaagctcgcgttgtgcccttcagctagcttagatgtaccaaattgagaaagcttaaggcgggctacagaacaaggaaaaaaggccacaacagttccctctcactttcagtgatccataaatagatacagcagcaggccatgaaatctagtgacataccggagacaaatgaagtaaatattgtgttgtgcagcattgaaaaaaatcaaaataaaaattaaatgtga

SEQ ID NO: 680710 - DNA, 117 bp, Homo sapiens
  misc_feature (58)..(58): n is a, c, g, or t
  misc_feature (89)..(89): n is a, c, g, or t
  misc_feature (112)..(112): n is a, c, g, or t
agtttgatgggaaagttacctacggtcagaaaagggctgctggtggtggaagctatanaggccatgtggatatttgggcacctactgtncaagagttggctgcccttgaaanggagg

SEQ ID NO: 680711 - DNA, 132 bp, Homo sapiens
ggtaacacatcttccccaggcccacacaatacaatcatttttgctggatacacagtatcgtcgctcatgtgcagttgagtatcctcatcaggcccgacctggcaggggatctgcaggtcctcagttacatgg

SEQ ID NO: 680712 - DNA, 654 bp, Homo sapiens
cctggctctgtacttagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagccactgtgcccagctgtattccctattatattccattggtctatgtatctgtccctcctgagtagctgggcatgcaccaccatgcccggctaattttgtatttttttttttttaagtagagaaaagatttggccacgttggctaggctgctctggaactcttgacctcaggtgatcggcctgccacccaacctacggggattacagtagccagtccggccagggttctggctgtgccgggacagtgaatggacacaccgtcccagatgagctgcagaacacggtacgatgtcatgtggaggagccgccgagtgattgatgggccccagcttgaatgggaagtccagatcccaga

SEQ ID NO: 680713 - DNA, 785 bp, Homo sapiens
catctataggtgcttcatgatccgcaaccgcatcatattgttcaagaaagtgctgatacttcttccctaatgaaatgcgtgattctacaaagagcttcacaacatgtggcagcggtgctcctggcctgacctgtccacacaggaggcgcgtaaacaccaagcgactcactgggacgagcgtacatatgtagatgtgaaaaacagacgtgtcaacagatgcaccactttgtatggggaggagaattgctactatgttgcgatgcactacatagcagaggctatggcgtgcaactctatgacgtggcaaaactacatacagagggttatataccgaggaagtgatacacgctggactctctgatctcatgaaatatactctgacactgagcgaaaatgaaagagatgagataccattattttatgtacatgcactatagacctcgagggtgctagagccatctcctgtgggttctttatgcgctacagagatcacgtaaaaaaacagggatttcagaagaaaattgtaaccaaattgagtacacagtgtgaggtgagagatgataagcacaggagacttccacagcctcgcatatacgcacacaacaaggccggctgtattaacgcccacataaaccccatgcggggttggtcaacggacttaccacgcactcatatcatactttaaaccggtcacccattgcgaggtgtagggtagacacccgatgttgatagaatgtggagccaccttctatttccttcatgaggagtccgatggagcccgtact

SEQ ID NO: 680714 - DNA, 240 bp, Homo sapiens
atccccctctgtgctgatgtgatcgcaacttaactccatcggagatttcaaccgtagaatttattcagagatgcatagtttcgtggctagtagaaatctatgctccatggtgtggtcactgtcaaagattaacaccagaatggaggaaagcagcaactgccttctaagatttcgtctaagttggtgcactcttatggggtaccgagcctctaacttcgtaaccctcgatcggtagctttt

SEQ ID NO: 680715 - DNA, 1132 bp, Homo sapiens
tttggggcccccccttggtttttttgccccacggggggagcccccgcttattggtagtgacccctgtcgcgtcgtgtttgattctctcccccccccccggggcaacccggggctcttcccaaggccgggatatttgcggcgcgttctcctcacacagggtggcggctcccgttggtgtacacacacgaagtttgttgcgtaccaccatcgtgggccgttatttttacatcacacgggggggcgaacccccccgcgtatatggatgagtgttgtctgtgccccacaccattctttctctcccggcgaggttgaaatatattgaatgagagttcgggggacaaaacaaactgtgccgcggggtatacttacccccccgtggggcttacagaggccccttatgccaacgcacaaacccgccgtgctcgggtggcgagaccccaccccggggctgttaacactcacacgtagctcaccgcgcgagaagccctctcgcgcgcccacttcttggggcatacaaacacgccgcctcgttgtatactcacgcgcgggtctcctcgcgggggagcgcgcataacatacctcccacgcacgtgcgaagtaaatctttctaaggcgcacaagaagaagagaggggtgtaaattacatagcgggagacaccaaggggcacccaccccgctcgccttcacagagaaaggagcgccccaccccttttggtggtgtgttaaagccgcccacactgtctgtccgccacacgccgcctcgttgggtgtcgctatatagcccccacgggttgcccccccgggtggtttctcctcgggccttctaaacacagagtcccccgacgtgtcgccctgccctgcttccgccgcggtaatacccgggtgtaagtaagccgccccacacaagcaagaaaccgctcgctggtgacacacatagttgtcaccaggaccgctggttgtccccccccattttttagaggggaatataggggaacacttcgactcccacgacttttcccctacccccacccatccttttgtaggggcttttggggggaactggggcaacaacaaagggaaatgggtttttactttttggggtaaaaaaagatgtttttttgtggggcatata

SEQ ID NO: 680716 - DNA, 517 bp, Homo sapiens
  misc_feature (46)..(46): n is a, c, g, or t
  misc_feature (115)..(115): n is a, c, g, or t
  misc_feature (248)..(248): n is a, c, g, or t
  misc_feature (251)..(251): n is a, c, g, or t
  misc_feature (507)..(509): n is a, c, g, or t
aaaaaattagctggccgtggtggcgcatgcctgtagtccccagctncttaggaggctgaggaaggaggattgctggaaccccaggagatggaggaagcaatgagctgaggggtcngccactgcactcccagccctggcgacagagcaaggctcccatctcaaaaaacaaaaacaaacaaaaaaaaggaaaaggaatatatgtacccattttcattttaattttaaaaaatctttctaggccaggccancgngcacgccactgtaatctcagcactttgggaggctgaggcgggcagatcatgagctcaggagattgagaccatcctgtctaacatggcgaaaccctgtctttactaaaaatacaaaaaattagccgggcgtggtggcgggaacctgtagtcccttctactcgggaggctgaggcaggagaatctcttgaacctgggaggaggagcttgcagtgagccaagatcgagccactacactccagcttgggtgacacagcannnctgtctca

SEQ ID NO: 680717 - DNA, 262 bp, Homo sapiens
  misc_feature (2)..(2): n is a, c, g, or t
  misc_feature (13)..(13): n is a, c, g, or t
  misc_feature (116)..(116): n is a, c, g, or t
  misc_feature (126)..(126): n is a, c, g, or t
  misc_feature (200)..(200): n is a, c, g, or t
anacaaggaagtnggcagctgatcctagcgggcgtgctaggcatgcactacagacatgaatatcaggtgcccagaccgggcacggtggttcacgccttaatcccagcactttgggnaggccaaggnagatggatctcgaggtcagaagttcgagaccagcctggccacaatggtgaaactctgtctctactgaaaataanaaaaattagccgaagcagtggtgggcacctgtaatccctgctgaggcaggaaaattgcttga

SEQ ID NO: 680718 - DNA, 175 bp, Homo sapiens
attcgcggccgcgtcgacaaagaatattgtcaaatatctggtgagtaattgtggggcttttcatgtttaagaatgaatcataaaactgcctagagactttgctttagagtaagctgacaggaagcctactgttaaactgggggtttcccaaatttcaatatacagagagtttttg

SEQ ID NO: 680719 - DNA, 894 bp, Homo sapiens
agtcatgctgaacacatgactatgacctagagccctatttctggtgtcttgcgattgttacaagactccttggcatggtgggtacttagtgtatcttataatttaatctccattgtgatcggagccttgtcggtccgttcggagccttggctttactcctgacctctatgcgagttgaggtcatcttcgcatttcggggaccatgggatcggcgccacgcccgtttaaaaaccccgggacctcctcggatccttgccggtgccatgtgaggtgcttgctggccgacctacatggttcctttggtattatcggtcgtcttgtacgggtctgtaggagtgaaccgttttacatcacacgctccggcatgtgtcctcggacccctcgatccttgtcgctgcccgatgcccgtgccttgcaccttctcgtccgctcgcccatctcatgcgtgggttcgggttcagctcccagcctgcacccagggtgatctggggcccactgtggcatccagatccgtccctgcccgcgaagtgacagtttacataaagttattttccttgctaaacaagatataaaagcttacgttagaaaaccaaggtaaacgtacatattttattatagaaaaagtattttttctccaccaggacgacatatggtaacaaagagaggcaaagattaactatttgcaccgaaatgtcttgttttgttgcgacataggaaaataaccaagcacaaagttatattccatcccgtttgttgacgtgatggtaattttcttctatctgttcccatcggcaggatattcaccttctccaatctgatgtccattatggtgtgggagtcggggtagggggtactcttgtcaaaaggtacaactaggtgccagtgtgtgttttg

SEQ ID NO: 680720 - DNA, 509 bp, Homo sapiens
  misc_feature (86)..(86): n is a, c, g, or t
  misc_feature (420)..(420): n is a, c, g, or t
  misc_feature (497)..(497): n is a, c, g, or t
  misc_feature (499)..(499): n is a, c, g, or t
tgatggcgctgatgacacccagaggggttctacccgaccaaggcgctgatggcccgcagccctttgaatacgggctgcggcctgtngtcgcaggggttgaaaccgtaacactttgttgctaagagagccgccccgcaggcgcgtaagccttagtagtaggcgttctctttctgcgtgtggtcagtcacgtcacgtacgcctttgagctccggaatacgctcgagcaaggtgcgttcgatgccttctttcagggtgacgtcggcctggccacagccctggcagccaccaccgaattgcagcacggcaatgccgtcgtcaaccacgtccaccaggctcacctggccgcatggctggccaggccggggttgatctcggtctgcaagtaataatttatacgctcgttgatcggcttgtctttgnttgacatcggcaccttggcgttcggggccttgatggtcaacttaaccaccattccattggggggggaatccaacaancnctttttcaag

SEQ ID NO: 680721 - DNA, 644 bp, Homo sapiens
gacgtaaatatcgccccatccgcgcctggacgatttcttcccgggtaccgatcgctttgcccggccggattcagggacatttccaaatggaacaaccgcgtagtgagcaactgttctattaccagaccaactacctggtggtggctgccatgatgatttccattgtggggtttctgagtcccttcaacatgatcctgggaggaatcgtggtggtcgctggtgtcacagggttgtgtgggcagcccaaaataaagacgtccttcgccggatgaagaagcgctaccccagacgtcgtaatggtggtcatgtgggcgagctatttccttatctccatgtttggaggagtcatggtctttgtgttgggcattacttttcctttgctgtggatgtttatccatgcatcgttgagacttcggaacctcaagaacaaatggagaatacaattgccaaggaatcaggttgaagaggacaccgatgggcattggtcctgggatgccctagaacagccggcacacaaggcctcaccagatcacttgacttattattcagcaaagtgaaaggaataaacataatttacctgaagctagggttgcagcagaaattgaagttgcagtttgcctttgtcaagacctattttcctggtg

SEQ ID NO: 680722 - DNA, 473 bp, Homo sapiens
ctcgtacctgcagctctctctgatgactactgggtacataaccgactaggcagaaataaataagttctttgaaacccatgagaacaaagaaacaatgtagcagaatctctgcgatgaagttaaagcagtgtttagagggaaattcatagcattaaatgcctacaggagaaagtgggaaagatctaaaatcgacaccctaaaatcacaattaaaagaactagagaagcaagagcaaataaattcaaaagctagcagaagacaagaaataactaagatcagagcagaactgaaggagacagagaaacaaaaaaccatgaaaaaaaaaatcaataaatccaggagcgggtttttttgaaaagattaccaaaatagaccactagccagactagagaaagaagaacgaagaatcagatagacagaataaaaactgataaaggggatatcaccagtgatcccacagaaatacaaactac

SEQ ID NO: 680723 - DNA, 366 bp, Homo sapiens
caggatctccttgagtatatcgtctagaagtaaagctactctcacctctgaacctactttatacgccctatgtctgagattatcttgtcgggcacgtcgtgcattttctacctggtatgggaattattcatgggcgtgattggcacatcctggagactatatgctcactgaagaaaacccagttcaatgagtgcttagaccatgactccttccttgttttccttaaagagagcaatccccaggctcccacatcactttggttccttcacctcagttgtccataacacttaaccttatcccaggatgctgttactagtctgagtatctgccttccctagaggataaactccttgagatcacaatagt

SEQ ID NO: 680724 - DNA, 156 bp, Homo sapiens
tgttaaacagaaatcagtgtatcatcatgcattgaggggactgctagccaattctgcttgtatgactatgtactgtctattcatctctattatcctggtatgacgcgagtgcatccgtctagtaggtctgacctgtaggcagtgcatgccttgtca

SEQ ID NO: 680725 - DNA, 341 bp, Homo sapiens
ccaggccatttgacagttgcaccctgatcgttcatattcccacgcttctggttaatgtcccgcatcaattatacgggacatttcgttaaatgtcccgcaaaattattgggggctaattgtggatagcaccggaaaaaagggacatagaccggaaaaaagggacacttccggttggaaaagggatagttcagaggaacgtcaaaaccctcgcaaacccgcatggatgaaggctttccgggctgccctcgcgcgcgcgcgtaaaaaaacaagataaatcaagaaaaaacaccgggaagcgcccgagaccaaagaccggcagcatagaccaaatccagcgccca

SEQ ID NO: 680726 - DNA, 339 bp, Homo sapiens
ggaggcaggaactgtgagcgcctttgtgggggttgggaggggaagaggacactgggcggccctggggctctagcaggggacctcctcaagcccagtgcaccagctctggcccaaactgtgccccaggcaagcagctcctcctcctcttctgatgaggcaggtgaccccaaatgaggcacccatgccccgacacccatgctcggtgccctggccccgcacgacaggttgacacctgggccagcctccttgagcgacacacgagtcttacgctacagctgtcctgcgcctcccagcgctaccgcagctcgaacttcgctaatcactggtcactagcatgtc

SEQ ID NO: 680727 - DNA, 273 bp, Homo sapiens
ttaatttttaattttttttcaaaggtttaaactcctggttcttaaaaggatcgggatcttttcccaccttttgggttccatttggtgaaaaaaaaaaaaattttcctttttttacttttggatcagcattttaaaacttgcctccccctatatttccaaggaccccattccctttctttgttttattctttttatttactttgttttctttaaaaaaactgggcattttgatttggcaattaacagcccaatatttccaatcaaccccccaga

SEQ ID NO: 680728 - DNA, 348 bp, Homo sapiens
gccggggctcacacggccgtgtggcgggctcggagaagacacgcagagtgaagtcagcctcgtcgccggcgtgggcgggctcggcaccaccaggtagtggcctggacgcaggcagcagcgggggtcacgtcgcggcgggcgctgaggggcgagcggtcggcgcgcagcagccggggcaggagcgcatggctgcgcggggaatcccagaggcccagcagctggggacggggcggatgaccacggaccaggctcacccccggccttcatccccgacctccaggcgcccgtcactggtaacctgtcagtcgcccgccgcccgccccccccctcctccccccccttggcttc

SEQ ID NO: 680729 - DNA, 681 bp, Homo sapiens
  misc_feature (22)..(22): n is a, c, g, or t
  misc_feature (26)..(26): n is a, c, g, or t
  misc_feature (59)..(59): n is a, c, g, or t
  misc_feature (119)..(119): n is a, c, g, or t
  misc_feature (504)..(504): n is a, c, g, or t
  misc_feature (533)..(533): n is a, c, g, or t
  misc_feature (540)..(540): n is a, c, g, or t
  misc_feature (550)..(550): n is a, c, g, or t
tgagataggaagtatcggcgcntgtncatatacatcaaaaaggaaacggaaaatgccanaaaagataacacaaatagcactacttttttaattgaaaagtcttctttgttggaaaacanaggtattccgtgaactatataagttgaaattttgttttacatccagccgatcactcgccacgttatatcatagtcggctttatggagataaaaacaaaaacgaaaaatcggaaattctttattgcaacttatatagtatctgtatgaaaaatacaatcgcaagcaataaataagattttttactcacctatgtcacgaaactcgcgcaaggaagcccctgcctaaagataggggaggaattgaagtttcattccctcctttcgatacgtgtacccatccaatcgttgaatgagacgaatatatttgtagtgaatgccttgtgccattcgctttccatcttttcctttgatgtcaaaacttccgctttttctgcatgccacttcgncaaaccacacgcctttatattttcctttnggaacancagccttgancatgtctcctgtttgaaaaccaaagaaaaattttgtctgcaaggtatcccttggaagccatattgtaaggttgtgcgtgacgatgccagtctttgctgatgatatatctttgtcgaatcagcatcggggga

SEQ ID NO: 680730 - DNA, 457 bp, Homo sapiens
tctgaggtgactctagcaggatctgtgtcatccccttcgtcatactcaaagcacaggctcatttagccctaaatgtcttcccagcatttccatctgcgcaccagcacagtcccccagtgtctgactcgtagagccaccatgctcaaatttctttatggatttattagccaagtgcttattccaagacacaatagcttagtcttaaccagttttgtagtatagcttgatagaccccttaagcctctttcaatcagcagcttaccctcagagcctcttcttttccttttgtaaacaccaggtttatcttttgtaaacaccaggttgtatgagctggagggtttgccaacgactggatgttgctcatggtggaggatgggccatcagcagtcagacctggaggcttccccttggttcagagtccacctcttgggcacaaacctacgaaggcggatggaca

SEQ ID NO: 680731 - DNA, 252 bp, Homo sapiens
tcagaagggataattgaggcctgtgaggtgaagtgattattttaagactacacagtctaaaagtgggctggggctggaatttgtctcatgactcatgattgccagacaccacgatccgtcttctgtgtttaaaacttggtcccccaatgccctgtcttggttctcatacgctgacaaataatatgtaactgccttattcttttgccagtctggacacttacacaaaccccttgctcacatttccatcactac

SEQ ID NO: 680732 - DNA, 780 bp, Homo sapiens
ggcttgtgtcatggcacagcctggtttctgctgctcgccagtctgtgtcattcttcttacaaaatgagcgagtagacacatagagcccctcgtatgtgtcagacctgctcctaggacctattatgattttgatcctcatggcagtccctgagaaatggggggaaatgtaagtgacaaggcagagccaagtcactaagtcacatgcccctggtgacgtagcttctaaggggagacgtgggtctttttaacccaaacccaaagtgctgggattataggcgtgagctaccacgtcccgcctatcttcaggctttttaagggtgtctcttgtacacacacaggaacacacagtgccccctcctggccactctgtgtctgtcatggctaaaagctgtacttagagaaaagcacacagatggtgggtgtgaacccagttgcacccctcatttgctcttcaccttcatccagtcgctttcttctgagtttctcaatgggaaaagtggggtgagagcatcttccttgagaaccattcagggctcacatgaactaggtggatgtgcctggccacatggggacaagctggcgaacattgagcctgacccgactctggaacacgctgtcaaaaaggagcaaagactcccggacctcccctctctacctttccttctgttgacaaagctgaggagcttgagtcagtctgtcttccaggactctggggaagagcagcaattggtaaacatactcttgacaagtggcacaaaggtacacggttacaaatacggc

SEQ ID NO: 680733 - DNA, 825 bp, Homo sapiens
aacatacggcataggtgcgaggcctgggattatgatgctcagctcagacctcccggctcgattgtgcggcgctgggacggctggataaaatgtctggtatccagtgaccttaccagtgctgtgaccactggtgccttcctcagcaccatcctgcacctaccatcctaatgaatgatgacagtgtgctgttaacatgttattaccccacacctccatgctcccatgcctgtgtgccaactactgtggtgcttgtgactgtgtggcctgattgtggaatgtgtgcatgaatcctccttctgtattatacccatgccatgctgcccatccccaataacaatccaagttacctgtgcatgactgtgtctactgtgcatgcaccccatcaccttttttgtgacctgccctatccaacattgttgtttgtccttccttgcaacaatgattgatctgtgatgtcatgcttgtcctataatcgcctgtgttgctcttgaccttgtgcttgtccttgcgtgtgatgccttgtgccttgcttgggtggtgcatagctgtggcttgcttgcttcatccccttcttgctgtgtgattgcccttgcagtgactgtttgaccactctacttgtcccaacttgcatgatgctctcctgtgcgcacctaccaacgctgttttgtacgtgactcaagccagactgtctagtggatgccgtggttgcctgcacgttgacgtccttttcctccttctcatccagcttcactgcctgtgtggcagtgttctgccctggtggttctcacctctcctgtgttgcccaccttcatgtctttctctggg

SEQ ID NO: 680734 - DNA, 367 bp, Homo sapiens
acctcctaccccacgtgatctcctctgccaaaaaataaatatgaaaaacaaaataaaccggctaggtgcagtgggtcacacctgtaatcccagcactttgcaaggccaagggaagcacatcacctgaggtcaggagtttgagaccagcctggccaacatggtgaaatcctgtctatactaaaaatacaaaaattagctgggtgtggtggtgggtgcctgtaatcccagctactcggaagcctgaggcaggagaattgcttgaacccggtaggcaaaggttgcagtgagatgagattgcaccattgtactccagcctgggcaacaaaagcaaaactccatctcaaaaataagaaaaaacaaaaaacaa

SEQ ID NO: 680735 - DNA, 367 bp, Homo sapiens
tgaagaataaatatgcatttatgcacatgaaaagatgctcaacatctttttaccattaggaaagtgcaaattaaaatcacaatgagataccactatatacccactagaatggctgtatcaaaaagtattggtgaaaatgtgtagaagctggaaggaaccctcatacattgctgatagacatgtaaaatggtatagctactagctttgcaaaagcattttggcagtttcctacaaagttaaacatactcttagcctataacctagcaattttattcctgagtatctacctaagagaaatgaaaacatgttcacccatagatttgtgcacagttcatatctgtattattcataatagccaaaaaaaaaa

SEQ ID NO: 680736 - DNA, 1390 bp, Homo sapiens
tggatgtacaaacgtacctgttttgggggagggggtggggaggggggatgggggagggacgggtcagttcttcctttcaggcctcccaaacacgtggggctgtggcacgcctctgtgcgtgccccagccgacaccctcgtggggctctccaggctcctatcttcgttccctcgttccctcgttccttcgccccaggcgtggaactctctccctgcgggtggtgtgcaccgtgcgtggtgcccagctctctgtgccacagcctcctctctccggagagaggcgtctccctctcctctccacgaacacgagagcaatcgtgtgccctcgtggtgccgcccccagaagcgcgtgtggctcacacgctccctcccctgccctctcctgacgccccgtccaacgcgtgcggctctctgtgcgacccgcggtgtagttctcccccacgccgagccttttcaaagtgtgtgtgtctccagagttgcccccactctcttgtcgcccccatcagggggcgcccccgcgtgttcctcactagctacccccggtgggtagcgccccccgtggtggggcggcccacctggcgccgccccgacgaaagacctccttgttgtagagacggctatctctttgcgcgcgagctgcgccccctttgtggagcagttttgtctccgccccttgcgccgcgtcgtgtgttgcgtcacctgcgttgggggcccccatgaggcaccgtcgcttgatgccgcgcccccgtgaaaatattaaccgccgccaaagacaattttaactccccctatcagaactagaggtgatgttgtccacccatcaatctactgaggccccaataagtcgccccgatggaaaacacctctccaaaaaaaatgcgccactttttccacacacgacgtttcctttaggcgactaaagaaaaacaccgcccagcccgacggagacctagtaccacggagggggcgaaggctcaaacaaacgaatttctctcggaggagaagcagcccaaacaaaacgccttgagatcccacaaatttgcagccccccgcagtggagcaaagccacagagaaaccaaacactctataccccccacagaaaagcacattgaggacaaacactccacaaaagtggtctccagtgcacacaaacatccccagacgagaggcagaacaacaaacttcttctacaccgccgccccgatctgccccctcccttccccgagatcactcgaccccccctcatcaccgtgggcgccccactccagggggcctcacaaaaattttcccccggcgcacggatacgctatctcagcgctgtgtcaccccccccgcattagtagaacttctccgcgggccgccgtccccccgctgtatgacagcttcttcc

SEQ ID NO: 680737 - DNA, 901 bp, Homo sapiens
  misc_feature (207)..(207): n is a, c, g, or t
  misc_feature (284)..(285): n is a, c, g, or t
gggcaaaaaaaaaaaaaaatctaatgattcacagaacagatctggagcctctcttcattctcagtaatggctagtcccaaaaactaaaattgcaaatgggcacaacctatatccttcctgtggcaagaaggaaggccactctctcgaagcctgaagtttccagaaagaagcagcttaagtgtctcaagaagaaaatttgaacctcanactcgagcaacaaaggcactctatttgtgaagaagccaacattttcacaagagctaaagtgtgtgcactgtgttgcnncaaacccatttataagggtggccataataattatggcgggggctccatgtgactataaagggggaccccttttaatactctcccacagggtttttaaaaccctcggtgggggaacaaaacaaccttgtgattgttgcttccttgtttgtgttggccgccacaaagagagagtcagccgaacccgaaacaaccagagaaaaaaaatttctctttcccctttgagcttttccacccaaaaaagaaataggggtgtggggggcgtaccttttaacaccagggataatttatttagaaaaggagatttagaaaagggggggaaaaaagaacggaagaaattttaaaagaagggaagaagggaggggcaggaagaagcaaaaaaaaaccaacaccgcctgtttggctctcaacaacacaccccaccaaatgttgtgtttcgcgaggcgccggtttaaacacccccaattgttgtgggaaacacaaaatctcttatacactgttgtcttcctgtggccgcaccacacttaatctcttgttatgctacctgattccgccttttacccacgacaaaaaaaaaaacacctacgtcgattttacgggtgcggcgggcgcagacaag

SEQ ID NO: 680738 - DNA, 285 bp, Homo sapiens
tccaggctagtctcgaacctcctggcctcaatgtatctacccaccttgacctccgaaaggtgctaggattgcaggcatgagccattgcactccggccactagcacagttatagttcactgcagcctctacttcccaggctcaagcaaatcctcccacctcagcctcccaagtagctggaactacaggcatgcaccaccacgcccagctaatttatttttatttattattttttgagacagagttttgctctgttgtccaggctggagtgcagtggcacgatctca

SEQ ID NO: 680739 - DNA, 464 bp, Homo sapiens
ggcggggtcgtgcacggcagcatcaggagacggaactgcttatatagctgggaccacgcagattacgcacgacgagacggacggcgacggcgggaatgggagcagtaccgctgtccggcagtgtgagcacacccaggaggggaacccacccgggtggctgtccctcacaaggtaggctgtggggctctggcagcctactgaggggcggcgacgggacgaactgggcttgcgtcctggcgacacgttcctggttaggacgcatggacagtgacttacccactgtgggggtggggcagggacggctgtcctatgacaagcatcacagcccaatactgcggtgccggctgtactcttaatgcgtcttggtgaacatgtccaacacttattttcctagacggactttgactcgtgccccggaaatctggggcttagcacaaagcaagggttatgggacttttgcctca

SEQ ID NO: 680740 - DNA, 329 bp, Homo sapiens
tagacagaagacgaaaggaaaccaaagactaaaagaagttgccaaaactgtctgggactgggaacttatgaatcctatcaaaccaatattgcagagaccatcagaagaagtagaagaagatgaatacaaagctttctacaaatcatttacaaaggaaagtgatgaccccatggattatattcactttactgctgaaggggaaagttaacttcaaatcaattttatttgtacccacatctgctccaagtggtcagtttgacgaatatagatctgaaaagagcgattacattaagctctatatgcgccgagtcattcatcacagacgactt

SEQ ID NO: 680741 - DNA, 459 bp, Homo sapiens
gcgccctctttttttcctttccgtggggaggccccccaagttcccaagtagagcccccccgggttttttcccaccccccggtttttcctcttgtttccgttttttcccaacaattttccctggaatttttaaaattttttggtgggcccaacgggtgtccccctaccaaggtacaccccccgtttccaacccttttactttgaccctatctttgaacccctgttttttcaagggttcaattttgcttggggcccccctcctcccccggttttttgccaattcaaagactcttttttcgggggggtttttttttaaagggggttttcttttaaccccccgaggggggaccccttttttttccaaaaaatcccccctcaaaatggggggtgttcttttttttccccttttttccccacccaaggggtttttcccccttatttaagtcccgggtttccccca

SEQ ID NO: 680742 - DNA, 230 bp, Homo sapiens
ctggtcgcaggtcacacagggaggtgatagcatgctggcgggtaaattatgtaatgcaaaatttgtttaatctgcgccttaatactttttgatttcgttggagggcgaatgatgagccttcgtgcccacgcgcgtcccccttgtttggtccccacaacttgacgacgtatgacaggctttgtggtctccctcgggagtgggtggaggcagccaggggcttaccgtgtaca

SEQ ID NO: 680743 - DNA, 291 bp, Homo sapiens
ctttatatgaactctgtacatgctctaagctctttttgaatgatattttaagaagtttctaaaccaaagtgcttaagaaaacatgaagatgttaatttcatgaagactgtacaagtttagaagtacaatgtagacctgtttaagacaaaggtggatgggctttggggttttttttacaattggacttcaggtacagaaggattgggtaatggtactcctcagttcatatcaccttatcattggcctttagtattttgtaaataagtaactggacttttatgaaaagcatat

SEQ ID NO: 680744 - DNA, 1111 bp, Homo sapiens
  misc_feature (142)..(142): n is a, c, g, or t
  misc_feature (279)..(279): n is a, c, g, or t
  misc_feature (511)..(511): n is a, c, g, or t
gggtacgccgtgcagtaacacaggtgtctgctgaaaactagccccgaaaaggcacatctggtcactacggtaaagaggactcatactcaaactatttgtccgtgcaattgcgagcatccctagaatatcgagggcgaatgtntcacaacctatatacctggtccctatcatgaatcatactaaagtggcggtctggacttcggctaatacagaagctagttgatgccattttgaggaatggaggctgcttgagatgggagcagggacgtccatcaatgntatgcctgtgtggtctcgtggataatactgtaatagctgagtcgatgaatcgctggatatcattcaattgcatagtactaccttgttgtgagaacttctagtacgcacctcgagcaaggtatctattgatgaactaatctatcttgagtgcctccaatgtgataactatgcagacttttattcaataatagccattagatttacgacgtggacatcttcaaagtgcttgacnttggagcgtcgtccgtggattacgtaagcttgagcttgagtgctaagagtgtgaattctcttgacatgctagggaattctccaaaggaatgcggcgaggaacccagaagagcattgcccttgactggtcgttacaccagcgtggtgtggtgcaactaaacataaatagtccggtagttactcatcaatgtggttccatctgagccaactcctaatacgccaaggaacgcagagtactgtaaggcaacgttggttcaacgaggaaagttccacgagacattcaccatgggctgaaacacatttggtgtactgacccccggaagcaaaagccagccaatttgttgtcccacacttcctggagaggtgcactgggttgacaaccttgcctggaagccaaaccggtgccaaagaatcggcctttgagcgacccacgggcgattgcgcacaggcagaccccgcaaaagacggagcccaagccaagggggcaacccacggcagcagtaccagaggccaggaatgaggcagcagagaccccaaaccggccaaaccagggcacgcctgaggcctagcacaccacgagatgataaaaacacgaggagag

SEQ ID NO: 680745 - DNA, 180 bp, Homo sapiens
ctcggcaccccctcgttgagtaggttgtggggcatccgcaatctgacggacagctgccgttagggtaacctacgcatatctgacgtggcaaggggcgacgaggctcacacaacgtccccgcgaatgaagggtgatgcacgccgcacgcctgtccccacgaaccgcaggtgatctcgtcac

SEQ ID NO: 680746 - DNA, 271 bp, Homo sapiens
  misc_feature (181)..(181): n is a, c, g, or t
  misc_feature (199)..(199): n is a, c, g, or t
cccgactagcccgacaggcaggtgttggcaaccacggcctgtgggccacatctcacccactcacccacagcttattttggtaaataaagttttattgggaacacagccacacccggctcatattaccttgtggctactttcccactggtggtagcccatcgaaactgaaaatatttaccantatctcgactttgcaaangagtttttcaggcctggctttaagggtcccctgagctaggatgcttgcttgtcggggctaagtccggggggg

SEQ ID NO: 680747 - DNA, 106 bp, Homo sapiens
atactgtcaccgtgatacacttcttgggtcttagctttttctagactagaagctctattagccattaagataataactcgtcgttccctacccctagaacacctgg

SEQ ID NO: 680748 - DNA, 124 bp, Homo sapiens
gtgatagactcgagctggtacctctgttaaaaaaaaacaaaatgggttcaggaacaggcagcagggagcagtgtgggattgaggatgggagggaggagggaaagggctggggcttgccagccag

SEQ ID NO: 680749 - DNA, 519 bp, Homo sapiens
tcagctgcttcttgcggtgactctatcaggatcccctgtgggcatctagtgaggacatctccaccagtacagttcgtgtgtctgcaagctgactaccccttgggatgattttatccctcttactgtcgcgttcttttgccagctacccagtcggatcctctcttcgttcactaattcatactcgacggagacctaagggccatcctggactctattcttttacttcctgcctatatccaatagatcactaattcctaattatttgagctgccaagtaattcccaaatccatccagcctctcatgtcctgcgatagcctgcttaccacttcccctgtctcagtttattcttcatgtggctacaaaagcctttcgaatttgtaattctaatcaagacatttccttattgaaattcttacgaaattgcctgtaggataaaaataacagttccttagcatgacatactgaattgtttgtgacctagcccccactcactacctatatcttatctctggccacca

SEQ ID NO: 680750 - DNA, 110 bp, Homo sapiens
caggttggtcagcgctctgctctgcgcggcttgagttatagctctggtcagggcagagctctgctctggcctgggctgtgctcctggcctggccagggccccgccctggc

SEQ ID NO: 680751 - DNA, 594 bp, Homo sapiens
  misc_feature (4)..(4): n is a, c, g, or t
  misc_feature (7)..(7): n is a, c, g, or t
  misc_feature (105)..(105): n is a, c, g, or t
  misc_feature (152)..(152): n is a, c, g, or t
  misc_feature (169)..(169): n is a, c, g, or t
  misc_feature (172)..(172): n is a, c, g, or t
  misc_feature (185)..(185): n is a, c, g, or t
  misc_feature (189)..(189): n is a, c, g, or t
  misc_feature (219)..(219): n is a, c, g, or t
  misc_feature (226)..(226): n is a, c, g, or t
  misc_feature (231)..(231): n is a, c, g, or t
  misc_feature (414)..(414): n is a, c, g, or t
  misc_feature (437)..(437): n is a, c, g, or t
  misc_feature (458)..(458): n is a, c, g, or t
  misc_feature (536)..(536): n is a, c, g, or t
  misc_feature (585)..(585): n is a, c, g, or t
  misc_feature (590)..(590): n is a, c, g, or t
tgtntgngagagtgcatccggcccggtacttgtgatcggaggagagccggatcgtccttccttgaaccctctggtaagggctgtgctgaggggctgggcgggganacatgccgtgtccgctcgcttgcaccttttcagactgccgtgtcagnctcgagcggcgcccacntgnagccctcccctgnccanccgcccccagcgcccgatatccgcccccgnccagaangcatnccgcgtcaatccccagtcccgtcgcggccactgacccttgagatcagccctcccctccccaccttcccgtcccaaggccaagcccaagggcccgaaagcccaacccactcgcgtctctagcaagccgctcttgtcctctgggtacggctcgcgggagtgttggttagcatggtgaaacttggnagcaaattgatccttggcagttnctgtggataaaaggcttagcntgcagaagtgtgctctggctgttgtgaagttttgagattagtcttaatggaactgtggcctggccgcggctcaaaaanaaatttcccgtgaaaagaagaaccaagagttggcaagaacggcctgganagatnttcc

SEQ ID NO: 680752 - DNA, 160 bp, Homo sapiens
tgcttaagtactctgctacgatttattccaggtagttcatttgttatagtcactcacaaatcctaaaaatgaacctacaagtagcctattataaactctttcacacaaacgataaattccctaactcagtatcattctttagaactaaagattaaacgtt

SEQ ID NO: 680753 - DNA, 396 bp, Homo sapiens
agaaggatttgtactctcccagcccagacaatggtgattctttctttaccatttctggggacttctagttctctaattaggtaccattattaacaaggaaatgctaagagtaccattctcctgtggaacatatctgcaagtgtctaacatctgcctgtaccgagagccctactcttcttacgcctgtctgaccatcacgtgctctattccacttcttcagaatgaagcagggagtggtacctatcccggccacggtagcgttcagatgctgggtggtcgcactgtgaattctcccttcaacagttccaagcccctgatttcctgacgtatcggtggtatgctccagtttcagaccatgtgtattcctgaagcatggcttgatcagagatcaggagg

SEQ ID NO: 680754 - DNA, 175 bp, Homo sapiens
  misc_feature (9)..(10): n is a, c, g, or t
cctttttannccattgtggactagtggctgctgtatgcctcagtgacaatgtcccagcgctcctatcatgtttacagtcaccctatggtcctatataagaattgtgttacatgtaggttcgtgtcgtcgttggctctgagacattgataataaattttttctcaactagtgaaag

SEQ ID NO: 680755 - DNA, 480 bp, Homo sapiens
tgtgatatggcacgtgtttggtcagatcactagaggtggatcactagtcgttagaacatccgtgatcttgactattatatgtggctcagacaaaattacgcaggctggttcagctgcagttcacgtggcgtatggcgtgtgtactggggtgttgctgggcaatattactgcctgtacagctgcatgccgatggtggtgtttcacttaaagagtacaccctggatcaaaggtcagaaagggctcataaaagtgatttcgtaggcggtgcttaggggtggagtcagccacaccacgtcagatataatttaaattccgtctattacaactgaaaagttaggacccagaatgtgttgagggccgagcttgccaatagactcactatgttagggagccaaattatcacaagggttgcttgggtgtccacacaaggattcaagaacaagtgctcttaatgggatcttagacaatgcttgctgtcac

SEQ ID NO: 680756 - DNA, 854 bp, Homo sapiens
  misc_feature (220)..(220): n is a, c, g, or t
cgacccacgctgtcggacccacgctgtcgcccacgcgtactgtggacgcgtgggtcctggacggcgtgggcgaggagcacccgcgtgctagctgatctgaggccccacctgaaccccaaagggcaagcgcagagaagatgacccagatcatagtaatgatgaccgttcaacaaccccgagccatgtacgttgctatccagtgactgtgtctatccctgtnacgcctctggcacgtaaccactaggcatacgttgataggactaccggtagacggtggtacacccccaacagctagtgacgccatactaacggagggtgtattgcccctacccaccatagtccatccgtgcgtctaggacctaggctaggcctggtgaaccatagactagactaacctacatgcaatgatctcttcaccgagctgcggactaccagatatcacgacccacggaccgacgacgtggaaatctgtagctgtgacaattacagggacgaaagcctagcagctcacggttcatgccccttggaacatatcgacgccaagcatgactaggacaacagctgctgcattacacagcgatcccatacccctggacgaaagaagctaccgaagatagcccatgacgctcgggaaacacaagggagtcgaaatgaaaaccaaacttggaggtcacaattagaaagacggagcatcaccaggcctttggcgcctatggatggcgcacaacatgccttaacccacgacgcatgatcacactattaaccatgaactaccacttgcgcaaggatcccatggctagggcacaatccgaagagaaaatactcaacccaactcaccaaccccatacagtgac

SEQ ID NO: 680757 - DNA, 587 bp, Homo sapiens
ggaatatgcatgggaatgaggctgtgggacgagaagtgctcagttgttcttggcccagtacctatgcaacgaatagccagaaggggaagcgagacaagttgtcaatgctgatccacagtacccgcattcacagtcatgtccttccctgtaatcccaggaatggctttgagaacggcagcgtctcagtctggtgaactcatggactggttggtgggtcgaagcaatgcccagggaatagatctgaaccggaactttccagacctggataggatagtgtacgtgaactgagaacagaaggtggtccaaataatcatctgttgacaaccatattccagaacgatttgggtgatctaatatcacaaaagcgttggtcctgagaccaagggcttgtcattgcattgggattatggaatattccgtttgggtgctttctgcccaagtctccatggaaggatgaccttgttggccaactgtatccatatgatgacgaacgcggagtgggtagtgctcaggaataacagctcctccccagatgacgccattatgccaaagcttgggccgggcaatacgtcttctttcaagccgga

SEQ ID NO: 680758 - DNA, 171 bp, Homo sapiens
gtatccccggcggttgcggcacggaggcaaaagaagaatcagtgtgtggcttgtcccatgtcatcagcactaagcaacagaaacacaggctgtgtggacatggagcctcagtgtcttccatcatcacaaggtgcaccgtagtcgtctaccatgatcacaagcttatagtta

SEQ ID NO: 680759 - DNA, 762 bp, Homo sapiens
  misc_feature (400)..(400): n is a, c, g, or t
  misc_feature (454)..(454): n is a, c, g, or t
  misc_feature (563)..(563): n is a, c, g, or t
  misc_feature (649)..(649): n is a, c, g, or t
gcgcggcggctgcggcggcgagcattactccggaactcggttcgcggccgcgcccgtcgtcgcacggaccgcgcgcatgcagggcatcaaagtgctgtggtaggtgcggggacggcgccgggggagaagagatgcttgactcgactccagcttataacgaccacacgtcgcttgctcgcgcgggcatgaagatacattacaccgcgacccgtgtatgtatgaccaaactatggtctgtcactcacggtggatggctggacgtggaagaaccgatgtgcaagctgtagggaaacgtggtagggcaacatccatgcagagagattccaggacgtgagcattacagtaagtcgtgaccttgcggggcacaaacgtcgtcgcatagcacgcacaccaaataccnttggatcgggtccttgtgtacctttgacatctgggacattcttccttgcatggntttgaggctcgcgagagcgcttgcgcgtatccggaaagaagatcgtatccgttgcgacaagagttggggtaccacgtgacgtggttgccagagggacgcccaaactggnacgcaccaccgagactagcgacgcaccatttccctctccgcgtgggatgcgggacgagccgagatagcctgggagcccgtgcccgnccgtaaaacgggaagcccaagggaaaacgaaccgagtgttggaaggcagggcctggtccgggggaaaccgagagaagaggcggtggggggcaaacccccgaatacagcgctga

SEQ ID NO: 680760 - DNA, 325 bp, Homo sapiens
ccccccaaggggtttaaaaaaaaaaggggttttttttttttgggggaccccccctgttttttgggccccccctttttttaaaagggggtttccccccggtttttttcccccccccggggaaaaagggggggggggggcggggtttaaaaacccaaaaaaaccctggggggtttttgggggggggggctttttttttaattttttttttaccccctttttcccccttgggggcccgtttttccaaaaaacctttgccccccccttttttttttttaatttggggggggttggggggggccccccccttttaaccccccccttttta

SEQ ID NO: 680761 - DNA, 406 bp, Homo sapiens
cccagacagacaccgcgttccgagatgaatagaggcccgtaagacagagcgcacttcgtatgccaccttccaaccagcaaccagcaccccctattggcccccaggcccgatcgtcttggactccgtactggatgaatctgacctctatagcctgacccattcctacctcggaagttggaggccggataggacgctccaatagagaatctggtgtcaacacctaccggccttgccctggtggacacgagaggaacctggtgaccaatctgcagacatcagaaaggacgactcgggcacggttctgagacagagctggagatgaggccagaccatgcacactacagcccaccttagagacgggactgccgatgtgaggacctggtacaggatccaggcctgcttagct

SEQ ID NO: 680762 - DNA, 523 bp, Homo sapiens
  misc_feature (55)..(55): n is a, c, g, or t
  misc_feature (99)..(99): n is a, c, g, or t
  misc_feature (121)..(121): n is a, c, g, or t
  misc_feature (149)..(149): n is a, c, g, or t
  misc_feature (239)..(239): n is a, c, g, or t
  misc_feature (315)..(315): n is a, c, g, or t
attaattggaagtaaacaatacacaccggaatgcaaagaacggaaattacaacantttttcagaccacagtgcaatcaaattagaattcaggattaagnaaattattcaaaaccgcacaantaacatggaaactgaacaaccttgttcntgaatgattactgggtaaataacgaaattaaggcagaaataaataagttttttgaaaccaatgagaacaaagacacaatgtaccagaatntgtgggacacagctaaagcaatgtttggagagaaatgtatagcactaaatgcccacaggagaaagcaggaaagatntaaagtcaacaccctaacatcacaattaaaagaactagagaagcaagagcaaacaaattcaaaagctaccagaagacaagaaataactaagatcagagcagaactgaaggagatagagacatgaaaaacccttcaaaaaaatcaatgaatccaggacctggttttttgaagagattaacaaaatagatagatcactagccagaataat

SEQ ID NO: 680763 - DNA, 333 bp, Homo sapiens
  misc_feature (103)..(103): n is a, c, g, or t
  misc_feature (248)..(248): n is a, c, g, or t
  misc_feature (313)..(313): n is a, c, g, or t
gggaggatttgaggggacatcatcctgaattaggttaaaaactgtcgcaagggctgggcatggtggctcccgcctgtaatcccagctctttgggaggccaagncgggcaaatcacttgaggtcaggagtttgagaccagcctggccaacatggcaaaaccccgtctcaactaaaagtacaaaacttagcctggtgtggtggtgtgtgcctgaaatcccagctactcagtaggctaaggaaggagaatngcttgaacctgggaggcagaggttgcagtgagccaaggtcgtgccactgccctccagcctgggtnacacagcaagactctgtctc

SEQ ID NO: 680764 - DNA, 411 bp, Homo sapiens
cgtgcccctgtatatgttatccctcatacttaaatatttattttgttttttattaattgctatataatgttgctttcatttgaatagtgaacttatgcgctgtgctctttccatacttacaacctgtaaggcattaagtggagagtaagacttgcgttgaaatcgaactggcatgatctgttatgatcagactgctaaggcttcaggtccagactacagagcttctttcagcattcactgcatgcaagtcttttttccctcataacttcttattgggtaaaaatatgtcagatcattctgaagcaatttgtcagaatacaatatacatcattataccctctccttacattcaacattcatccatttttgctttaccatattaacattctcattttgcaagtgaagtgggta

SEQ ID NO: 680765 - DNA, 150 bp, Homo sapiens
ggagcctttacttgaattgtgcttggaacctatcctccttattcttttcctaattaggcctattaaacacattttagggaattgggattcccttattcccctggttcaatctctagggattagccctaggactctagtgattcgctctcg

SEQ ID NO: 680766 - DNA, 2290 bp, Homo sapiens
aagccactttgacaacgtttctgagccaggggtgaccatgacctgctgcgaaggatggacatcctgcaatggattcagcctgctggttctactgctgttaggagtagttctcaatgtgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcatggactcaagtgatctgcctgcctcagcctcctaaagtgctgcgattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaatct

SEQ ID NO: 680767 - DNA, 624 bp, Homo sapiens
atatgggtctaggagagtaaaacctaggatataagtcggggaaaaatgagtaacacctcaaaagcacaggcatcaaaagcaaaaataaacaaatgggattatatctaactaaaatgctgttatacagcaaagaaagcaatcagtggagtgaaaagacaacctacagaatgggaaaaatatttgcaaactagtcatctgacaggagattaatatccagaatatacaggaaactgaaacatctcaatatcaagaaaacaatctgattttaaaatggtcaaataatctgaacagacatttctcaaaaagagatttaaatatgtccaacagataaataaaacaaaatgtggccatcaataatcttcaaggaaatgcaaatcaaaaccacagggagttatcatctcaccccagttaggatggctcgtatcaaaaaggtaaaaaataaaaatgctggtgagaaagcagagaaaagggaactcttatacactgtgtggtaggaatgcaaactagtgcaaccactgtggagaacagtatagaggtccctcaaaaaataaaatagaataccatatgattcggcaattccactactggatatttatccaaaggaaggaaattattacatgggag

SEQ ID NO: 680768 - DNA, 291 bp, Homo sapiens
gtttcgtccagcgagttgctgatctacacttggatggatgcactttgaccgcactgtccaggcttagtaacagaagtctatccagcagctagaaagaagggcactcactatcaattttgcaatcgtttttacagatgttaacagacctggctatcgagttcaggagataggcagcaccatgtctggcagaacaggggactgctgattccatgaacctgcagacgcacaagttccacgactacggagattaacttgtatcatagacaaattacccctccaaatcgggcaacc

SEQ ID NO: 680769 - DNA, 298 bp, Homo sapiens
ctaagaggtgagtgagggaatgaagagaggttggttaatggataaaaacatacagttagataaaaagaaaaagttctagtgttcaataacacagtagggtgactatagctaacaataatttattgtatatttcaaaacagctagaagagaagatctgaaatgctcccccacccacacacaaaatgatgtatgtttgagatggtggatatcctaaataccctgatttgacacacggtatgtatgtgtcaaatattgtagttaccccataaatatgtataattattttgtggggaaggaa

SEQ ID NO: 680770 - DNA, 798 bp, Homo sapiens
  misc_feature (50)..(50): n is a, c, g, or t
  misc_feature (62)..(62): n is a, c, g, or t
  misc_feature (67)..(67): n is a, c, g, or t
  misc_feature (76)..(76): n is a, c, g, or t
  misc_feature (78)..(78): n is a, c, g, or t
  misc_feature (89)..(89): n is a, c, g, or t
  misc_feature (171)..(171): n is a, c, g, or t
  misc_feature (174)..(174): n is a, c, g, or t
  misc_feature (246)..(246): n is a, c, g, or t
  misc_feature (272)..(272): n is a, c, g, or t
  misc_feature (282)..(282): n is a, c, g, or t
  misc_feature (287)..(287): n is a, c, g, or t
  misc_feature (294)..(294): n is a, c, g, or t
  misc_feature (305)..(305): n is a, c, g, or t
  misc_feature (322)..(322): n is a, c, g, or t
  misc_feature (331)..(331): n is a, c, g, or t
  misc_feature (567)..(567): n is a, c, g, or t
  misc_feature (631)..(631): n is a, c, g, or t
  misc_feature (644)..(644): n is a, c, g, or t
  misc_feature (766)..(766): n is a, c, g, or t
cactaacgcacacacagataaatcccttgcccaaggtcacagagctggtnagacgcatgttngaacncaagcctangnaacctgtactncagatctgcacccttgaccactgtgcactctgcctctcatgccctcatctctaccaggttgggccggagatacatgggagangcngtcgccacttgctctgccccaggcacttggcaaacacctgtcggttcaatctcagacgaccccagtgaagantgacccagatactcactgtccacctngagacgccanaccanacgtctnacatctgccanagccacacagccccggnagttagggngctgaaatccaaacctcttcctgatctctgcccaccaggtgtctcctccccagcccatgtagggagctgaagagaatggagaccagaggggagggaaagaggaggctggagaggagctccacaggtcttcctcaggcctgacagctgcccctggcttccctgaggtccacaggaacctccagaccttcccaggattgcccagcaggggagggggcccagtggggcaggaactcaangcagttgggctcctggagagcagccaccctgccgctcctgcctgcctcaatgcaacggtctcangctgggctgccangatgggaggcaggtcttgtggagtcgcccacacaccacatacctgccctgaggccttcagggaccaatgcaacaggagaggcattcccaagcaccacatgttccagtggtccctcctgctcnacctgggccaacagggctgaggcctggaggag

SEQ ID NO: 680771 - DNA, 419 bp, Homo sapiens
attatgaaatgtataggtaaatggatggaactaaaaaaaattatcctgagtgaggtaactcactcagaaagacaaatactgtatgtactcactttcatgtttatgttagtatagaggcttgcttgtataataaataacatgtgtgtgtgtgtgtgtaaccacagagggtagggagagggaaacagaatagatagttatgaatggacatggtcaggtggtgactagaatggcaatatcaaacagggagtgagagggaagagggcaggaagggagagaatacagggaagaacagctaaacttcgggtcacttgaagggtcatatggaaacctagtacagtacaagcttccgataatatatatgcatttctttttttttttaagatttatttacttggggctggtgagatgtctgtcgacgc

SEQ ID NO: 680772 - DNA, 375 bp, Homo sapiens
gcggccgcctactactactaaattggcggcggtcgacgagaaagaaaagggagagatttaaaaagtaagaaggtggccgggcatggtggctcacgcctgtaatcccagcactttgggaggcttgaggtgggcggatcacaaggtcaggagatcaagaccatcctggctaacacagtgaaactccatctcttactaaaaatacaaaaatttagccgggcgtggtggcgcctgtagtcccagctacttgggaggctgaggcaggagaatggcatgaacccaggaggcggacgttgcagtgagccgagatcatgccactgcactccaacctgggtgacagagcgagactccatctcaaaaaaaaaaaagaagtcgacg

SEQ ID NO: 680773 - DNA, 303 bp, Homo sapiens
tagagatcccccgcggtcactgtcttacgttacatattgtgacaattcctgctgcacagcaaagtgattcagttacacatttgcacaatccattctctttcagattctctgcccacatatattatcaccgtatattgggtagagttctctgtagctgtacagcattctccccatctatccaactatccataattcctcaggtatgtacatttctcaatccccgcttagacataatccgcggggtgtaccgaggctcgaaatctcgtaaatcttcggttcattagcgtattttcctggtgttga

SEQ ID NO: 680774 - DNA, 817 bp, Homo sapiens
gggcatcttttctagctgcgacatgtgtacccagtcacgccaacgggtgatgagcgtctcacattcagaccttggtctgccagctgccaccactcccttatctgatgctggagaggcacaccaaaatacagagaactttcagaaaggcaccatcggacttgagctggaagcccggcttttacgttttaaatagataagatgtggaggaggatgtgtgctccatgaagactttttcacagaatctaacttgctatggagtggccagagggctaaacaaagatgccaactgcctttagatgtctgcagctgctatcacggatgtgtgaagctataggctgtggcaaagaccaacctggggagaacaatctttggccatttattcaaaggctggtgcatcaggggatccaaccacccatacatgtgttatgggaagctgcttctccccgacgcctgatttagctgatcttcagatgaaactggttgtccagcacgacctcctaccccatttctacccatcttgggttcattgggccgggacccctgtgacataatacgtattaacgggaaagcgggcccccattctacttaacttagggtatagggctcaggagccttcacatggatataaggttctgagtaaccatctagaccatagaggttctttgctaaatataaggagcattcgaaccatggctgaaaatcgaggaaagtaaagaaacacacgtagagaaatgtgagagatggggatggggcctcctctcttaagggaggatgagtattatcgcgcgtctaccgactccgcagcaagtcatatgag

SEQ ID NO: 680775 - DNA, 178 bp, Homo sapiens
ccagcagcttggaaggcgctgcgggtggctcacgaggtcaggagtctgagaccggctggaccacagtggtagaaccccatctcaactaaaaaggaaatataaatacaaaactgggcatggtagtgcatacctgtaatcccagctacttgggaggcaagaggaggggagaagtagcctg

SEQ ID NO: 680776 - DNA, 138 bp, Homo sapiens
cctgagtggtcgatctcggctcactgcaacaagagcaaaactgcgttcaaacaaaacaaaacaaaacaaaaaagaagcaaattgccacagtcacctaaccttcagcaaccaccaccctgatcagtccgttcgcatgtt

SEQ ID NO: 680777 - DNA, 508 bp, Homo sapiens
  misc_feature (4)..(4): n is a, c, g, or t
taangagcgccccccatgcataccttacatatatataaacacatgtgtatatatgtacataccacacacatccacacatgcgcacctacaacctagacaccccccacactcacacgtgtatgcacacgacagcacacagtggtggctgtgaccgcaggggagaggtctggggttccccagggcctgggagctttcaccttcttcggcttgggcagtggtgcagctggccaggggtggcacaggcaggcctcacttgggctccagttgaaggaacagctgtctggcccagccacccttccccctgcagagtggcagggccattgtggttagagcaacttgcacctggcctgggctgacaggccgtgagcggcattgcacagaccggggagagaagatgccagctccagcaattggaagcttgatgccagagtggggagaagggcagggctagttacggcgctcgttacggaggcggttaggaggcgctcgttacggaagcgctcgttag

SEQ ID NO: 680778 - DNA, 138 bp, Homo sapiens
gtcaacatgtatatatatgttatatacaaggtctgacaacatatttctgtttttatatgttttcttatgatgcagggcatactcttatgcaaataattagacacttcataggtcttaatttccatatctctatatatt

SEQ ID NO: 680779 - DNA, 630 bp, Homo sapiens
cctgatgcgatgtgcgcgggcaagccagtctggagcgccgaggagcggcctcctcttcaatgagtgggagggggcagggcctggagtgttgggtgcagcctgggaacacctccgcttaatagtgcgtggttagagactgaatcagtgtgactcgtctggcagtcagtcccagtgctgaccgctcgtgagtgtactttccttgatcaggctaggcttgttgtggcagggctcagcttgacagtactccatcctgcagcagccttcatgagttctcgcttcttccctgccccagtgccttcagtgtgcagaggccatgcaaggtgctcggccggtaaggagaacggtcagtggcccatgggcttcagcatggcggcaccttgttaattggcattgactgttgatggagtgcctcctcctcactctggactccagacaggaaggtgatcccagtgacaacggggggcactgtgcgtggcagcgctgagactggtcgccatggcaatctcctcatgagaaaactactgaatgcaagcatagtctggggtgaccatgttgggcttcagcaaggtgccttccaggtaaattgggtgatcactcagagccttgtagacaggcagccagcaccttctc

SEQ ID NO: 680780 - DNA, 183 bp, Homo sapiens
gccctgtgggcacgcacgtgcgggcaactcggaactggattgccaccaggaatttctaacatctttttagaagaccagaattccccatcagaggcccaggtatagtagtgacagggtcctgcatgccttctgctgggacacggagaagcggagtcctggcaggtgtgaccccggcccctgcct

SEQ ID NO: 680781 - DNA, 489 bp, Homo sapiens
  misc_feature (342)..(342): n is a, c, g, or t
  misc_feature (363)..(363): n is a, c, g, or t
  misc_feature (444)..(444): n is a, c, g, or t
  misc_feature (454)..(454): n is a, c, g, or t
gctgctcgggtacagataaaaacatcattgcaggtggtacttgaaccatgaatgctctcaactatgaagttttacgcaacaccgagaaattgtattacaaagaccaataccaggccggtgcaaacacgcaagtaacgcgggtgcacagtgacggtatcgagttgcaaagtaccgtggcctacccggaaggcggtggccaggaggcagacatgggtaccattgaacttcccatcggtaccgtacgcttcatctgggttaaaaaactttacggtagccccattcgccttgaaggtttcaaaggtggaaagctgggcggcatcattattcacagcctgcaccccnatgacctgcacttgctcgatnaagtcaccgcaggtatgcccggcccgcgtcaccatcgatattgaacggtgcgaacggctgacgctgtctcacagtgccagncacttcttgnatgccgccggcatcgggcttgcaagaagagttgaa

SEQ ID NO: 680782 - DNA, 195 bp, Homo sapiens
gaccagctaattttttgtattttttcctttccgtagagagggtattttgccattgttgcccaggctagtcttgaactcctgggctcaagcgatctgccttcttaagcctcccagagtcctaggattacaggcatgagccacttcacccagcctcttaacaaattttgaatataactccgccttaaaatcttcaga

SEQ ID NO: 680783 - DNA, 134 bp, Homo sapiens
gggtattctgggggaacatgcctttgttataacatttattgaatgttcacttttccagctctgaatactgaaacttagtgagattttttttttcgagccatgccccatcaacacttttaggttgtctctaatgg

SEQ ID NO: 680784 - DNA, 1004 bp, Homo sapiens
gcctcatgtacccattctaatcgcaatggcattcctaatgcttaccgaacgaaaaattctaggctatatacaactacgcaaaggccccaacgttgtaggcccctacggggctactacaacccttcgctgacgccaggtagaaactcttcaccaaggagcccctaaaacccgccacatctaccatcaccctgctaacatcaccgtcccgaccttacgctctcaccatcgctctactactattgaaaccccccgtccccatacccaaccccctggtgcgacagcctcaagactaggcctcctgattgtatgtctacgccacctctagcctagccgctgacgtcaatgcctcggatcagggtgagcatcaaattcaaactacagccctgataccggcgcactggcgagcagagcccaaagcaatctacatgatgaacgtcaccctagccatgcattgctaacgtatcaacatcactactaaggggctcctttaacctcgccatccttatcacaacacaagaacagctctgatacactcctgccgtcatgaccctagcccatcatatgattgatctccacactagcgagagcatcaagcgaaaccgcttcgaccttgccgaaggggagtccgaactagctctcaggctgcaacatcgagtacgccgcaggccccttcgccctatgctggcatagccgagctataccaaccttatcattcataagcaaccctcagcactacgatctgcctcggaacaacatatgagcactctctcctggaactcggacacaaccattggttcagccagaccctacttctagccccctgctcgttataaatcgaacaggcgaaccccgatccgtagacaatcccataacctctcatgacaaattccacctcgcccagcagtaatcaggagcgcccgcccataatccagcatcccgccccaaacaaccaaaccacacaacaacaccgccctcggggcagcgaagcagcccccctccacgga

SEQ ID NO: 680785 - DNA, 242 bp, Homo sapiens
gccaaaaaggatttaaaccgggctgggggggggaaaagtccttttttgttttcaccctttggttccaaaaaaagttcccctttttttgggttttggttccccgggggggggccccaggggtttttttttttttttcccttccccttggctttggggtcctgttgggaaccccggccccctgtttcccctttttgggggggaaaatccataaaaaggccccttttttttttttttggccccca

SEQ ID NO: 680786 - DNA, 134 bp, Homo sapiens
ttatccccagccggtgagggagatcagcggataacgcacaaggtcttcaatcgacctgatgccaccacctaggttgaccagggtgggcgagcataccggtgtaagctcaatgctggctaacagcgtggagtcga

SEQ ID NO: 680787 - DNA, 1420 bp, Homo sapiens
  misc_feature (255)..(255): n is a, c, g, or t
  misc_feature (310)..(310): n is a, c, g, or t
  misc_feature (592)..(592): n is a, c, g, or t
  misc_feature (806)..(806): n is a, c, g, or t
  misc_feature (961)..(961): n is a, c, g, or t
  misc_feature (1039)..(1039): n is a, c, g, or t
  misc_feature (1420)..(1420): n is a, c, g, or t
gtgacactctctgtgccgggtggctgttcttgttgttcgtttgttataatctcaaaggatacttataattccatgtggaagaaatagccatatacctgagctattcgtacactttactaaaggaatgtgtgaatggtcgatatacgatcctcgatgcgtctcctctatatcgtactggtcttcgttggacatgtttctcatccaatagtactatgtactagattaacactactaaattcccatgaggcggtgtcntaacccgtattggaatacccatcaggactagcaggaaaactcacgtcatggtccnaggtgagactaacaaatacactatagccatttattccggcattaagattgtgaagggcggtcgttataaccttggtgttagtgcatttggccataataggtacaaggacccagccctttttattaagctcgtacgagaccatgatttattggtgacatgttgcatggaagggataggttttaggctcttatctaaaatcgtagaaatagttcccaccttacataggtaattcctttatccttagggttccggaaaagaccaaaagtttgttattatatcaangagataagtgaccgttccagttgcttcttaggttgacctgttgcgaactcagaacagacaccaaacaccgtaggaagccagtgacgaacacagagggtaatcctccatgcctaagaagttctataaaccttcaatttgttgaacttttcccaggggggtatctcataatccgctcaagccaggttgtttttattttcacgcgtgaagcctggcngtacaatgaagtgtcatcgttcgtgacagccgggcactggacatcaatactgggcggaccaagtcatggtggagcgtgcttgcaaagcattctggtagtcttgcttgtatttaccacgattggaaatattgggactaatcgtaatcgtatcttgngggctggacaatctttaagaattgcgggatatcgcatctgttcttcatcgcacatttcacatggccttaggaaatttnaccaattcagtttcctaacggggctgaagtacttgcatttggacgattattagtacgcgcacggcgtgtgtgcggaatgcggagagagtgggtgaactcacctgggaatagggtagagatgttccctaacattggacccgtaaattacccgaggttgcagaggcgcagattgggaccgggcacaaagggagatttggacacccaaattggcgggatggggattaaggaaccaggagagcattgagagcttcagcgagagaccacacggggttgccgttcatccacagagagaagctcatgcaaacgccgagagcagcgcgacagagagtcgcacagtgtgcaggtcacacacagaggagagcactaatacttatgctctan

SEQ ID NO: 680788 - DNA, 207 bp, Homo sapiens
ccttatcactatgttagtgtccaactccaagtgggatcaattccttagtataatattaaggcttactaatatcactgctttttccttatcttaattacttacttataatttatcctttattttaaattatctgtactatctagtgtctaaaacactattctccataaaaatcattcattttctagccctctccctcagtcctttatt

SEQ ID NO: 680789 - DNA, 971 bp, Homo sapiens
gccgaggatgggtgtaatgcctgagattgcacaagctgtggacgagatggctggctcctcccaactgatatccaggctgaatctatcccattgatcttacggaggaggtgatgtacttatggctgcagaaacaggcaagtggcaacaactggtgcttctccagtattccagttatccgagcatcagtttatgaaaactctgcaaagcaacgaaccaggaaggcaaacaacaggcaacaacacacacaattcaacaactggtgcttccagtgctgcaacaaatggcagatgaacccatatgcacagcaggcatctgcattttagccacattagggtccagcatggtcttcagtggtccaaagccagcagacagtcacaaggcaatggcccatgggtgtaacgcagctaacgtacacggcattccaatgcacacagggcacacaccactactcatgcaagatcagtcgctgaatcaagtgcaccacacggcgatcaactggacagaggacatccgaggatgcgagtcgtaacccactgaacagcgcacaatctacacggggaccacctacgagataacacatgaccaacgattgccgggccatgaacggacataagcagagatggcaacacgcagcgccaccacgacacaagaccccatatagagcagcaacacaaaataggataaaccatcaaatgggacaagaaagggcaatgccacaataagaggacaataggcagtaaacccaataggggagaagagggaagaagacatggagaaataataaaggaagtcaaagggcgggaagacaaggtaagcaaggataaacataacccgacaacaaacatgcgggaagaccggacagaaacgggaaacaaaggacaagtagggaaccagataacgcaagcgaacagaatagaaacacgaccaaagagccgaacgaaaaacgatgaataggaagacaggaaagaaaa

SEQ ID NO: 680790 - DNA, 327 bp, Homo sapiens
ccggccggtggtcataccaccagaatctcagcgagatctccaggtcatggaaaactagactcagaattttcatttggactgaggtggaacactttctgggtctgggctccctcataagcagcccctgagacaaatattcagtggcaagtagtttatcacagaggtgatcccatggaatacacatggaggaataagtaagtgagaaaaaaatgggaaggaagccagtcgagaatacttaatcaagccatttctactgtggacaaccagaattttatcctacgggggaactcaggtatgaacaacagtgcaggtatgaacaacagtgca

SEQ ID NO: 680791 - DNA, 194 bp, Homo sapiens
ctcgcctctgccccctaaccacagtaaaaaccaaagccactggcccctggatttaaagtcatttcagaccaccttgggggcctgccctgctctctccagaaagcctcaatctatgagaaatgaatgtttttgtgccctttctggacatgtgtagcatcctcagcattgacatccatgccaattttgagggattg

SEQ ID NO: 680792 - DNA, 394 bp, Homo sapiens
ctggaacttagtacccttaggcctctctggacagtatgtaagaactttttgtgggctcccccaaagaaacaaaaggaagcctgcccccttgtagccctgaacttttttttgggcccctgaatcccaggaaccctcaatgaggttttcaagatgaaaagactggtgccagctaccagcctggctggccctgtcctgtcccccctcattgcccccactcccatgttgttttgtgaagataaaagctggggtcttttttttttttttaagtctcccaagacatggggcatctcccccaatttaagttcctgtccctttggaaatttgtttttatggggccagtttgtcaaaaaaaaacaaagtttttgtatgaatacagaatgtgattttcgccaga

SEQ ID NO: 680793 - DNA, 130 bp, Homo sapiens
tccttttaacttttttaagtgggctcctcaaaatttcttggtgacaaatttttgggctcaagttgtgtttcccatttaaaaagttactgatttttaaaaacttaattaactttaaaactgtgccacacgc

SEQ ID NO: 680794 - DNA, 291 bp, Homo sapiens
caatcccctttgccatttttggtttcaatggggaccctcctccccttcccacctgtttttataatggtcagtgaaatggcccaggcttttcttccagggccatgcttggcaaggttggttgagggcaccctccttttttgcacccttgggacgagggcagggttgggttttccaatgcctccatcccatccccatggtgttttggcctcctcaaagcatcccccatggtggatggggtgaagtgggtatatttttttgattttttttttaataaaaaggaaaaggagcaga

SEQ ID NO: 680795 - DNA, 225 bp, Homo sapiens
tttaagaacaaacgtggggaacaaacgtggggcgctatggtatgtaaagaatacttatacactagaatactgcttcgagacgtatcatagtactatatccaaaagaagccacccacctcaaagagccctgcgcagccccacgtgacccatagagtgtggtagccggtcatttaattatagccactggtgggcaatcactcacaagtatacaccatacagagtgtg

SEQ ID NO: 680796 - DNA, 340 bp, Homo sapiens
  misc_feature (338)..(338): n is a, c, g, or t
gatagtgaatgagccaatgaaaatttaccttgaggttacaagccaggcacagaggcttatgctgtaatccccgcactttgggaggcggaggaggcggatcacttgaagtcaggtgtttgagtcgagcctggccaacatggtgaaaccctgtctctactaaaaacacaaaaattagccaggtatggtggtgcacacttgtaatcccagctacttgggaggctgaggtggaaggatcacttgaacccagctagtggaggtttcagtgagctgagagccaagattgcatcactgcattccagcctagacttggaaggcagcagactctgtcttcaaaaaanaa

SEQ ID NO: 680797 - DNA, 935 bp, Homo sapiens
  misc_feature (94)..(94): n is a, c, g, or t
  misc_feature (340)..(340): n is a, c, g, or t
  misc_feature (362)..(362): n is a, c, g, or t
  misc_feature (373)..(373): n is a, c, g, or t
  misc_feature (388)..(388): n is a, c, g, or t
gctctgtgacctgtttactgagcccagggcccagcccctggctgagggaagggctggcaggccgtgttttggtggcctcctccgtccgcctctnagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcanggctctgggagccagcaaggantggacagctgnccctgaccaggcagngactctgagggactccccctccaccctgggctacactgctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcgaggctagagtcccgcccccgatcgagtcccgctgccctccgttctcagagtcctgccaaggtaccgactgatc

SEQ ID NO: 680798 - DNA, 1237 bp, Homo sapiens
  misc_feature (94)..(94): n is a, c, g, or t
  misc_feature (340)..(340): n is a, c, g, or t
  misc_feature (362)..(362): n is a, c, g, or t
  misc_feature (373)..(373): n is a, c, g, or t
  misc_feature (388)..(388): n is a, c, g, or t
gctctgtgacctgtttactgagcccagggcccagcccctggctgagggaagggctggcaggccgtgttttggtggcctcctccgtccgcctctnagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcanggctctgggagccagcaaggantggacagctgnccctgaccaggcagngactctgagggactccccctccaccctgggctacactgctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcgaggctagagtcccgcccccgatcgagtcccgctgccctccgttctcaggcccctgctttagttgtttccgggccaccggggacagccatccttacaaggcgatgtgttcaccggtgtccttccccgccacacccacctctctgcgccgtgaattttgtcacttaagagtatagtttgcactccatccagcctgggcgactgagcgaggccctgtctctaaaagagtagagcttggggaaggttctgtgctggctcaatccatatcagaaagtttacccctcggccaggcacagtggatcacacctgtgaccctagcactgtgggaggccaagacagaccagcctgggcaacatagcaagactcgctctctctaaa

SEQ ID NO: 680799 - DNA, 153 bp, Homo sapiens
gggggcctctctagcttgcggcctgtgtctatggtcgggccctcttgtcgttccagcttgctccggaccgagctccgggttgtatttggggtgtgttaaggagagtgccgggccttccgggagacccctgactaaacgggccgtctcccacaa

SEQ ID NO: 680800 - DNA, 257 bp, Homo sapiens
tctagaggatcccagatgattgctccacgctcccggccatagagtggagtatattcagccttgaaagggaaggagattctcacacccactccaacatggatgaaccttgagggtgtcattctcagttaaataagccagttacaaaaacacacatgctgtatgtgattccgcttctgtgaggtctctagagcagtcagattcctagagacagcaagtagaagggtggttctcaggggctgccggagcggtgcacatgt

SEQ ID NO: 680801 - DNA, 164 bp, Homo sapiens
aagattctgtgggctcaagctgcggacgatgcgggacttgggaagaagaagtgaggcctccggatggggcaggctgaagggcaggtagtggtatgtatccctgggggctcccgggtgaagaacctgtcctgaaagagctcgtctataatgctggacgcgcggct

SEQ ID NO: 680802 - DNA, 240 bp, Homo sapiens
ttagcaccgacagtcagctggccccatgccacaccgtggcttctcggggactggcctgcattctcacacccgtgcttacaggcaaggatgggcatttgttgctcccctgccagcaaactcctttggaccaggaatcgatgccgatggtgttagcatacaagtcccgcttcaaggcacgctggtgaaacactctgagacggtcatgaaatcggcttttcatccctgtcgggctagtcgggg

SEQ ID NO: 680803 - DNA, 417 bp, Homo sapiens
  misc_feature (188)..(188): n is a, c, g, or t
ccataaacacgaatggctgctctccctaaaaaaatcacccatgcccatacaataacacaacaaaacccacaagtaccttatgaggcaaacagacgcaacatcccaaaaactttatcagcaatacattttacaaaaagaaaaggtggctgggcacaagtgcacgcctgtagtcccagcactttgggagnccaaggcaggtggatcacctgaggtcaggagttcgagaccagcctggccaacatggtgaaaccctgtctctactaaaaatacaaaaattagccaggcgtggtggctggcacgtttaatcccagctacttgggaggctgaggtaggagaatcgcttgaaccctggaggtggaggctgcagtgagctgagaccacatcactgcaccccagcctaggcaacaagagtgagtg

SEQ ID NO: 680804 - DNA, 706 bp, Homo sapiens
tgtgcgtcctggagggtgtctctgcccttccagacccatggatattgggctggctaccaccccactgctgaccagcgccaacgggttctggggtgcctgcacccgcaagatgtaatgctcgccatcgcccgcatccggcatgctcgcgacaaaatactgtttgccgttgaaatcgatggctttagcctcagacagttgcagctcctgacccacaggctccaccaacacttcaaggctcgcagtgggcatcaacgcctgcgccacttcatcgcgggacagggtttgaatcagctgtgcttcttcgattgcaaactgcccctgcagtgcttcggccacaccgtcgaacaccgccttggagattgcaccggactcgaaatcgcgcaacaacgcattcatttgttcgtgatggggttggttctgcgcctcgaaccgcgagcggtatttgttcgcgatgtagtcttgccagaattccctgacgagcatggtttgaaactcatgcaccgaattatccaggccgatcaccttatcgtacgcagcatcctgcatcgcctggctgacgttgccgaaacgaatgaacctggtctgctgcgcctggccaggcaagtcaagccgctctttaaggccgtaacgataggccagcctgatttccacttcttctagagcccttagagcgtcagccttctgcgtcgccgtcaggtcttcgcgg

SEQ ID NO: 680805 - DNA, 140 bp, Homo sapiens
tagtttagaagtttcaatagcaggcactctgagccttgtttggttactggtttgcctcgatagttccaataacagggccacctctgagtcttgtttgttaacttctaaaacgaggggctatcgaaacttctaaaactagg

SEQ ID NO: 680806 - DNA, 927 bp, Homo sapiens
ggacgcgtgggtcgacccacgcgtcgcccacgcgttcgctgtagacatatctgaagagatggattaagaatgctttgtattaacggattgtggagcacatttcaatcatttaggattgtcaaaaggaggattgaggaggatcagatcaataatggaggcaatggtatgactccaagtgctatgtcgcagatgaaattggcagtatagaccttatactaaaaggcaggggttatacaatgattatatacattttccttaaaatactagcaaacattttattcagttgtctgtagctacaattgcttgctttttaaaggctgggcaatgtggcgaaaattatattgcccattttgtagcaacttatttgctcccttccccccattttggttatatagtagggactaatgtgggaagaactggctagtttgtcacagtgcttagttgcaatcgtgttaattgtgtgacctgctgtggggtgtacagtgtgtggtacaggctgttttgaaatccaacaagatacgagtatagactatcaatactgtctaaatctgcatgtcctctgagtgactgatagagcgttgctatttcatttttttaagacaaaatgaaagcacaatataaagttccaatgtattggtgtgatatttattgggaatactttaagtctcacttccctttatactagtttccttaatggcgtcgaatgtttatgagactttatttgcaattggttgcaatgggacttaaattggttgtgactagggggggcctggcgacacttttggtactttggccgaacgttgtacgtaggacaggggattaagcaccgtacaaggtcccaggtctatgagtatgaaccaagtggggtggttagagacaaccaaaacaccgagggaggacaccagtggtagacaacaaataatgtag

SEQ ID NO: 680807 - DNA, 444 bp, Homo sapiens
  misc_feature (49)..(49): n is a, c, g, or t
  misc_feature (276)..(276): n is a, c, g, or t
  misc_feature (407)..(407): n is a, c, g, or t
  misc_feature (443)..(443): n is a, c, g, or t
gcatgcatttttcaatgggagatactaccgcaagagggcaaatgttgantcttgaaaggtgaaaaaaaatcttgaatataacaatggtttttgacccttcaaagggccatagtacataaacagatatataatacatttgtggcattaaagtttcctaggggtggctgggtagcgtggctcatgcttataattccagcactttgggaggccaaggcgggtggaccacttgaggtcaggagctcaaaaccagcctggccaatatggtgaaaccctgtnttttactaaaaacacaaaaattagctgggtgtggtggtgcatacctgtattcctagctacttgggaggctgaggcacgagaattgcttgaacctgggaggtggaggttgcagtgagctgagattgcaccantacactccagcctaggcaacagagggagactctgtnt

SEQ ID NO: 680808 - DNA, 1293 bp, Homo sapiens
actccatctcaaaaaaaaaaaaaaaaaaaattttaaaacggtgtcaggaaaaatttcaccaaggtaaaccgggtgattcctgggttgatagactctatctggcagtatatttatttcagtggtatcagaaccccaaagttgtgttggccttggtaaatctcttaaatatctctcacatttttggcaaacaattagcatgcctatcctctatagctacacactactggaattccactcttattagttagacaactacttacgagaatttaccaaatactgggctctgtgaaaaagtcttgggccctttattccaaccaatcttctatcagtttgtgccccacgtgaatttttccaacagtgttcgtgcgtggcgaaatgtcgcttatacactacagtctagaacaccgttgcaaaacactgtgacttcttacactttaaagaacagtggggcatagcagaagtgaaagtttctacagtgcgccttttacacacacacggcctatcttccacagctctcccaatcatatcttccaaacaccgtgctcggggcgcctgtgcctcggaaaatatgttggcctccatgcgcgtctccccgtggaactctcacgggaaacctcttaagtggaagcccacccgtgtggatcccctatacaaaatctacacctgtacccgccctaaaagaggaaccctttctccttacgcattcctcgcccggtatcatctagcaagaacaaatttccacggaaagtgtcccacatctttaacatttctcaccattcctaagctgggggcgtctttgcctataaccccaacaaaatctcaccacggggggctttcagccacgtctacacacctttcaaagcgcgcatcgcgagcatgtggcgtcccccatgttgtgttggtgcccccgtgtggtctcttccccctattagccaaccccccccaacgttgtacgccgcccgactataacatggtgtgccaaacattcccattttatacataaacgcgccccttttgtcacaccccaccagttgtcggggggcggcatatctctgtcattacaaatagcgctccacacaatttgtgggtgccagacacaacaccaatccttgtagcgaacacgcagactccttgggcacagtggccttctacgtggccctgtcttcctatggtgggaatatgtcccgatagtgacctgcttaacaacgaccagagggttctacttcagagggggacaccacttcaccgcaatttaactcattcttggtggtatgcccgtgtgtgtgaacaacc

SEQ ID NO: 680809 - DNA, 335 bp, Homo sapiens
  misc_feature (116)..(116): n is a, c, g, or t
cgccctggcgcactgctcttcccggtcatagaggcgccacgcccgtcttgtttctcctcctgttgcttgggactttgggccccggcgccgggcaagcgcttcctcccgaggaaccnccgttgatcattaaggacgttgaagcgcacagtggacctaaagcagccacctggctaaggtgacgcccgaggtggtcctggcgcacctggccggcggctccacgtcccagagctaccgctttcctgctcgcttttggagctgagctcaagcccggctcgcgcagcttgagagtacagataaaggcagagatgaggaacaccacagtttggagtgtacgt

SEQ ID NO: 680810 - DNA, 127 bp, Homo sapiens
aggacctctaagacatccttatgacgacagttttgtccaaggggatatccacagagtaccttgtggcattaggtgattgtagtcatacactttaaaaagattttatttctgatcttttggcgatctt

SEQ ID NO: 680811 - DNA, 300 bp, Homo sapiens
  misc_feature (82)..(82): n is a, c, g, or t
  misc_feature (84)..(84): n is a, c, g, or t
  misc_feature (86)..(86): n is a, c, g, or t
  misc_feature (99)..(99): n is a, c, g, or t
  misc_feature (106)..(106): n is a, c, g, or t
  misc_feature (160)..(160): n is a, c, g, or t
  misc_feature (227)..(227): n is a, c, g, or t
aagtgcggcttgctggcagagaggtacctttgggtcgtgggcgcctccgttgttggcctatacccttcataacatgacgacnantntccgttcgaatgncttatcngtggcggatgtctcctggatgagatatattcacgaacttgagatcctcggagancgaaggtagtccatccgtcgactgtcgattcaacgcttgtggtctatccgggcgacgggcatgggtnacttgtctcgatcgctcggcatctctgctctctcgattcactttgctcattgttcactccggtgatggtacgt

SEQ ID NO: 680812 - DNA, 209 bp, Homo sapiens
tgtctagcgatccctgtgcgcgagttccatcagaagagcttaatagagattaaacaaatagactttaattttagagaagttacatttacagaaaacatgagcacatagtacagtgttcttatatcccttctctacctttcagtttccctattattaatatcttgcattagtatggtacttctgttgcagttgatggaagcgtcgcgcat

SEQ ID NO: 680813 - DNA, 276 bp, Homo sapiens
cttttcatatctgactcctgtaaactatctataccaatggctactccccagaggtctgtaaaccctttaaacactgtatgtaaaattgtgtgactttccgtgcattttttgagaagagtaaccatagcttttttcttttttttttttttgaacactggccctctatttagctacctatatgcctgtggtgcagggttgtatctctgggcccatgtgggcaggcggtgccctcaaatatcggttgatgcttaaagttatttttttggttaaccaggc

SEQ ID NO: 680814 - DNA, 102 bp, Homo sapiens
ccactaggaccgtactactgcactgactaatttaggccttcaccacttctcagatgcagtatcttcttagctgacctccctgcctcatccacagctttcaca

SEQ ID NO: 680815 - DNA, 561 bp, Homo sapiens
  misc_feature (1)..(1): n is a, c, g, or t
  misc_feature (61)..(61): n is a, c, g, or t
  misc_feature (79)..(79): n is a, c, g, or t
  misc_feature (83)..(83): n is a, c, g, or t
  misc_feature (90)..(90): n is a, c, g, or t
  misc_feature (118)..(120): n is a, c, g, or t
  misc_feature (129)..(129): n is a, c, g, or t
  misc_feature (141)..(141): n is a, c, g, or t
  misc_feature (144)..(144): n is a, c, g, or t
  misc_feature (160)..(160): n is a, c, g, or t
  misc_feature (169)..(170): n is a, c, g, or t
  misc_feature (189)..(189): n is a, c, g, or t
  misc_feature (191)..(191): n is a, c, g, or t
  misc_feature (218)..(218): n is a, c, g, or t
  misc_feature (223)..(223): n is a, c, g, or t
  misc_feature (239)..(239): n is a, c, g, or t
  misc_feature (242)..(243): n is a, c, g, or t
  misc_feature (248)..(248): n is a, c, g, or t
  misc_feature (252)..(252): n is a, c, g, or t
  misc_feature (268)..(268): n is a, c, g, or t
  misc_feature (276)..(276): n is a, c, g, or t
  misc_feature (281)..(281): n is a, c, g, or t
  misc_feature (292)..(292): n is a, c, g, or t
  misc_feature (294)..(294): n is a, c, g, or t
  misc_feature (318)..(318): n is a, c, g, or t
  misc_feature (325)..(325): n is a, c, g, or t
  misc_feature (355)..(355): n is a, c, g, or t
  misc_feature (379)..(379): n is a, c, g, or t
  misc_feature (395)..(395): n is a, c, g, or t
  misc_feature (402)..(402): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (431)..(431): n is a, c, g, or t
  misc_feature (451)..(452): n is a, c, g, or t
  misc_feature (522)..(522): n is a, c, g, or t
ntccctctccatcccctcaccccaccccttagccagcggtgaagggaatggaaaatgagangccccgagggtcctgccngggnaggctgncccagacgtgtggtgagcagagtcagannngctgtggcnggggcagcagcngcnataggctcctccctanaaattaagnngctgaagccacagctgtgngncaaggatacttgtagaagcaagggagngcagnatgagaagggagaggnagnngcagngacncccagccatgggatgnacgggcangcgcnccgggctcagngncaccaacaggccaggtgggaaganggagagncagaataggccaggagcatggcaggttganggactgaggcccctaaattttggncccaggggaaaggaanaggccantncngnccagttttgatggctactggggnagggaatgtattgaggaagnntgggggggggagggggccagcaggcacctctagaggtgacaggacaggctgaaccccccaccctgacagnaatgagcttgagagctctggggctctctgggaatgtcac

SEQ ID NO: 680816 - DNA, 367 bp, Homo sapiens
ggagatcgtgacatcacagatagaggaaaaactttcaggactcatggcgagctgaaatgtagatgagtatcaagcagaacagaaattaactgcttgtactgaactaatctttcgacttttgacttaaaatgttgctgctccttagtttagtctatacagagtcttaaaacagtgggtctggagctatggataggtaatagcgaattcagtatacgtcccatgaacaaaattgggagactataagtttctctctacctgattactccagaagtttagaatgtatgcgtgagtattcttaacttatggcaatacagatatttgcataagatgcaataagaatctgttttcatttgtaaccgaacactac

SEQ ID NO: 680817 - DNA, 749 bp, Homo sapiens
  misc_feature (20)..(21): n is a, c, g, or t
  misc_feature (158)..(158): n is a, c, g, or t
gctttcggagggtggtgagnnagtctgcggacgctgtataccctcctccacttcccgctgcagccaataaaggccgttcctaccataaaaaaaaaaaaaaaaaaaaaaaaaaaaaaaaaaaatagaaaacaaaaaaaaaaaattaaaaaactttggtnggagcaatcttgacccatttaaactttagaagtgaaccaagcttatgcatgcggccgaaattgaggctaattaggccaattgcccctaaaaaagacaatataaaaattaactgaccgtggtaataaaccgacttgactgggaaaaacctggctttaccaaattaagttgccttagaaaaaatcaccctttcacaaatttggcttaataacaaaaaggccccgacgaatcgcctttccaaaaagttggcaaatcctgaatggaaaatgaaaatggtaagcgtaaaaattgtgtaaaaattacgaaaaaatttgagaaaaaaaactaattttttaacaaataggccaatatgggaaagattcctttaaaatcaaaaaaatcaaccgaaatagggttgaaggtaggcaaagttggaacaaaaagcaattataaaaaccggggtctcaaacgcaaaggccaaaaaaacctttttaagggctatggtcctttaggaaacaaatacttaaaaaaattttttgggatgaagtgccccaaaagattaaaaggaaaaccaaaagggcacccccatttaaaacttaacgggccgccggggc

SEQ ID NO: 680818 - DNA, 207 bp, Homo sapiens
  misc_feature (9)..(9): n is a, c, g, or t
agggagacntcgtctcgaaaaaaataaggtttgaaaatcactagtttaggctaagtgcagttatgtttaggtgtcaccaaggacgagtaagtatccttgtgtagctctcagtgcaatattagatatgcttttctttagtgggaaaatgaacagtttttgcatgcgactagtgtaacttgatacatttagtcatccactttggggtta

SEQ ID NO: 680819 - DNA, 675 bp, Homo sapiens
tgagcccccccccccccccccccccgcttacgaggtaccccacccgcaaacacacgcaccatactttcagaaaaagaactttaggacccctttcttcgcgcgcccttgctccgtcctcctacggcttacgacgttagtcgaggccgctagcataacgaaattaaatcggtgggacggaagtagaccacctcgttacccccttaggctcccgagccgtatgctaaactcggggtcgactattttatatccgcccagttcgttcgcgaggcctataataacccctttagtctcgcggctactaacgaccctaaacctgttaacgcaattacgtcctactactatagcgagaaattggatgacgatcccggagtatggttcaacaagtattcggtgcccgttcgctcccctggtacggccgacatctccgagagtactcgttaggatacctacgtgtattaccgcggtctgcgttgaaccttcgtagtttgggggacttatcagcctcagagtggctgctattgtcgcggagtcttaaccggtttcacagcgagctgcaccatgtgtgtctatcggttgctgccccataatgccgcgatcgggaaaatttcggtgccttttaatccaacttttccggactatacattttccctgttagtcggtccaacaattaagaat

SEQ ID NO: 680820 - DNA, 514 bp, Homo sapiens
tgaatgataacagctccatcagtgattctacggagccaggcatcatatcctagggcacaggaaaatgcttcagacaattatattgccgttctgtgtgattacattcatcatctttgagaatgcttactgggtcgtagtgagtctggtgtctgatatatagcaggcaaatgagtagcagtacagctacctcccaatcaaagcccatggttccttgagtgtaaactgcaggacatgcagtgccgtctgacacgtgagctacagctcatcccaggcagtgtcatatctgtggcagagaagcaagctgcagattgttgcttcattaggaataagttgaaacaaatgtttggagccaccttttgcagtgcacacatctatcacacatccataactattaggacatttagagcctagggatccaataagctgtgtacctgtcataaaagtcaggagttccatcagagtcactccaatactgtctatggcaatactacgatgcatattgagaaactgcttc

SEQ ID NO: 680821 - DNA, 245 bp, Homo sapiens
aggcacaagagtctgaagcagcaagaaccagctaaacttgggtgtgggaggtaatgtatgaataaggtgtcagttctaaaggaagagaaggtgaagtttgagcagcagagattacaggtaagcttacatatgagccaaattgtgattggatgcagtgcgctacacctgtagtcccagctacttgggcggcccagcgcagggaggtttgcttatcgccacgaatgtcaacaatagtaaaacactgt

SEQ ID NO: 680822 - DNA, 332 bp, Homo sapiens
cccgtgaacctttactgtactctgattttggcttctgactttccatgtgtaggataactgggagacactgaagcgggctcgttagggctcgcggagtcaccgttgaaataccagtcttggagagtcggaaatctaacgatatttcatgaaactggaaatcggacaatgtcagacgggcagtttgactggggcggtatcctcccaaaaagtaacggaggagtccaaagcttacctcatcgtggttggcaatcacgaaacgagcgtaaaggtataaggtaggttaactgcgagaccaacaagtcaagcaggtacgaaagtagggcttagtgccg

SEQ ID NO: 680823 - DNA, 676 bp, Homo sapiens
ctctccacacagagattttgaagcttgtcccacaggctgcttggcaggaaagatattcctctttaatggcatgtaagttacctgtggaggatgtccaccctctgtctcaggcctttgatcaaattaaaggcagtgaaacagcaccttcaacctggaggaatacagcctctctcaggctaccttggagcaggtgttctctagaactctgtcaagagcaggcgctgggaaatgttgatgataaaattgatagtaacagttcgatggaaacttctcccagcaggaagattcttaaacagcgaagaaggctcctaacattcaaggttgctaagtcctactgcattattacgtttccataattcgtacggagaatgttgtccttttacttcagttaacaagatagaaaatattcaatgaggtttaaacatgcaacgaagtgagttagagtttttcatttttaagaaagttttaggatgaaggagaacaaggaaatatagggaaaagtagcagacaaaattaacaaagctcagacatgttattcatccccaagatgggtctattgggtgcttaaaagagtaattttagaaactcataaacatatgaggttagtgtatatggttagttatcaagtaaaagttaacgactggagcaccatgtgacaaacaaagacaaggcaaag

SEQ ID NO: 680824 - DNA, 1164 bp, Homo sapiens
gaaataggacaataataaaactaaacaaattagaaaaaaaataacacaattagaaaaaataaaaagtattaacgtagttcttgtacgattaaatgggtaaagtgtcagctcagccagaaacagtaccaattagtaaattcgtaattcgaatacggcaatacataaaatcaatagagattctgacaaagagttatcagtatagcctgccacaacaatgtgcatctacatatatgcccagctccttaatcaagatacaacacacattcatgaaaactgacacatatatacacccagcacgaatattaccaagaatcaggctatctgagaaataacccacaatactcaacgacataaaccaattaaacataggcacatatcgctatgtagaacagcttcaacatagagacttatataccacaactagttcaaagaaacatatcctcctggccgggctgtaggtggccatcaggccatggatcatcccaaccacattatggcgagtgcacgaatggtcaggataggacatcacaaggatgtcagcgacgttccgaagaacccaagcacatggcgcaaacaatgaggtgaaaacactgatatatctacacatatcaagaaaaatttacgaactacacactactacacccagtggccacttggtggtcagcacatgaccttgtgaaatccccaacaatacgtacgaggagagcctgtgagaacaggtgagcacattgcgtgtgaaccacaaaagaaagcaaagaggttagcaactagagtcgagagcatcgaacccattggacccaatccactgtcattagctgatagtacaacaaatcaaacaacatacacatcctacaatctatataaatcacaatacaacaataataaacaccatatatcttcccaaacaccaaaatcaaaacaacacaaatcataacaatttttttcccatcactatacctcaaataaaatcttttaatacaataaatgatcatagataactaataaatcaaccaaaatccactttacgtatcatatagataaaacaagtccaaaacaataactataattcacctataataaaacattaccacaactacattcatacttaatataacttaaaaaagtgtaataaacatctactccattattaacccacgcgaaacc

SEQ ID NO: 680825 - DNA, 112 bp, Homo sapiens
  misc_feature (72)..(72): n is a, c, g, or t
ccaacctcgatgccataggaactgcaaccactaatttcctaaacttctagagccgactgatataaccggcanatatgagcaaccgcttcgtatcgtggactgaagcaaataa

SEQ ID NO: 680826 - DNA, 245 bp, Homo sapiens
gtgttgtggcgcatgcctgcagacccagccactcgggaggctgaggcaggagaaccgcccgaacccgggaggcggaggttgcaccactgcactccagcctgggcgagagcgagactccatctcaaaaaacagattctttctcactgtggactgagatttcatggagagcactgggagagcctggctccgtgaaccccagggtctgtaagatctcatgtggccctgaccggtgcgcatgacaccaa

SEQ ID NO: 680827 - DNA, 379 bp, Homo sapiens
gctcgcatgaacgccagagactggacaactagggacatcctaccccaaacccattgaaaggattcaagctaggcaatcctagacctgctcactctgcctctcaggttccttcctaagcaaaccacaataaaggctcttgccccacagttcccctccctccctctgcccccgaccaacactggtgcttccccgtgtggcccgtgttagtgtgcggtgccgcctgtttctagggaactgtgagtataagcttcttcccaccatggcagtcatttctgtgtctgttacatcatatctaaggacaacaaatccaaggtgtccttacaacaactggcgcagtgagcagggtggtttgatgccagatggagatggtatgtcctca

SEQ ID NO: 680828 - DNA, 136 bp, Homo sapiens
cgtatctaggtcttttgtgttagtgaaaatgaggtgaatggtatatatatatatcttcatcgatatctatatctatctatctatctatctatctatctatctatctatctatctatctttctttcttttttttttt

SEQ ID NO: 680829 - DNA, 138 bp, Homo sapiens
ccgatggcgaagtattccatgtgtgttaggtctagtgaaagccccatctatggctgtgcacttcaggacacttgaattactttcgtgcggttaccttgataactgctttaccccgtgacgtaggccacatggagtcca

SEQ ID NO: 680830 - DNA, 106 bp, Homo sapiens
tacaggatctatgatgaggaagtactatagagaggttcttgggtatcggcgacgccctcctatcaagcgaggccgcaggcttcggaggcgtgcgctgctgctgggt

SEQ ID NO: 680831 - DNA, 126 bp, Homo sapiens
ctataatatgacacaagacatagaacactatactattatcggcgcatgggctgaagtctagagcacagctctaagcctccttattcgagccgagctgggccagccaggcaaccttctaggtaacga

SEQ ID NO: 680832 - DNA, 953 bp, Homo sapiens
agataccaccgaagagccacacccatctagtcaagatcaatgtgctacacagagaccaggatagtgcgcatctccctggctcaccaaggaccctcctcaccggccgtcacccccacgagcttgtaggaaaggactgccgggatggcttctatagactgctgagctctgagccggtgctcgcgtgggatcctacagtgttcgcagaactctggtgaatccccgttgtgtgcagagaagccgggacctggagctaggcttatcgagtcaggcgcgatccagcaccaaatgaagcaacccccttccaagttctctatagaacaagcagtggctggggagtactgagctgaagtgctggtgcgggtctgggttctcgaggttggactagatgcagggaatccctatcagggcaggcgcgcctccggcctgccgcactgatcgcgttgcatcagtcccatctttggactgatcgttgccgcgcacaaagactgtgcgaagctcaagatctgcctgagtgacaccgagaatgtctggcagctgcctcggtgtgggatgatgatctatcgctactgtgtgacgacggtgcggaaggaggacattgaggtgtatgtcacggtgaccagtgctggtgaggcccgagtgctccttttcgctaagctgatgtgcagcgcacgagtggccttgtgttccaggaacccctttcctacgtggacgtgcaggccgtgggagggctccgtgtgcgtgttgtccagtgcaagctgggggggtcttgcgagcgcggagcttattgatgccatgggaggttccagtaccttggccgagtatcgacgactggcccgggttggggtgaacgttaagggcgtttttccccttggaggctcgcggaggaggtctttcggccggcgcccgggggtccccggggttgttggcgcccggaaaagttgtccccaggcccg

SEQ ID NO: 680833 - DNA, 230 bp, Homo sapiens
agcggggaacatggataggggccgatagcccagggctgggctgatacatcttggccttggcggttacggggcattggtatcacggatgctccagttaagtctccattcaggtgtagagagaggaatcctgggatacggtgagggcatttccaagtccttattggcatatctggatgatatatgggagtgtgaagaaatgcatgatcatcacaaagggatggttccccgcg

SEQ ID NO: 680834 - DNA, 127 bp, Homo sapiens
gcacttgccttcacttaattcctgagatcattttatcagtacatactgagagccccttccttttatttaaataaccacagggtatgtttttacaacttattatttgttatacacaaatttcaaacat

SEQ ID NO: 680835 - DNA, 383 bp, Homo sapiens
acccgacatgtcccttttcccaaaaccccccaaagtgaaaatttgcttctgttctgtgacctagaatgtgtcccgaccttaaaggtcctgaatactcctttacctgtaaaaattgtaacactgctctggcctggttttgacgtccgtgtttatgtaataacttccgtgttttatttaaaatgggtaaatttgtgaaataacaattttttggggaccgtcaaccttttatggtttaatctaaaggttttcatttacatgtcaacgggtatctgaatcccccgtgaaactgttaagttttccttaaatgactctgctgcaatactagtttttttctccgaaaatggaattcaaataaaataagttttttggtcttggcctttcca

SEQ ID NO: 680836 - DNA, 510 bp, Homo sapiens
  misc_feature (7)..(7): n is a, c, g, or t
  misc_feature (31)..(31): n is a, c, g, or t
  misc_feature (52)..(52): n is a, c, g, or t
  misc_feature (71)..(71): n is a, c, g, or t
  misc_feature (86)..(86): n is a, c, g, or t
  misc_feature (103)..(103): n is a, c, g, or t
  misc_feature (145)..(145): n is a, c, g, or t
  misc_feature (149)..(149): n is a, c, g, or t
  misc_feature (169)..(169): n is a, c, g, or t
  misc_feature (182)..(182): n is a, c, g, or t
  misc_feature (220)..(220): n is a, c, g, or t
  misc_feature (226)..(226): n is a, c, g, or t
  misc_feature (240)..(240): n is a, c, g, or t
  misc_feature (242)..(242): n is a, c, g, or t
  misc_feature (256)..(256): n is a, c, g, or t
  misc_feature (282)..(282): n is a, c, g, or t
  misc_feature (332)..(332): n is a, c, g, or t
  misc_feature (351)..(351): n is a, c, g, or t
  misc_feature (415)..(415): n is a, c, g, or t
  misc_feature (487)..(487): n is a, c, g, or t
taaaaancggcatgctcctttatttgttcanaagagcagccagcatcacccncgccactcaaacctggcanaaacgcttcggaganaatggcctcgggacccncaagctgcggggcccaggagaaaaagttctgaggcagaaacncggngtccaaggggggccgcgggncaggcactgtggngaagggaacgccggggagtccggccccaccttgcagcngggganacgggggcgcaaananagggggcaggctantgtcccgctgccccaggaacaaaccncagggccccaggagggtctgcaggcagcaaggagcctgccaagtgctggnggaagtagaggccgaaaangctggcgagcagctggcaggcagccgtccaccaaaagaggtaggccaggacgccacggaggaanaggggagttagccggccacccagggccccggcaatccgcgctgcagtttgctggacttcgtcctccccaaanccgatgggggcagcgctggctga

SEQ ID NO: 680837 - DNA, 911 bp, Homo sapiens
gacttggacggagccgagctgaggctcggcttcctgctgatggtcaggatttttggcaactccccggtgtgagagtgggtagggatgtgctcccggcggctgacggggccgagttcaccagccgccggggcagtagtcgaaggccctggcgcgtgcatgtcctgggtgcctgcggtgcgtggcagtgaactgctgcgccgtggcgtggatgggccggctgccgtgtgcgccagaagctgtacctgggctccgttccctgtttgtacgcgcttcagggtctgaccccagcacttgggctgctcatcgctgcgggcggaggaggcgccgcaagacaggcataaagaatggcgtgcactttcttgcagctagagctgattaatgggctgcttgaagttgcctccttgcttgcactcccatgacacaggagacacggggaccaccatgaacttggcactggctggtgacatccttgctgcagggcaggatgcccacgtgtcagcatcctgcgcttccaggcacatcaagcagcagggcaacgaaggcagagaaggccggttccaaaggagcacgggggctcgacgaaggaagggagcaagcccccagcaagagaaggaaatgtggagcgggaaagccaggatgatggggctagaagttcagggtaggagaatttgcggggcgggtggagagagagctttaggtcggatcaggtgcagaaaagttgtgtgctttagacgagataatacccgttgttgacaagtggaggaacagatggatacgtaccggtgctggaaagtgaccaggcttgacaaggtcttggagtggaaggcacgaaggggagattgaggcggtgtttaggtgctgattgagaagtgggtaggggttggcgtaccttagggtattttgtgcaagtg

SEQ ID NO: 680838 - DNA, 158 bp, Homo sapiens
aaccttttttggggggtttttttttccaagggtttaaaaggtgtgggggccaaaagaagggcccccccctgccctcctcccccctggggctttcccgccccccatttggttaaagggtggggaccccgtcccctaattaaagttttttgggtttctca

SEQ ID NO: 680839 - DNA, 1570 bp, Homo sapiens
  misc_feature (350)..(351): n is a, c, g, or t
  misc_feature (356)..(356): n is a, c, g, or t
  misc_feature (373)..(373): n is a, c, g, or t
  misc_feature (402)..(402): n is a, c, g, or t
  misc_feature (420)..(420): n is a, c, g, or t
  misc_feature (487)..(487): n is a, c, g, or t
  misc_feature (499)..(499): n is a, c, g, or t
  misc_feature (696)..(696): n is a, c, g, or t
  misc_feature (768)..(768): n is a, c, g, or t
ctaagactcctactctctcatcgtaccggatttgtaacttgcaatgagtaaattcctaactgttataccgaatcgcatatatacttgtagtgctatattactgatctacgcttaggcctcacaacacgtttagtaacgccacccttacagcgtgactactacaacactcctttcgactgcatcgaccgaataaataacatacattcgatcctagaaagcattgactcccttgaacacagcccagtcatcacttatactccatcatcgctccttacatcataccgtcaccgcgcaactccttatgtactactacacacagatcgacgtgcttacatacgcatattgcaatnnccctnctactcacctcaatacntcacaattgcggcccatggcatacatggntatcatgacactacgtancgcatgtaaacatctcgattttaacgggcggactctatagtccttacaaccgtctcttacattaacnttcctcctgcanttagtggccttaggacaactcagggacgtaccctgcgcgaaagcttcccttgtgaatcgggttgaacccacatgtcgaaaggatagcttaactccccgaaatatgatacgtcacctctctaatatcgtctactacacctaaattttactacatctatcataagcatcgtttcattgactatattctaatgtaagacntggttcctccatctattatagcgttcctttacaacaaacctagaattgacaaaatatcccccggaaaaccanctctacataactataaatcacctttttcatcccgtgtaacacctgagagccgcgggaggttataagcattactgagtcaacactatgccttctttggacacagtacgtaggtcggacggcgaaaaacccaccatgtttgtaccacttgtcgcccagtacaggtgcgcgtaagtaacacttaaattttaagctccctttaaagagacatttctttttcgataccataagtgggcccccggttaaatgtgtaaccccccttttaattaaagacaattaactctcccctttctaataaacgcccccgttaatataaggaaagacccaaataattttacatgtgcatctaaattagagaacaacgccacgtgaggagggcgaggggagacacaagtttctatagcgttttattgcacccccacaggatgggttggcacccgacaattattaacgccgcttgggacaccgcgtcttttgctttggaaacacaagcgggtgggggcaccacagaaaacggggagggttggtaaaatccatcacgcgtaggcgggactgtggacctcggcgatataacaaaacccccggacattcggggggaacacaagcgaacacgagttgaacacctcctgtggaagagggcagcctctcatcccacgggggcgcgagcaacatggcgtacgacaagctctcaaagagagaataacgactccggcgagtaagcacacatcccaggtaaaagtagaagagcggcgcgccaatattattcgtgcggaggagtttcggtaatgttgaatcacaacagact

SEQ ID NO: 680840 - DNA, 617 bp, Homo sapiens
ggtgaacaggagccgcgttcctatcccgcttatgggaactcttggggacaagagccgccccaggccgcctggatggcccgaggcaagggtgctgaccccaggaccccaggcacggcctccgggaacccaatacccatggccccggagtccccctaagaccctataacggttctgtctgtctgtctaatccgtctacaggtctctgctgtcccatgtgagtctcccccccgccggtccctgtgctgtgggaatgagcgccacctggcacgcccgggagtgggcccgggagaccggggaccccggccaagggattccatggccctaggtcacactgcggcccgggcaagtccacgggcaggactgaactcgccctcggaatcaaggggaagaactgggtccccacgggcatgggccaggagggaccccggcccgcgagggacccgagaggccggtccccctggcatgccaccgagcccccgaagggagggaagattcccgaatcgagagagggagggatcaaggtggaacccctagagtgagcctcctgtagaccccgaagcggttgcctctctccattgaattaattaattagttaataaaattaaccccctgtttta

SEQ ID NO: 680841 - DNA, 367 bp, Homo sapiens
cagttttaatggtgatcctacgcggccgctacagacgcttttgggtagaggggtcacagtacttaactgtgagggcgttgctatagctgaatgagcacgtggcgtgatgaccttcatgcgttaagttttcaatccataatgtgatggtgaacttatgaagcgtttaattgcgttaccctttagtgcgttgatggtggtgtctgttcaggtgtctgcgctttgcttgaatatttcagagagcttcaccgggataatcgggcctggaggtgatagtgtcgcccatggtcccttcacgataagtggtgcgaacggttgctccggcgcaagtataaatgccatggtttccgctggcggtgcagggagaagt

SEQ ID NO: 680842 - DNA, 167 bp, Homo sapiens
catcgcacaaacaccgcaatctcatccctcttggcctttgcttttattcttgcagtttgcattggaggggacaatcaaagaaggtgtgggcataaaaaaaagctagtgatcaacagtggcaatggagctgtggaggacataaagccaagtggactcaacggaaaggc

SEQ ID NO: 680843 - DNA, 164 bp, Homo sapiens
  misc_feature (116)..(116): n is a, c, g, or t
tgaatgagtgatctcagctcactgcactctagcctgagtgacacagtgagactccatctcaaaaagcgaaaacaaaacaaaacaaaacaaaaacaaccagcaacacaaagggcccntccttaggtcagtggtcatgaatttaacagggagagccaggtcagctt

SEQ ID NO: 680844 - DNA, 131 bp, Homo sapiens
tcgtggcccatggtaaggcattctaagtcacaggatgcacattgtaaagactttgctgataaaacaggtacagtactacagtgagctctggttgtcctcactgctacactctcgtggcatcgataacaccg

SEQ ID NO: 680845 - DNA, 598 bp, Homo sapiens
ctcgggacagtagcaatcttatatattcccacatgctaggaccagcacacagtgaaccagtaggcactcagtgttgaatgctcaaaccaggtaatctgcttcctgtagttaccctgctgagcactgcttccatcacaggtgcactgggcctcaacacttctgccatttccccatttgtctcctccatggacactgtcaacaatggtctgtcaacacctgctctgtgccaaagccagggagtaggctggggggatacggaagagaatatctttctccttgatgcctgctgtgccaacagccccctttaagccttgttcacagcctttgctgaaacaagcatcttgaaagcaagccatgttatacaccgcatgaccttcatgctctggcccagctgactgaactggggcaggccccagagtcatgggcagcctattgtcttgctaatggcctctgacttagcctggagtaaaacactgtccaaacaagactggtggttattcaagcataagaatttgaactaggaagccaagaatgaagcaaccggaccattaccatcaaaacatgattacaggatgaagaaggaagccaacattcagag

SEQ ID NO: 680846 - DNA, 608 bp, Homo sapiens
  misc_feature (510)..(510): n is a, c, g, or t
cacagcgctgggctaggggcgcggcttgaactcgcctaaagagctgcgcctctcacccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaccaaaattttaaactctttataaatacccaaaattaattccnccgtgggggaaaataacaaaatccctctgagggggggccccgtcccccaattcgccctatagggagttggtttaaatattaacgggcccgggttttac

SEQ ID NO: 680847 - DNA, 495 bp, Homo sapiens
gaggggcggtgtctccaaggggcggggtcccggggtccctgaaaggcgcggaccaggccggatccacccagtctcgcgcctgcagcccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttgga

SEQ ID NO: 680848 - DNA, 488 bp, Homo sapiens
  misc_feature (80)..(80): n is a, c, g, or t
  misc_feature (167)..(167): n is a, c, g, or t
  misc_feature (324)..(324): n is a, c, g, or t
catcctgatagaagagtgtgcatctctggactagtctcaaggggtactggctgtgtgaggtgtagtctgccctagtggtngtgcctccagtatgctatcagggatcaggggaccacttgaggagcagtctctccattctcagatctcagactccgtcctgggagaancactactcgcttcaaagctgtcagacaagggcatttaagtctgtggaggtttctgctgccttttgttcggcttgtgccttgccccaaagagtaagagtctacagaggcaggcagggctccttgagctgtggtgggctcccccagttcgagcttcctnggcgctttgtttacctactcaagcctcagcaatggtgggcacccctcccccagcctcgctgctgccttgcagttcgatctcagactgctgtgctagcaatgagcgaggctcatgggcgtggaacctccaagccacgcgagggatataatctcctgggtgtgcgt

SEQ ID NO: 680849 - DNA, 638 bp, Homo sapiens
  misc_feature (540)..(540): n is a, c, g, or t
gaggggcggtgtctccaaggggcggggtcccggggtccctgaaaggcgcggaccaggccggatccacccagtctcgcgcctgcagcccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaccaaaattttaaactctttataaatacccaaaattaattccnccgtgggggaaaataacaaaatccctctgagggggggccccgtcccccaattcgccctatagggagttggtttaaatattaacgggcccgggttttac

SEQ ID NO: 680850 - DNA, 449 bp, Homo sapiens
gcgaattcactagtgattccccaccaagcctgtttgagcagccatggggagtgtgaggggcaccatgccccactccctacttgccaagtggccatttccccccactggggtgcaaaggtggcagtaaccgccctgtttttctcgcttggcttgtacaacccgtgcctgagtcagagccctggaggccacctccccagcctgctgtttacaaacataccaagcctgcccaggactacaccggtggcccatgggtgcattatggagtgagaggacagccactccacgaagtgagtgagaacaccagactgtcccttcccatggggcatgccatcaggcccagggatcaccagaacctgacactgctgggttgcaaatagggcttcatgtgagccaaatgttggcatactcaaagtgtgaggaataggatggtagagtcatgtgacttgctc

SEQ ID NO: 680851 - DNA, 812 bp, Homo sapiens
ggacacctggactagccggttggtattaggaaacgcggcagttgagtttatattccgctgcattgtgtaggggctaatcaatgtgatcagccctaagaagggacgttcaaacctcctgaagtcatgcaatcaaatgatatatatctgggtggagaagtgtcacacagtaaaatgaaataatacatctatgggattccaagtcagatgactagagatatgtgtgattacagagataatgtacaatgaaaaggactaggagattggtcgttatttagatagttcgaggaatgctggggaacttcagaggtaactgttattgcactgtatatcgtgtgggattagtgtcttttcccgagttgtctgaattggttggtatacgactatgacgaattttcggctgtaacaagatatgttacgcgcgcctgtatggttgcggagaagagtacattgttacgcagaggttcgctcctacagttgagaactccgtgataatactacaagatagatatacaaaatccttgtataaacagctgtttattttaccaatattactatatttcctatgtgactaacagtattaaattgtatagaaatttaaggcaatagtaaggaggaattgaaataaatcaagtgtgagatcagaaacaaattgatttaatagtacttataaataatatagtttaatgttgaattgtggtatggtgtcctcattggttttcgaaaatatcttcgggtgtgcaggagtcacctagttgagaatggtggtcgacttacggtaagcgcagacacagcacaggaaatttgagtgaggg

SEQ ID NO: 680852 - DNA, 507 bp, Homo sapiens
ggggattggagatgttcccctcatggagggtgctgaggaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttgga

SEQ ID NO: 680853 - DNA, 121 bp, Homo sapiens
cttcggtactgtttattaaatcagccgaggtacttccctggggaatatcctttctttctttctttctttcgagacggagtcttgctctgtcgcccaggctagagtgcagtggtgcaatctc

SEQ ID NO: 680854 - DNA, 932 bp, Homo sapiens
  misc_feature (65)..(65): n is a, c, g, or t
  misc_feature (95)..(95): n is a, c, g, or t
  misc_feature (120)..(120): n is a, c, g, or t
  misc_feature (139)..(139): n is a, c, g, or t
  misc_feature (151)..(151): n is a, c, g, or t
  misc_feature (157)..(157): n is a, c, g, or t
  misc_feature (177)..(177): n is a, c, g, or t
  misc_feature (193)..(193): n is a, c, g, or t
  misc_feature (195)..(195): n is a, c, g, or t
  misc_feature (209)..(209): n is a, c, g, or t
  misc_feature (224)..(224): n is a, c, g, or t
  misc_feature (226)..(226): n is a, c, g, or t
  misc_feature (238)..(238): n is a, c, g, or t
  misc_feature (352)..(352): n is a, c, g, or t
  misc_feature (358)..(358): n is a, c, g, or t
  misc_feature (361)..(361): n is a, c, g, or t
  misc_feature (372)..(372): n is a, c, g, or t
  misc_feature (377)..(377): n is a, c, g, or t
  misc_feature (379)..(379): n is a, c, g, or t
  misc_feature (388)..(388): n is a, c, g, or t
  misc_feature (409)..(409): n is a, c, g, or t
  misc_feature (415)..(415): n is a, c, g, or t
  misc_feature (495)..(495): n is a, c, g, or t
  misc_feature (575)..(576): n is a, c, g, or t
  misc_feature (585)..(585): n is a, c, g, or t
  misc_feature (597)..(597): n is a, c, g, or t
  misc_feature (624)..(624): n is a, c, g, or t
  misc_feature (691)..(691): n is a, c, g, or t
  misc_feature (787)..(787): n is a, c, g, or t
  misc_feature (809)..(809): n is a, c, g, or t
  misc_feature (845)..(845): n is a, c, g, or t
  misc_feature (907)..(907): n is a, c, g, or t
tattacgtttataattatccagagacttgaacatgccatgtcctctgaagaaggaaagctcttcntgggagggctcaactttaacaccgacgagnaggcactggaagaccacttcagcantttcggacctatctctgangtggtcgttgtnaaggancgggaaactcagcggtccangggttttggtttcatnancttcaccaacccanagcatgcttcagttncnatgagaaccatnaacaggagaggtggggcctcctatctgcagagggaccttgtccccatctgcgagcttccttcattctttttgtttttccctctgtagtcatgctcggggcagacgtgagcaacnaagccncgnagtgcccactnacagnancatgactgncttttgttctagggggtgganggcaanggcagacaaagccataggccgcctgggaggcgacgactggtcctgcatgaggccgagaagccacctgatggatggttganctgcctatgggcttaggatagtagaatctgcagacactgtgggcctggcccggagaggaactcgtgagtcttctgacatnnactctgaancctcaaaccaanagaggtgtctgtctagccctgatagtngggcagcttagaggagtggggaggagaactcagcctgagttcagtcaagattctctggatggtcgtnagatccgtgtggatcatgcaggcaagtctgctcgggggaacagaggaggtggctttggggcccatgggcgtggtcgcagctactctagaggtggtngggacagggctatgggagtggnagtattatgacagtcgacctggagggtatggatatngatatagacgttccagagactataatggcagaaacaagggtggttatgaccgctactcaggngggaattacagagacaattatgaca

SEQ ID NO: 680855 - DNA, 650 bp, Homo sapiens
  misc_feature (552)..(552): n is a, c, g, or t
ggggattggagatgttcccctcatggagggtgctgaggaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaccaaaattttaaactctttataaatacccaaaattaattccnccgtgggggaaaataacaaaatccctctgagggggggccccgtcccccaattcgccctatagggagttggtttaaatattaacgggcccgggttttac

SEQ ID NO: 680856 - DNA, 465 bp, Homo sapiens
cacagcgctgggctaggggcgcggcttgaactcgcctaaagagctgcgcctctcacccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttgga

SEQ ID NO: 680857 - DNA, 409 bp, Homo sapiens
gaccaatcctgccggtaggctgaacagaccatcctacggtcgtggttacggtgggaagtgtagaagacggcctgtctttcaggctataaggcccgtaagatatacaaaagcctaatcttatacaataagtgggatctggaagcctgcgtggatgcggccctgctggccacccagatggaccgcgtgaacgccatccccttaacctaccagcagctggacgtcctaaagcataaactggatgagctttacccacaaggttaccctgagtatgtgatccagcacctgggctacctcttcctcaagatgagccctgaggacattcgcaagtggaatgtgacgtccttggagaccctgaaggctttgcttgaagtcaacaaagggcacgaaatgagtcctcaggtggccaccc

SEQ ID NO: 680858 - DNA, 97 bp, Homo sapiens
gcccttcccccccccgccccatccccggaaaaaggggtggagccccccccctgttttttgaccaaccgggtttttaattaacccctggggcccccca

SEQ ID NO: 680859 - DNA, 504 bp, Homo sapiens
  misc_feature (406)..(406): n is a, c, g, or t
gaggggcggtgtctccaaggggcggggtcccggggtccctgaaaggcgcggaccaggccggatccacccagtctcgcgcctgcagcccgtgccgccccagccgctgccgcctgcaccggacccggagccgccatgcccaagtgtcccaagtgcaacaaggaggtgtacttcgccgagagggtgacctctctgggcaaggactggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaccaaaattttaaactctttataaatacccaaaattaattccnccgtgggggaaaataacaaaatccctctgagggggggccccgtcccccaattcgccctatagggagttggtttaaatattaacgggcccgggttttac

SEQ ID NO: 680860 - DNA, 289 bp, Homo sapiens
aaaagaagtacggtaaggcaaatcctgaaattaagagttactatgtgcctgaaaatacattgttctactcatttagtgtgatggcaatgggcgccggcgcactcttgctatcgaccatcgtcgcgctttggatgaaccgtcgtaagtcacaattaatgtagacacaacgtcgattctcgtgacttatggggatcgcaactttcgcgccattctcgatcaacacagccggttggtcagtgactgaattaggtcgttatccatgggttgtttatggcttgatgctaatagc

SEQ ID NO: 680861 - DNA, 348 bp, Homo sapiens
gaggggcggtgtctccaaggggcggggtcccggggtccctgaaaggcgcggaccaggccggatccacccagtctcgcgcctgcagcccgtgccgccccagccgctgccgcctgcaccggacccggagccgccatgcccaagtgtcccaagtgcaacaaggaggtgtacttcgccgagagggtgacctctctgggcaaggactggcatcggcctggacagtggccctgcaagcagccaaggagaggggtctccaccacctggttacttgaaagtgtggctactcggctaccgccccgcccaaagcctttaggcccaaacatgcagcgtaggggatcactctcagagcaa

SEQ ID NO: 680862 - DNA, 422 bp, Homo sapiens
  misc_feature (23)..(23): n is a, c, g, or t
  misc_feature (42)..(42): n is a, c, g, or t
  misc_feature (145)..(145): n is a, c, g, or t
  misc_feature (391)..(391): n is a, c, g, or t
  misc_feature (395)..(395): n is a, c, g, or t
  misc_feature (411)..(412): n is a, c, g, or t
gccaatcccccagccccaagctnaaacactgtgggttaaaanattggcaggtagaaggaagcccagcacccaacaatgactaaactcggctgtgtctgaatccctggtggaacttattaaaaatagtttcccaggcccaggagcnagttgtcgcgccctataatcccaacactttgggaggcctaagtaggtggatcacttgaggcccaggagtttgagaccagcctggccaacatggcgaaacgctgtctctactaaaaatacaaaaattagccaggcttgatgcgcacgcctgtaatcccagttactctggaggctgagggaggagaatcgctggaacctgggaggcggaagctgcagtgagccaagattgcaccattgcactccagcngggncgacagagcgagacanngtctccagaa

SEQ ID NO: 680863 - DNA, 359 bp, Homo sapiens
atggtgcatatttatacaccaacgacatccaagctgagagccaaatcacgaatgcaatcctatttacaattgccacaaaaagaataaaatacctaggaatacagctaaccagggagatgaaagatctctacaacaaaaattacaaaacactgctgaaagaaatcagagatgacacaaatggaaaaacattccatacttatggataggaataatcaatattgttaaaatggccatactacccaaagcaatttatagattcaatgctattcctatcaaactaccaataacattcttcacagaatcagaaaaaaaaaagcattaaaatttatttgaaaccaaaaaagttccgttgaagccgt

SEQ ID NO: 680864 - DNA, 1014 bp, Homo sapiens
ctgagcattctgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgtgcctgtagtcccagctacttgtgaggctgaggtgggaggatggtttgggccccggaggtagaggtgggaggatggtttgggccccggaggtagaggttgcagtgagctgagattgtgccactgtattccatcctgggccaacagagccagaccctgctcaaacaaaaacaaacaacacaacagaggctgggcacaacagggggacctacacgccgggtatactcccaacgaacacctaggggaaaggctgaggcgggcaaacaacaaatggaaggtcacacgttggagaaccagccggagccacacctggtgaacccccgcgtcctattcaccacaaataaaaactaacacaactcaccacgcgacgtgcacgggcatgtgcccatatgaccccacagacaactcagagcaggcaaacgcacgacgcactactggggccaccacgggcggcgacaggaagcagatgagcaagatacaacacatccgccacgccgcgccaacagagtgacacacccggtgtcccccaacacacacaacgccacagaagaaacaaacgaaaaagaccagcacacacacgccgactagcaaaccggcgacccaacaccaaccacaacgagcgcgcgcccacccacacacacacgcagcaccagacgctcacgtcgccacacacaccacacaagacagcaacgccaacacacggaagatgccagccacgcacctccgcccagcacaccgatgacagcacaccaaccacgcgccggaacatggaccagaggacaaagcaacgacaccagcaaaccagactacgacacgag

SEQ ID NO: 680865 - DNA, 209 bp, Homo sapiens
atcccacccgatgcagagcgtttagtatctaaaccctagtaacctcgtgatctgcatctgtcctcatcaacacgtcaccacccttagctctgctgccaattagtacacatgtaggctgaattgtatttcactccagctactttagcgacctgggacagcacagaatcgacttacaagggtcaacttcccagcgagtttccttcagcggc

SEQ ID NO: 680866 - DNA, 942 bp, Homo sapiens
ccgttgtggtgtaccataaagtcacctcgcccccaactgccgaatgccccagcagggctgatttgccccatccctgtggggccctccacacctttgtgggagagaccccccaaatttatgagaaacttctgctgcttcgcccagaacgattgtgcgccccccctgaatcttttgtttcaaagacaggacaagcgtggtaattcgccttcacttaaatcgttgtgtgaaagatctctggccgtcctgttgctcccacacagaacggatgcacattctttccgttttaaaccaggcgcacacacaaagagagtggccccaaacaatactaaggatgcctagaagccaatggggtgctcgccaccaaccacttcgggggggatatacttcgttgggacatttttttgccacccgctgaatccccccacccacacagacgttcatgttctcccccccttgatatgcaaacttatgggtgaacacctgggcgaaatcttctctttctttttataaaaacaaatttctgtctgtacaatatacagtggtcaaccacaagagccgaaacctcctttactattatcaaaacatatgtctagaacagtttctcacctcccttgttagaataactcacaacagagacccatcctgtgagtaatacactcagagccacaatcatcttctccttgacccacgacaggagcctctgtgaaaatgctccccaaaagatatctcccccttctcaccctcccctccccctacaatgctgcatattccacacattccttttatccacatcgtttgaccacacagaaagttgtaaatagttccaactcctgtccccccagataaataattatgacatgatgtatttattaggcagtccagataaaccacacatcaacaccacgcagcggtaactaccttaaaaaaaaaatccacaaaaca

SEQ ID NO: 680867 - DNA, 134 bp, Homo sapiens
tcgcctgttatgtaaaggatgcgtagggactgggacgggcgactgacggacctacggactgactggcgggcaggactagttcagacggtttccatttcctgagcgtctgagatgttagtattagttagttttgt

SEQ ID NO: 680868 - DNA, 138 bp, Homo sapiens
taccgtgggaggacaccacgagaaggctccgtctgtgaaccagaaagcagaccctcaccagacaccaaatttgttggtaccttggtcatagacttcccagcctccagaactgttaaaaataaatttatactgttttta

SEQ ID NO: 680869 - DNA, 398 bp, Homo sapiens
  misc_feature (108)..(108): n is a, c, g, or t
gagcagaggcggaggttgctcctgtacgcgtacgggccgctcggccggagccgcagcccgtatgcgccgggcggagcgcagaaagccgtaaataatgctgttgctgcngctgcccacccttcgccgcccgggcccccgctgccgcccgggccccggctgccgcctgcgcccccgtcgaccccgcccgcgagtgcgccccagccaggacgccgcccccggccgggtctccacttcttggccgcaccttccatgacagcgcccgcgagaagatggctgcgaagggcgcgcacggctcctacctgaaggtggagagcgagctggagcgctgccgcgccgagggccactgggaccgcttgccggagctggtccggcagctgcagacgcttgacatgcccggg

SEQ ID NO: 680870 - DNA, 171 bp, Homo sapiens
atcgacctacacttcaggaaaggcatcaagcctgaaacaataaattcctgctagagaaaactgtcttcagatgtgcatgacttcatgggatttataacatgagtccatgaaggaaatcgtgaaagagattgtagagacagcaaaaacgggtagaggagaggggctctcaaa

SEQ ID NO: 680871 - DNA, 202 bp, Homo sapiens
gctcgtttcagtttttgtctttttggccggcagagacttaattgtcatgagagactgagttcagttggatttaaggagcagtgaggagagttgctagaagtcatcatttctggccaggcacggttggctcatgcctgtaatcccagcactttggaggccaagcaatgtggatcacttaaggccagaggtttagaccagcctg

SEQ ID NO: 680872 - DNA, 759 bp, Homo sapiens
agattccagtcctgcaatatgctacctactaactgtccgcatgccacctgaagcagcgctttcccgttctacaggctgttcaatgacattcgacaaatttagggactaaatagctacctgggtttccagggcacacctagacaaatcaagggagaagagtgtcagaatgcagaatcatggagataatgggcgaagggtgtgcgtctgggtgatgggactcattgtagaaaggaagccttgctcattcttgaggagcacttaaggtacttgtcgaacactagccaacgggctgctgcgtgcggactggacatctaattgcagccacgacttgggagaatactttgctctcatagtattggagcacatgttacgtgtcttcattgtctggagcattgtcggagtctgcatgactttcgtgttttctgtttgtaaattatccttgctaagcatatattctctaggcttttttcctgtttggggttctacagtcgtaaaagagataataagaatagttggacagtttaagagcttttagtcgtcctttgacaaaagtataatgggagggcattcctatcccttcctgagagggggacactccatgagtgtctgtgagaggcagctatctgcactctatactgcaaacagaaatcacggtgattttaagacgtgaatgttttatttatcaaaatgtagcttttggggagggaggggaaatgtaatactggaataatttgtaaatgattgtaactggcatattca

SEQ ID NO: 680873 - DNA, 160 bp, Homo sapiens
  misc_feature (4)..(4): n is a, c, g, or t
tttntctgtagtagcacattgcggagacacagttggtggccctatagaagtggtccggctgtatgatgggacagtgggtacagtgcctcatccccttggttggccttgcaaagtcccagatggacaacctcggcagacggtgccattctcaacggcctcg

SEQ ID NO: 680874 - DNA, 452 bp, Homo sapiens
  misc_feature (48)..(48): n is a, c, g, or t
  misc_feature (115)..(115): n is a, c, g, or t
ttttgccaggagcaggttaactgtccccacgtaaggtgggacacccgnttttgttttccagaaaaaaagggagggggagagggctgcctttggacttgttccgggacacctaggnatagggtggggaaaaacgggccctggtggtggcttggaaggcaaagcgttgtcctcaaccccgcgtggaatttgtttttggcacaacctggttgtggcctaacctgccgaaagtccatcagcctccatcctaccccctgtgcctttttacgccaaactttccacggctccttgagattccaacactgccagcattttccttcctttttttcctgtttccctcctttgcccgggagctcaggaaccaaggcagggaaggtttcctttagctccttaaggtttttttttaaggtttttttagtttttttttttccccctgaataaaaaattaatgggca

SEQ ID NO: 680875 - DNA, 1449 bp, Homo sapiens
  misc_feature (690)..(690): n is a, c, g, or t
  misc_feature (815)..(815): n is a, c, g, or t
tggtggagtgaaaaatagtgttttcgactccaagctagctcaagggcttacacgtccatttcaacttggggaccaattcacctttagaaagtggtgaagggaaaaggtgacagaccaattattccaaattttgtgggtaggaacgtcaatttggcattattattaccaccaagaactcatttactcacattatttacacaaacctaacattacccgcgtggttgtggtgaggattaatctcgtgacaagtggcgtcattctcatatttgtgggaagtatatccagagatataaaataagccccgtggagaacgagaaagacaccacctggtggccctctcaacacgagcgagcctgtgccccatgtgacactcgtggtcccctcagttgtggcgggtgctttataatatatagaaaccaacagaggataataacagacaaaggcgtgtatggggagacacaatctcgcgggtaatattctcgccgagcgtgagcactcgtgcacatagaatgtggagagagaaacaagagtttgtgtgctgagcggcccaaaatatcttctctctttagcgagaaagagtctccataaaggcgtgggtctcacgagtgtttctatatataccccctctctataacccaacacgaggtgtggtgagaagacgaggaaaaggtccctcccccgagagggggnccccgttatgacagtggagagtacacaaagaagggtgggaacactggagccccaaaagcagacgtggacagtatcttccgaggagcccccacaaccagcggtgagaagtgacagcagggggccgncccaacgggggcccccccaaaataggtggggtgtacgagacaaaaagtggagcaactaactccccgtagggacagcgaggggggccccccccgcagcagatgataaacaacgcccggtgggaaggagcaataacctgctaggcatggctaatacagacagacaacaccgagggggggaacacaaaaacagcgcccccgtggtgtacaaccaccgaaacaaacagaaggacaacgcaccctcaggtggttgtatcctcccggcgaggaaacaaccgcacgacgatcaaccatctttccggtagacagagacaggtgggcgcccaacatgatgtgagcacaaactcatacacaaggggggtctcatgaaggaggggccccaactgatgttacagccagagcaaaacggcatgaaaattcacgcacacgacgcgcggggctccgccacgcaacagagcggggcggctgggaacagctggtggaccgagacaacaacggggggcccatcggccgccacaaacatcaaccgagggcacccacaaaagaggcggcgcatctcggcgcatataagaaacaacgcataacaccacaaagaaagcaccgacgaagcgtcgacacagtgggggtagtacccccc

SEQ ID NO: 680876 - DNA, 125 bp, Homo sapiens
gaactggaactacctgtttaccacacatgacacgactactacactactgggtcaactacacgcactactgacaacacgactgcgccactaccgcacttggtcacttacgggacacgtgccaatct

SEQ ID NO: 680877 - DNA, 426 bp, Homo sapiens
tagataaggtgacagataaaccagcttggaaacacggagttttctgcaacagattgcatccaagatctcctgaaatatctccctgcttggtataagggtactctcctctcatttggtgtcacaggacctatgaattttttttttttttgagatggagtttcactcatgttgcccaggctggagtgcaatggaacgatcgatctcggctcactgcaacatccgcctcccagcttcaagcgattctcctgcctcagcctccagagtagttgggattacaggcatgcaccaccacgcccggctaattttgtatttttagtagagaccgagtttctccatgttggtcaggctggtctcgctcccgacctcaggtgatccgcccacctcagccttgcctgctgggattacaggcatgagccccgtgcctgc

SEQ ID NO: 680878 - DNA, 154 bp, Homo sapiens
atcacaaaagcagtgtgtgtgtgtgtggaataaccaccatgctgcttgtcaactgccccataatctagaatggactttaaacagcaacaaaagctgaaatggtggaccagaggctgctcctttgttcatccatgctttctcacttccagtcgca

SEQ ID NO: 680879 - DNA, 1397 bp, Homo sapiens
  misc_feature (459)..(459): n is a, c, g, or t
agcggggcgggcaagcccaggcggcagcggcaagcggcaagccacagcgaggaagcccaggtcagcggcacgtgccacgcgaaacctgcaaacttgtgccatcggctctgcccgtccccgtgggagcccgagcagcccctgaacgtcctcaccccttcccgacacgtctctatgctatgggtgtgcctttgcttgctgtatctatagtgtctgcggagcgagttcctcttactgtcctctccttgtgttggtcatccactactctgcattctcctggtgagttggccctctaagttacttagctgtgctatgtgggcgcgatagtagtgcttctactgctatgggcaaccagattgtgtcgattctacatttgaatgcaaaacagcgtgtgcttcctatacaaaggaggcgatggtcgaccaagtttgcctttttgcatttgaggactgagagtgagtnatcggaatcttgatttgcaaggattatgggttcctattacatgagttgcgcatactaggacagtacacttttttcctcctttgcggttgataatttgggggattccacttttgttgatctttgtgcgcatgtaaaggggcgttttataaggcaaaccaactatattgcttggcaaagttggttagatatggagagcttttgccaccggtggtgaacgcttattaattagattcgacaactcggccattatggttcgttgtcgccggcaagttagtcaagtttctacgttccggcaactcgttttccgttgtctccccccgttgctatctccttaagttgttggccctttgggtgggaagggttggcgcttcggtgggggcctcgggtgctctgctcgattttttggcgaacgttgttccattccaagttctggagcttgccccctcgcggggggctccttaatttggcttttccatttagcaaagaccctagtatagtttggggttccacgatcgtctgtggtgtggtaacaccgtttccgacttccaagagggattttcacccccggacaaagggaacaccccaacacccaggtggtgcgaaccccaccaggaggggtatagcttgccggcagggcaatacactccataggcttggtttgcgaacataatatgcgggtacccacactttccccgagtgctcacttccaatttctcccgtgtctggggaacattctgcacgtggtgttcccccccgtgggagacatacccattaatttgcgtgtgcccatacttgggccccactaggggaataaaatcctcgcttcagctggctaaaacgaccaacatagcggggaaggtgtttggcataacgccagttgtttcccctggattaacacctcgcggtcaccaattggtctggggcggcctcggttgtca

SEQ ID NO: 680880 - DNA, 127 bp, Homo sapiens
gctttttttgttgtgggacaaaccacaacaaggcgaggaatccccgcctgcgggcgttatacaacaaacaggggagacaacaattctttctgtctactctctctttctcatcaatagaacaagaaat

SEQ ID NO: 680881 - DNA, 138 bp, Homo sapiens
attttttaataccatggatgttggacctcaccctctggaaatggtgggattgggaatcttattaatttttttgagatgagtctagctctgtccccaggcggaggttgcagtgagccaagtccagccttggagacagag

SEQ ID NO: 680882 - DNA, 139 bp, Homo sapiens
ctcaacgctttatacttcgagaaggagaggaagaataagaaggaacagaagaaagaaaaaagtacaagaagaagaaagaaggaagaaggcacagacagaggaagaactaagaagcagcacgcggcggaacgacgacaga

SEQ ID NO: 680883 - DNA, 163 bp, Homo sapiens
atgtactaatacaggaggcaccactatgtaccctggtatagctgatcgtatgacagaaggaaatcactgctactaggactcctaagcaccatgaaagatataaaattatatgctcacccctgaagcgataaatactactgtctaggataagggggactaccat

SEQ ID NO: 680884 - DNA, 442 bp, Homo sapiens
  misc_feature (22)..(22): n is a, c, g, or t
  misc_feature (90)..(90): n is a, c, g, or t
  misc_feature (128)..(128): n is a, c, g, or t
  misc_feature (180)..(180): n is a, c, g, or t
  misc_feature (208)..(208): n is a, c, g, or t
  misc_feature (265)..(265): n is a, c, g, or t
  misc_feature (304)..(304): n is a, c, g, or t
  misc_feature (354)..(354): n is a, c, g, or t
  misc_feature (365)..(365): n is a, c, g, or t
agccccaaggatgaaacccccnctgaaacattatgggatccagaacggggcccccccagaatgtttccccagaattcatattggtttccncaaacatgtaagattgaaaggcttgtatccaaagttantttgtcagccttgaagattgaaaaaagcacgtctaaagagccagttgatttnaacaatggattgaaaaagatttggtacncccagagggcagcttcaaaatgaagaaattgggcacatgatggctccgctacttacntgagattcattattggatcagcctttgatcagcatctgngcatagcgtttttgcagaaggaacagtagtctcaaatctttcctcataangataacaaaangctcttgcatgattttttaacaatatatttaaacaggaagttgtcactgatatactttataaaaggatttttatcgg

SEQ ID NO: 680885 - DNA, 569 bp, Homo sapiens
gaggatcccgatttgcgcgtctcttcttgagcttagcagtggtgaactgtgcggcactgtgtcccagtgacaccacgctcagatcaggagaagatgaacaggtcgatcactctacgatgcgatcagctttcagagggtatttcttgaggccctctctaggcagaaatggcttgaagaagcagtccagcagcttgaggaggctcatggtcaggttgcagttggttgaggcgatcacctccttcactgaggaccgaacgaaggagatggattcctccaggaagctgacaaagagggccttgaaatgctcctcatagggcttcagcaagggaggcagcttcctcagccagcactcgatgaagggcatgagccccaggatgctgggctccaggtacaccatgccacagcgggagactgtagctggtgaagccaccgccaggtcttgcacctcgaacatcatggtcattgcctctgtgagcttgatgatctccccagagctgaggcacagcttcttgttgtcatccagcaccgtgttcatgttctcaatccagatggcatccacctggccatcg

SEQ ID NO: 680886 - DNA, 236 bp, Homo sapiens
gacagacaaagaaagagatgcccatgaacacacaaaatgcctacagaactccaaatagactagaccagaaaagaaattcctcctgacacaataatcagaacaacaagtgcactaaataaagatagaatattaaaagcactaaggggaaaaggtcaagtaacaaggcaggcctattagaattacaccagacttctcaccagggactatgaaagccagaagatcctggacgtcgacgc

SEQ ID NO: 680887 - DNA, 923 bp, Homo sapiens
ggacaactggagtcggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgca

SEQ ID NO: 680888 - DNA, 249 bp, Homo sapiens
  misc_feature (197)..(198): n is a, c, g, or t
  misc_feature (226)..(227): n is a, c, g, or t
ttagggccgaggggtttaatgtggttggttggagaacggagggcctaaaggtttgggaccttcaaaaggggggttttagggggaaaaggggcccccccccttggggaacccccgggggggaaatggggggcccccttttttcccgggaagggaaaaaacttttttaaccgcgaagattttgggggggggcccccccnnggccccccccccccaacaaccccccaanngggtgccggcgccccccggggg

SEQ ID NO: 680889 - DNA, 865 bp, Homo sapiens
ggacaactggagtcggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagcgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgca

SEQ ID NO: 680890 - DNA, 160 bp, Homo sapiens
agtggggtagcgactggacggaggactggtgctgtgggtgacaacgagtatgatggaatgatggttgtcttggggtatactacagcataaactattgaggagtatcctgaggcatgggggtcaggatactcctcaatagtttatgctgtaatagtttatg

SEQ ID NO: 680891 - DNA, 1142 bp, Homo sapiens
ggacaactggagtcggctttaactatttctaaagttctcctctccatctgctcacttcttacagattgcaaccctgctgaccctctggtgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccattttgtgatggtatgttgtccatcttcccatcccagttcttcctgccccccttcctctctcccacgctctcttttatctctcattttattcccttgttgatttctgttaacttgaaagatttgggattttttcccacctcatcatagatgggaacttttgttttcagtgcaaacaatgttggagctgtaatagtaagagctttcttacaaagctttgtattactgtgtggttttgttttttttgttgttgtttatttgattttgatttttttttcttttatgtgatctttgggaaaacacattcagaattatatctcgtttctacttaaatgtagtgcttagggttaattttttgtactgaagtctttattggtgggtgcatgctactgggaacaagtttttgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgcacttctggtaacccgacatttgctttgtgtcctggtgaccgctgtagccctacgtgcagtgaggcttgtctaattcaattacaggttcaagtgtatttttcatctcaaacctctaatatttctttggagttgagttgcttagcatgtggaatttctccagctgtcagtagcctgatgattttatggttgttatagtaaattgctatcattttaaaaaaaa

SEQ ID NO: 680892 - DNA, 1001 bp, Homo sapiens
aaaatgctaaaaattatgactcactaaagactcagatgattttcacgtgagtcactaattctttttatttttaagacagggtctggccttagtctgcccacgcgcctgctaggtgcaggtggcgccactcagtggcctcacgtgccacacttgaactcgcggggcctcaagggcactccctccgtactcggcagaccttccccaaagtgtggcctgtgggcaacgtgccaccgcgtgccttgtgccatacacagtggccgtgggcctacttcttatactagactctctgttctcgtgctacgcgtgaagtggagaatcttcgagccattcttatgcataaagcgcgtggtctccctcgagccagacataccgtgggagaccactcgagagggcgagcatcacatacgcgccatcccctctaggccactctcccgagagggtgtgcccgtgcagacactgtggccacgagccccagtggacgagcccacacagtgggcgacaccgcggggccccaacagacctcttttctccgacgctccgttcatactaagaacaagttccccgctactacgaaatccgttgggtacagtgtgctatataaaagggggtaagtaaccgcacggcgatcctcagccacgcttgatatcttagccgcggatgtcatatagcaaaggttgcgataacatccgctctactcataaaagccgcaccttaagacggcgggaaccacacttcgtgctaggtgcccgattaaaccatgattagaagacgccgacgatagtgaacattatcctttccacgttggtgaacgctgttatgcaacaagcaccttaagacggagaaaaaacaattcttgagcaccacgtagataacccacttcaagcaataagaggttcgattgtcacaacataaacatggtgagtccgagcttcctttataaggtgggataaacgcctccaccgaggcggggagcccctatcctcttagtgaaagacgggtgt

SEQ ID NO: 680893 - DNA, 353 bp, Homo sapiens
tgtgaacttgatgtgaaaacatcttacaaacatatatatcggggatgagcagatgtggaggttaaggctaaatgaaactaatgaacaaacttaaggtgggatgatgctactcgtgaaacgaggggctgtacaaaagcttcaatcagaatcactgtgcattactgagactctgtttatcactagccttctgtccctcccgcagaagactgttggattgaacaaaataatatgtattttgatttacttaaagtgcttgtaaatttcttagggacctgccacttttgactgtggatcagttgatgtacacttgtattattaaagcactcaataaatcactgtggctgataactgca

SEQ ID NO: 680894 - DNA, 1217 bp, Homo sapiens
  misc_feature (680)..(680): n is a, c, g, or t
tccctccgggaattttttcctttttatattattttggggtttttaaaagggtggttgtattatttcagggatatatagggcatataaagaacatttattaaaaagaataagggggtatcaggggaggggagggaaattccggaaaattccaaaaaattcttctcacatataagaaatttaaaaaatctcacaaacctgtgggggcgcaagggtgagcgagaggcgcgaacacccattctctttctctataacagagaggtgcggtgtgagcaccatatatcgccacacagtgtgtcgcgctctcaaagagaggcgagagagaatatatacacaaagactctatacacaacaaacacacacacacaacaaaagaacacacagagacacactctcagaaggtgtgcgctatatgagtgaagacgagctgtgaggggtctctgtgggggggcccgtgagaaagagactttatagagagtgtgctcccttataaagaggcgggggggcggggcgcgcatatatagagaacatatcttaattcgcggcgagagacatatagcgcgccagagggagagagaaacaaatgtgttcacgagtgttggggggtttttaagagaggggcctataagagtgagagactctgctgtgggggggccacacaagaaagcctcctctatgtgggnggggggggacacaagcgcgcgcgtgcgcgcggtgggggaagtataaacacccgacgagagtttttttctcgcacaagtgtcaacacggttctatataaggcgcgcttagagggggctcacacgtgtggtgcattgtcggggagcagcacacagaatttatgcacacaaatatgtcggggggatgtgaatacgggcgggagcactatgtggcgtgtggtgttgggatcactacacccattagtgggggtccaccaaaaaaaatttcctcacacccacaaaggttttgtgacacacgttttataaaaaacaacacaaattccccccaaaaaggtgggagaaacatcttcaaataagtctctctaaaaaccggcgtttgtatagtgggactagtggtcactgacgcaacggggagtttctccaaaaaaaacattccttgcgtaaaaagaaggctcacccgcggcgtctcccccttgtgtgaaaagccatttacaaaacaggggagggggcacccacacataagaaaacggcgtggtcttg

SEQ ID NO: 680895 - DNA, 257 bp, Homo sapiens
cccaggcaaccttagcccctcagaacagggagtcccaggacccagggagagtgtggggacaggacagcctgtctcttgtagcttcctggggtgggaggcacaggggcaaagcaattacccagggaaaattggaagttgttcttgttcttttttcaaggccaacattcttggaaaagccgccaaaaccttgggcctccagcctgggactgctgtgatggggtatcacggtgatggtcccattaaacttccactctgca

SEQ ID NO: 680896 - DNA, 899 bp, Homo sapiens
aaaactcaagctacgataaggctgcgtgatgaaaacggacggaggcaggaagaagcatcagctgcctcactgaaacatggatgtgtttgcatgcctgctctagtgggacagcccagagcctggctgcccatcatgtggccccagccaatacacggtgacgaaggaggactgctggactggaggcccctggagccagatggcaagagggtgacagccttccatttcactgtgtgtactctgtccagtaacctttagacaaaaatggatgcccagaggactcccaaccctggcttggaggtcaatgaatacagacagcaatgagttagagggacccttaggtgcacttgaggcatgtagatccattgaaagcctgactctggccctggcccttacttgctatcgtctagactactctaggagctcgtccagatatagcacactgttccccagccctccactcagcctgtcctgcagacaaacactccacccatccaccttccattttcccccagcgtactgcagaacctccaggcctgcttgctatagagcctacctgtatgtcaatacagacccagcagctgcacgccccccacacaaccacgaacaacaaccaaaccaccagccagcagacaacacaccacacacgcaggaccccccacccaacaaacgaaaaggacggcgagcaaaccaccacaaaccacctaagtacgctaagccaacacgaaacacacaaacgacgaagacacccccccagacaagcacagctgccagaggcgcaacaggcgaacccccaccgcacagaagaacaaccgcaagaacagccacaaaacaggccacgaacgaccacaacgacaccccaacacgccaccatgcagtaccggaccaaaagggaccggacg

SEQ ID NO: 680897 - DNA, 323 bp, Homo sapiens
cagttatgggctaccgagtggacggtcagagatggggtgaagggtgttcccggttcttcaagttctcagcttctggccgggaagttaagcaacaagatggggctaagaacggaagccggaaggggggcgcgcaggaagcagggcgccgcagcctgtcgtacggtccttctgtgggtctgtcggtgccgagggcaggatggagaagctgcggctcctgggcctccgttaccaggagtacgtgactcgtcacccggccgccacggcccagcttgagacagcagtgcggggcttcagttacctgctggcaggtcgattcggcgatt

SEQ ID NO: 680898 - DNA, 315 bp, Homo sapiens
gaaggttctttatcatctcccccacccttaagaagtttctttgtaattctcctcacctttgacaatgtactttatgagatccacctcctgcccccaaaacactgttcttaactccaccgcctatccccaaatctataagaaccagtgataatcacaccaccctttgttgactcctttttcggactcagcccgcctgcacccaggtgaaataaacagccatgttgctcacacaaagcatgtttggtggtctcttcacacagacacgtgagacaggagttcggcactgtttggactctgggcactgtttggactctg

SEQ ID NO: 680899 - DNA, 322 bp, Homo sapiens
atgctgaggtggagaaaccctattttaaactgaagtgcacaatctagttgaaataaggtgcttttggccaggcgtggtggctcatgcctgtaatcccagcactttggggggccgaggcaaggtgagcggatcacttgagcccaggaattgagaccagcccggccaacatggcgaaaccctgtctctactaaaaatacaaaaattagctgggtgtggtggcgcgcacatgtaatcgcagctacttgggaggctgaggacggagattcacttgaacctgagaggcagagattgcagtgagccgagatcacatcactgacaacgg

SEQ ID NO: 680900 - DNA, 675 bp, Homo sapiens
  misc_feature (165)..(165): n is a, c, g, or t
  misc_feature (167)..(167): n is a, c, g, or t
  misc_feature (223)..(223): n is a, c, g, or t
  misc_feature (248)..(248): n is a, c, g, or t
  misc_feature (255)..(255): n is a, c, g, or t
  misc_feature (266)..(266): n is a, c, g, or t
  misc_feature (273)..(274): n is a, c, g, or t
  misc_feature (320)..(320): n is a, c, g, or t
  misc_feature (359)..(359): n is a, c, g, or t
  misc_feature (365)..(366): n is a, c, g, or t
  misc_feature (393)..(394): n is a, c, g, or t
  misc_feature (414)..(415): n is a, c, g, or t
  misc_feature (421)..(422): n is a, c, g, or t
  misc_feature (437)..(438): n is a, c, g, or t
  misc_feature (446)..(446): n is a, c, g, or t
  misc_feature (448)..(448): n is a, c, g, or t
  misc_feature (498)..(499): n is a, c, g, or t
  misc_feature (514)..(514): n is a, c, g, or t
  misc_feature (523)..(525): n is a, c, g, or t
  misc_feature (531)..(531): n is a, c, g, or t
  misc_feature (537)..(538): n is a, c, g, or t
  misc_feature (557)..(558): n is a, c, g, or t
  misc_feature (563)..(563): n is a, c, g, or t
  misc_feature (566)..(566): n is a, c, g, or t
tcgctccagctctctgctctcccagcgcagcgccgccgccggccctccagcttcccggacatggccaacctggagcgcacttcatcgccatcaagccggacgggtgcagcgcggctgtgggcgagatcatcaagcgcttcgagcagaagggattccgcctcgtgncnatgaagttcctccgggctctgaagaacacctgaagcagcactacattgacctgaangaccgaccattcttccctgggctgntgaagtnacatgaactcngggccgnnttgtggccatggtctgggaggggctgaacgtggtgaagacaggccngagtgatgcttggggagaccaatccagcagattcaaagncaggcnnccattcgtggggacttctgcattcagnnttggcaggaacaatcattcnntggcanntgattcagtaaaagnntgctgaananagaaatcagcctatggttaacgcctgaagaactggttgactacaagtctnngtgctcatgacgtgnggtctatgnnntaaganggtggnncacaacagcagtctccttnnagcanggngtggtgtgtcccgtggacacgagctcttcaattccatttgacttaagaggcaacaggattgatcattcgttttatagagcatatttgcaaataaagctttgggaagccg

SEQ ID NO: 680901 - DNA, 662 bp, Homo sapiens
agcggagagggagtgagtggcagagtgagttatacccctatgagactgtagagaggcccggggtcctacgctcaagaggagcggggtcagcgaagctagactagcagcggctcccccatccaggtccccgggcccggcggcgcggaggcggcattggtggtgaagaggcggaggaagcgggggtccaggtccccgtcatggaagggcgtggacgtagaccgtggactccggaggctgatgcgagaagtccgagctgcgcatgggcctagcacctgacagagggacgtgttcgtctccgatgttgccagcaggactgctgcggtcttcacagactcaaatcactgtcgcgagtaggcggccctatctgtccttggagcatttgacctaactggaaaccgtactaagcggggctagatgatgaggtgccactaatgagtcgaccttatgaagatggctcgaaatcgatcgaggtgtggcccgtcctagtgttcctcttgctagagagagatgtcatgcataaggagaatggggaggtcgattatgcatccgtgcatggctcgagttatgataaaatacattggcagggattcctagatagttcgtgggtggagaggacgtgtgacttccagggggtatgtacttaggatatgttcggggggata

SEQ ID NO: 680902 - DNA, 954 bp, Homo sapiens
  misc_feature (248)..(248): n is a, c, g, or t
  misc_feature (316)..(316): n is a, c, g, or t
  misc_feature (519)..(519): n is a, c, g, or t
  misc_feature (706)..(706): n is a, c, g, or t
  misc_feature (730)..(730): n is a, c, g, or t
  misc_feature (859)..(859): n is a, c, g, or t
  misc_feature (940)..(940): n is a, c, g, or t
ctagtgatactatggtgccctgttgtgcccctgggcccctgagcacatcgattaagccctcccgataacctcggctaaaatttctttcatatttttagaatttgtcctcggaaacctttttcgcttggggtggtctctctcactctgccccctcctcacgcagctcttggcagtcaacagacgctggcggatggggctgcccatgccatcccagctccaagcttcccactccgggacttgtgtttggntggggagacctgacctgggcatgttcctgtttcttcatcgttgagcttttctggcccggtctgaagcncaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctcctgggaccctgccccncatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgntgggggtccaggacttccagccanaagcctttgcccttgcactaccttgtttgtcaccccatcccgtgtccccttgtcccccagcctgactcctgcctgatagctcctgtgtccccatgctggtcctcctggcccaggctgcaggagccaggntggggggcctccgcacccccttgctgggtgtgggtaattgtgttttgggggaaagtggggaatttaataaatttttggtgntttggaaaaaaaaa

SEQ ID NO: 680903 - DNA, 81 bp, Homo sapiens
ctagaagattcagcaaagtacttttgtgctcttgaggaaactctaggggatcggcttccccggggtatggttaaactcact

SEQ ID NO: 680904 - DNA, 166 bp, Homo sapiens
ctatgttcatcgttagctggacaaattgttacttttcttccctgaaaacaacagagagctgtaaatggaagaatcaaaaagaaaatgaaaatagttaagacccacagaactctctaccttgagccacagatgcatcacccccacccactaggagtgaacttgtgga

SEQ ID NO: 680905 - DNA, 383 bp, Homo sapiens
gagacaaggggagccttggggtttatttactcaaaaccatttacacacagagtgtgggtgtgtgttagatacatctggagaacacgaagtggtagcagacaggcgttcctggctttacagaacttacatggttgtagaagaagacatttagttacccccaacaaaacgctggtttgacgaaaacctttttctttttccatgccccaatatacatacccccctttaggttttaccggacttttaggggccttattggtggctttcgctttgggggctggctggggccagggctggaaggcataaaaatggtctggaaagggttaaaaaggggggaaggctttggggggggcaggccaatggcccaaaaccccacaatttttgaa

SEQ ID NO: 680906 - DNA, 281 bp, Homo sapiens
gtcgacgtttgccaaacccatgaggctctgcttatgagggaaaatattctccaactatggccactgtacagcatatttgtttttttcacgataaccagaactgtgacttctgtaggcctacttgtaagagttgcatagctttaagattatcttaagtcgactccctacttccatgtggcagatattttaaattgcagttgcagcctttcagcttagaactgcttgtcctgaagacccttaaattctaaaccagaggggctgttggggaggagaggttggca

SEQ ID NO: 680907 - DNA, 174 bp, Homo sapiens
ccatctcaaggcgatccatggaaagcttcctggggaacgtatgctagcagagcttctccccgtgaatcacatgccggagatcccactcttagctggcaaatgaatccgaattgacacagcagccccataagcatcagccctgtagagtgaggagccatctctagcgggcccttc

SEQ ID NO: 680908 - DNA, 289 bp, Homo sapiens
gaacagcttgcctgacctatcgagataggccgatcattcaaactacaggcaaagtaatgagaacaccccaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaaccc

SEQ ID NO: 680909 - DNA, 135 bp, Homo sapiens
gctatacaccaccttcagtataagaaaagcactactcatgagaattcacgtgttgtatagcgtggtatagagtggtatagggtggatggggtggatagggtggtataaggtggtatagggtggatggtggtataa

SEQ ID NO: 680910 - DNA, 283 bp, Homo sapiens
cacgaggttttagtccctataatggacccatgattaaataatcactttcacatgtaccgttcacctacattatctgtgctcacattttattgttccacttgtgactgtatagggctttgtgttattaatgtggttctttattaatggattttaatgacacttcataataatttttcttgattcacaactcctaggattaccatgagtgctaaatgtgttcagccttgctcattcatatgcaatgtggtctcttttgtcgtacgactttgatttaaccatcatt

SEQ ID NO: 680911 - DNA, 405 bp, Homo sapiens
  misc_feature (26)..(26): n is a, c, g, or t
ccttcccaatttcaaaacatatacanagctacagtaatcaaaacagtgtgacattggaatatggacagacatacagaccaacagaatagtgttaagaatacagaaacaaattcatacacccacagcctgttgatttcccacaagcacgccacacctgttcaatgagccccccctactctcttcacacaaccgccctccaatacctgcactccccccacgcaaaagaacccagttgcacccctatccaatacatatccaattaactcgaaattaaaagctaaatgtaagggctaaaaccgtaatactctcaggaaaaaaacaacaggaacataccttcacaaccttgaatttaaattcttatatacgacaacaaaagcaccagccaggtggggacctcgtgccgaa

SEQ ID NO: 680912 - DNA, 997 bp, Homo sapiens
  misc_feature (374)..(374): n is a, c, g, or t
tgtagttctgagggtcttgatcagtgttgtaccatgatactagccgtcgctgtcgaggagaatatgttgtgaggagaagatttgctagatcaaaaatcgcgggtgtgcgtctagtgcacaagagatgttgttctcgtatctacgcgggtgatccatttcctgttccgccgggattccagtgtccgtccccgctgcgggtatgtggagcgccgcaacaggaatccctgggtacctatgggaaaacaattcgggggttagccggtttcagagaaactatgcttgccttcgtaagagcgtcgccctgataagtcacataggggcatggtcaaaacgaggttgtgcccccaattgaaaaggggtacccttatttgcanagcatatgtcatactcgggagaaaaaaatgtgccttaccaataattttggatcaactcaactcccgctttaagggtgttttttgcttccacaaaagattttgggaagaaactttccggcgccacaaagggaattagttgtgagacagaaggcggggcagaaccaagattgggggaaaaataaaaagtgtcataccaccccgccgggggaacataacaagacggttctgtttgcaacaccacgagccccaattatacgagctcgcgcctagaagaagtgaccgaccccacccttctacgagccaatgttagccgttaagagcacctccacccagggcccagcttaattggctttcacaagtggggatacaaaaaagagcaggcgtccgcttcaccaataagcccgcattgtatatagtggaagacaaatgaagatctgtcaagtgggctcttccctcgcataatcggcgcgctattcaatgctaatcagttcaattatagtgttatgaagagcgcacaggctgagtaatctccccgccgcctctgggaacaatggccgccagatacatcgagtcctcctacggcgaacctccaataaaaaataaaaccctcgtccacatataca

SEQ ID NO: 680913 - DNA, 159 bp, Homo sapiens
catcaccaccatccaggtcttgccaacggtgcctggcagctccatttctgtgcccaccgcagccaggcccagctgcccctctgccgaggcttccaccgaccccttcctcacttccacgcctgtcacaagccagccgtcgcccccacagtcgcctccacc

SEQ ID NO: 680914 - DNA, 148 bp, Homo sapiens
  misc_feature (47)..(47): n is a, c, g, or t
  misc_feature (98)..(98): n is a, c, g, or t
ctggcacctgttttccaactacttgggagactcatgtgacaggaggntcacttgggcccaggagttggaagctgcagtgagccgtgatcttgccactncactccagtctgggcaacacagcaagatattgtgtcaaaaaaattttttt

SEQ ID NO: 680915 - DNA, 371 bp, Homo sapiens
  misc_feature (38)..(38): n is a, c, g, or t
  misc_feature (40)..(40): n is a, c, g, or t
  misc_feature (68)..(68): n is a, c, g, or t
  misc_feature (85)..(85): n is a, c, g, or t
  misc_feature (94)..(94): n is a, c, g, or t
  misc_feature (107)..(107): n is a, c, g, or t
  misc_feature (202)..(202): n is a, c, g, or t
  misc_feature (217)..(217): n is a, c, g, or t
  misc_feature (220)..(221): n is a, c, g, or t
accagagcaagattgacgtcccacttctgctacacggntngtgtgactctgaacaggtcatctgattnatctctaagcctccatngtcaggttntataaaacccttngggccaggtagcaatacaacccatgtcaaggggttgtataaagatcgagtcacacagacatagagaacagacttgtggttgccaagggggagggngtggatggactgggngtnnggggtcagtagacgcaaactattgcatatagaaggggatgaacaaggaaagtcctactgtacagcacaagggaactatatccagtctctttggatagaacatgaatggaagatcatattagaaaggggatgtgtggtatgtatgtgtgtg

SEQ ID NO: 680916 - DNA, 160 bp, Homo sapiens
atcgatgtgtgtctatactgagtatccgtttgctatgtactattttgtcatgtccctgtccttctaatcattccctatgtgtctatgtctctagtgtgtgtatatcctctctagtgggtatgtgtccctatatgggttcctttgtcgctttaggtgtatc

SEQ ID NO: 680917 - DNA, 928 bp, Homo sapiens
aacagtggtatcaacgcagagtgcccagttacggccaggcaagagcacttcatgatgaggcacgtcgaaaatcatttgttgccagtgaggatagaccgcaagtgggtggtgagaccattgaaggcgtttatcaactgaagagtcacatgtaacagcataatttgtgggaggactggaatagggctgaataaatgtgtgtgaatctctaattttatattttcttgtgcctgaggaactgtgatgttgttctgtctcctggatccggccttgtcgataatggggtctgttccttgttagtaccaatcttgtagtcgcatatatgaaatcattaacagttggatgatcagtttttgttatcataaacagtaatatattttggtccaaggatagaaaactataagaaggcttagatattcgtgatttttggggtaaatcaataggtactctgggaatgtatatactgtttgtagttgtcccggcaacacttgtatttatacaatgcaaattttcattggttagcgaaaagctctttaaaggcatattgggtgattggcatgggatttttcccaaatgtcttctgtgtaatgtatgctgtgcggaacctgggaaagaaagtgattcggggagagcactagtggttcctttgattagaataaaacttctggtgtgttaggagtcatattaaaaatgcggattacggggaggggttctttcgtggtatccctgtagcatcttttgttcggagcggcgaaaatagttgttggtgctgggggtgggaggggaagggaaacgtaggtattactgtgacacacgggggtgcagattacagacgggtggggggagacatagaacacaattggggagagatattttagaggagcgcgattttgacaaaaaatgttgctttcaacacacggagcggaaaaaa

SEQ ID NO: 680918 - DNA, 100 bp, Homo sapiens
attctgctctatcttggattactccggtcgggacaggagcggaaggggcagaagctccctgcggtgtggcccccaagcacgcatcacaggtggcagcagt

SEQ ID NO: 680919 - DNA, 140 bp, Homo sapiens
acccctcggtgttgcgctctgtctcacccacatcacctttctggggtctgctgacgcgtcggcatcgtggcgccaatccccctggcgttcgtgttcactccctgcatgctgccatgttctgcttacccacacacgtggcc

SEQ ID NO: 680920 - DNA, 225 bp, Homo sapiens
ctttgctgtagaataatgcactttaaaacaaggaaccgtatcaggccagcatggtggctcatgcctgtaatcccagcatttagggaggctcaggcagacaaatcgctctagctcagaagttgcagagcagcctgggcaacatggtgaaacccgtctctaccagacaaaaagcagccaggcgtggtggcacatctgtggtcccagctacttgagaggctgagccag

SEQ ID NO: 680921 - DNA, 361 bp, Homo sapiens
aaaaatcaaaagggcccgggtggttttttcccctgggggggaaaaaaacccaacccccccattcccgaaaacccccggaatttggggggggttttaactttttttaaaccaaaggtggcctttttccccctttttaaaggggaaatggggtggggccccccaaaaatggaaaacccccccccccgttaagggggcctttaaaaacttaattttgccttttgccaaaattttttggggggaattccaattaaggccttttccccccaaaggggttagttttgttgcccgggcgggtttttcccttttttaaaaatttccccggtcctttttggtctaattttaaaattggcccctttttcca

SEQ ID NO: 680922 - DNA, 449 bp, Homo sapiens
gaatgaaaataaacgataactgtcatcaatgtaaagacttacttgcacatttaactgacttcagtgtctgcctacacaggtattgccctcttggaaggtttatccccaactcatggcttctgtctctgcagcaataagaagccacttcccaatagtttcctgatacccagtcacctttgggaacttacgaggaaagtttttccagtctctccgcagacccttgcatctcttctctttttgtttagacccttgaccaccaccccctattctaatcttaactcctctgctactcagttccaatcctaacccaagccctagtccctaaatttataatcctttaatcctagacctggtctctagatcctgagcccttgatgcttatcttctaacctcctaatcccaacctcaaatccctaaacctcaacccatcggacccatcggacccatcg

SEQ ID NO: 680923 - DNA, 675 bp, Homo sapiens
cccctcagacactgtgccccctcttcacaccacactcgtatactgtgccccacccctctctcctgtgtggtgtgtgtgatacactcatcccacaaattattgttttcgccccacgggagccggagacaagaagaaatagtggggtgagacagaccacacactactgcgggggggtgttttctcccccacagcacaattacagtggtggtgcgttgtagagtacacaataacacgttgaaacccgccccctcttgtgaaaatatatatttctctcatctacaccccacacactgtttcggcccccttgataagctttctatctatcccatccccactactcttggcaagataatatctccctctccgactctcgctcctcagagatagtagagcgcgataaatattcacccccgctctatcacctctctgtggtaaagaacacctcctggtccactcacgactactgtaaataaaacgaagctaccacctaactatgtgtacgcttgactgtctccttctctacatttctctgtcttctgtccagacgcgctctctttccgaactcacaagtacactttcgctcgtgatcttcggtcccggcaaccaccacttacattattatgtcttacattaataacttattcttcaccccaatcaacataccggacatataac

SEQ ID NO: 680924 - DNA, 241 bp, Homo sapiens
gctagccacccagctgctgtctttggcctcgcaaatcgttcgtaccccactgtaggcctatgttattcacctacagacatcttgcaagagaaactagacaataatttccacttggcagcccgtgatggacctggaatgcatcacgttagggaaacacgcctagctcttgagataagcgtgttaggtttcctcacgaggccactcgtggaagaggtggctgagaggcccaggagacgaatgc

SEQ ID NO: 680925 - DNA, 270 bp, Homo sapiens
tgttataaacgctggctaggttaaacggaatacacaggcagacatggtggctcacacctgtaatcccagcactttggaaggggatgcgattgggactcaagacatccaaaaacaggccgggtgaagtagctcacgcctgtactcccagcactttcggaggctgaggcgggcagatcacttgaggtcaggagttcgagaccagtctggccaacatgacaaaaccccgtctctactaacactacaaaaattacctgggcacacattatggag

SEQ ID NO: 680926 - DNA, 521 bp, Homo sapiens
tgctggaactacaggcatgagcatcgtgcccaactaatcataccatttctgagtgcgacacggatagccgcaaggtggaaaattccattgccatgaccgtcgtgtgacaggttgctatctacagacacagtcaagaatgttctcaactagcacaagaatattaaaaatatgatgtaaaattaccttcagacaattaagaatattgtgtcataattaccttcatatataaggtatatatgaaacaagtgaattttgtgctgagagtcgagccccatccccaagatagctcatatgtatctgcaaatatactagacttagacaaaagtctgcagtccgaaacattgctggtcccaagcgatccagatacgggatactcaccctgtaaggtagtagtaacagtaatagcggtgatgagaagatgctagaggaaaaccatgggaagtgctgcctgctttctggagattctggtctgagggatagcagacagtttgcccatagtttgtctctgggaggctgagagg

SEQ ID NO: 680927 - DNA, 144 bp, Homo sapiens
caccactcagcatcgaggtgacttgatgctgcagattgcagcatgctgtacgctgctctgctgcatcatgctgcagctgctgcccatgcatgccatctgctgagagaccacacagctcctgtggtgaggactgctggaggacga

SEQ ID NO: 680928 - DNA, 204 bp, Homo sapiens
  misc_feature (3)..(3): n is a, c, g, or t
ggnggggccccttttggggcccccaaaaaggggggcccccccctttttcctggtgggggaaaaaaaaagggttttttttggggggggtttttcccctttccggggggttaaattccccggggggggggcttaaaattttggtttttttgggggtttccccccccccccccccccttttttttttttttgggggggggggcccca

SEQ ID NO: 680929 - DNA, 204 bp, Homo sapiens
tttttttttgcaagttgacttttttgacttttgaagccaaagggaggtcgaaactgcggtgattggacaacatagttaattaatgattgagtaatcatcttagctgccttcattctatttaggtttttcctgctctgtgctgacgataaagccctcctttacagatttgtactgtggattaaaatgtcatgccacgcggtttcg

SEQ ID NO: 680930 - DNA, 324 bp, Homo sapiens
ctcccaaagtgctggggttacaggtgtgagctactgcgtggcctggcctcaatttggtttttagcatatctcaaagtaaattacatctgtatacttcttgcagaaacttaaattgcggacatctataaatgtagacttctccccaaatactaaggtttgcatattaaccagaattcattgtttttgggatatatttttatatgacatactcaggttttaagtgctcattagctgagtttcaacatacacatatatctttgtaactaatggcataattatgaaatagaccattatgttggaatgtttcctcaggcttccataacc

SEQ ID NO: 680931 - DNA, 1374 bp, Homo sapiens
atgtctgctcgtgctgttagacagtgtgctctacttacttttttttcgtttgtcatagttcctctcatctaaaatatacaatgtgggcagcatgtcgctgccatcagttaatttttgtcctggtagtcctcatcgggttttttaagtacaccccacctatgggagaacgtgtggggcgattacattttataccaggcggggacacccactactatgggggtactaatcaacttctgttcagcacacaccctatttggtgttttgatttcccccacacaacttggtttgtgatcaactcggggtgtgtgacaacacctttgtaggaagtgtttggccgcacaccagctcctgttcgacagtgggtcgtcattaaaccatagtggccgttgtctcaatgaaacgcaagaaagccgaatgtggcgttcagcaaaaccaagtgggccaaaaagatgaaacccacaatggaccaaacttgtgtggtgacttctgggtgaagggaacctctatggcgcacccagaggccgaacgaccaattcgccgggccacgccaacgagagagcccttcttgggaatgggccccctctccccgagggatacttgttggccttgattgcccccccggggaggatcttcccagggaacagttctatccgcatggcgttgtacaatggctgcttgccaaaaggcctgtttggacaaagagtctatctccctggagtcttgtgacacgggaagcggtctacaatggcactggcacattctcagtgtctcccccacagcacaaacagggtcacaattggtggacacatgtacacatgcacagtttataggaaaacacttgcccaaaatttgagtgacaatcaaagaacggttggtgaacacatagcgttcgtgagggccacaccatcaagggcaatctctggggtatcaacatgaggccacacaaggtggtctctcacatttgacatttctcacgagctgactacacccactctcatgccacccatttgacagactggggcctggcaattgcccatctaacagacccacactttgtctaagactctcatttccctggtttgacacaacaggatttggctacacagcaaacaagaggtggtggacactcaaatggccccacaatggcctccaaggagtaagacccctgggccaccagcccccgcaagggcacacagaggaagagagagacaccatcactgctggggaatcccatgccacaactcagtccccccacacaaacgtgaatctcccctcctcacagattgcaaagtagaccccttgtaagaggggaggggcctagggaaccccaacattgtcaagtacccatcatattaagttcccctgtgctctaac

SEQ ID NO: 680932 - DNA, 775 bp, Homo sapiens
cgctgtaccggccggaattatgggatgggcgggacttctccgggtcaaagccgagccttttccaggcgtgtttacttaaaccgtgggcgcagccagagcttttctccttcctgtcccacggccgttcccgcgacacgccatcgccgccatcgtcttctctggcatcgcctgtgtggcttacgccaccgaagtaacctggacccgggcccggcccggcgagatcactgactacagtggccgtccgtagctggggctgctgaaggtgctggagaccgttcgtggcctgtctcactcttcgggttcatcaagtagcccctacgtgtaccacaatgcggtcggccctggagtggtgcgtggcggtgtacgccctctgcttcgtcctggctgagcctcagctgtcctgcgtgacgcctgggtgcactggcaccaggcatgctgcccatccgcgttccccagtttcctgttggggctggccttgcatgtcctgtcctcctctagtgccactgctcgcttgtcctctggcccctctacgcagttcaactgagaagtatggtgtccagccctggcagagcgagagatgtgagctgcagctgacagaaacccctaccttgtgtgtatctgggaccggcgactggctgtgaccgagagctgactggccgtcgaaacttgctgggctatgtgggcgagctggtgtactctgcccacctggtttttgtcaaggtctaggactcccaaagggtcccgttatgctctacaatctcttcatcctgcccgc

SEQ ID NO: 680933 - DNA, 883 bp, Homo sapiens
cgcgcgtcgctgcctcctcagctccaggatgatctggccagaagacgctctactcctttttctcccccagccccgccaggaagcgacacgcccccagccccgagccggcgtccaggggacctggctgtggctggtgtgtgcctgaggaaagcggagatgctggctggtgcatcccagccaaggaatggccccgtgctgggcaggagtgagcctgggactgcctgccctcctcgccgctgagtgcctgagcagttggaccggatccagatggaacaatggcctgcgtgcctgctcagactcgcggcccgcaacgtgcccgtgggctttggaagatgagcctggaaggaagcaacctcatgcgtgggagttcgggaaaccgtattttatcaagctaattgggatttgttgcaggaagaaaggaaatgcataacacttgtttataccacccccaaaaccaaggtcttcacctggtgagccagaatgttgtgacataatacagatgtgacaggttggcatcctgggacaagagatcccatattcattggacctaatccaagctcacgggctctgctttaagtgtcaaaaggcctgttccgccttccggccagttggcgagaaccttttcattacagaggtggtctacgggaccttgcaggctttggtacaatccttggacatggcacgattaaatctggggtggggcccagccaagttgttcgtcttttcctaaggctggtctcaacggtttgtgtcccatccacgcaactctataagggccaggctgggcacagacaccgatgcgcatggttcgtggataatagcacgcatggctttttcgtcgcggggccttgtctcaaagtcccgcctgcatgagcgccagtaa

SEQ ID NO: 680934 - DNA, 124 bp, Homo sapiens
gtcctgtgaggccttcaacatgattgatcagaacagagatggcttcatcgacaaggaagatttgcatgatattgcttgcttctactaagggaagaatcccactagatgcatacctatgatgcca

SEQ ID NO: 680935 - DNA, 861 bp, Homo sapiens
gacccatctcatgggggcacggagtctggaacaacatggtgaaaggtcaggaagcgttacagatgaccagtgtctagttccttatcgtaccaaatacgtccgcaaggatctaaagtatggtacattcagggtgacataattcacagggacctaaaaccctagtaagtctagctgtgaatgaagagtgtgagctgaagattgtggatttgggactggctcggctgacagatgatgaaatgaaaggtctacgtggcgcactaggtggtacagggggtcctgagatcatgctgaagtggatgcgttagaaccagagagttgatatttggtcagtgggatgcataagtggccgagtctgttgagtggaagaagattgtttgcgttggtacagacacatatagatcaggggaagcgcattttaagactcgtaggaagcctaggggggtgagcttttgaagatagaaatctcgctcagagtcggcaagaaactatattcagtgcttagattcagatgcgcagaaaatgaacttttgagaattgtatttatttggtgccaagtcgcaaccatggaatgtcagagttgaatggagaagatgcttgtatggactcagataagagaagattagagcggcgaaggtcttgacacatggctagtttgctgcaggtaacacgatcgtgatgatgaaggcagtgggcgatccttatgatcagtcctttgaagtaggactccttatagatgagtggaaaggtgactagatgagtcataagttgggagacaacctttaacatgaagaggtggagctgagaggggtaggtatgtgaacccttatggagggaagggctaaaggaagcaaatttacggtc

SEQ ID NO: 680936 - DNA, 453 bp, Homo sapiens
tcagggcttagcaaatagccgacggaaacactgcatttaatcgacatccattgcgccactgctgcatggaatccactgcattcaaatgggattcattagggcctcactgcatggaatacactgcgttcaatcgagatccattgggccacgctgcatggaatccactgcattcaatcgggatccatttcgccatgcttcatggaatacactgcgttcaatcgggatgcattttaccatgctgcatggaatccactgcattcagtgatgctgcatggaatgcactaacttcaatcgggatgctttggaccatgctgcataaaatccactgcatttaatcgggatgcattgagccacgctccatggaatcaactgcattcaatcaagctggatggaatccactgcatttaatcgggatgcattttaccacgctgcatgcgtcggctactcttccgg

SEQ ID NO: 680937 - DNA, 326 bp, Homo sapiens
ttccggaggcggagggccgggggccgagggagccgggcctctcggacgcggggcagggcagcgcccgggctggagacggactctgggaccctaggatgcgggggtctcagcgacctgccccgcgggaagcgcggccacggagtggcctaccggggaccctcccccagagggaccggtccggcgcggagagatgaacggctacatcacgaatgaggacaaggcgaatcggcccccctacggccaagatgacggtgtctaggtctgctgccagaggtgctgcctaatcgaggacggcgagcgctgacaccggcctggctgcatctaca

SEQ ID NO: 680938 - DNA, 1763 bp, Homo sapiens
  misc_feature (235)..(235): n is a, c, g, or t
  misc_feature (1457)..(1457): n is a, c, g, or t
  misc_feature (1763)..(1763): n is a, c, g, or t
gagacgtgtctcgtgtcagaagtggtatcctgagagttgcggaaacctactgtgcccaatactcccatcatcctattgtgaactactctttgatcttccgtggatgatcaaagactacggatcgagacaactggataaagtgagaaagtaacgcttgcattacccatcatacgctatccgccagggtactagccgtatgggctataacgacgattgggtgctgtaataatatctngtgagtgctcagagggtctcagctcccacgacggcctcatacgacagtggctttgacgtaacacgactccgagacaagttccgtctgtcctcgaactcctcgatgtgacgaaaaaatggagaggatgacaagctcgccgtgacatgattgttaaaaatgttgctctaaacacgcatgtacgctagtcatttagggataccccatagttccctcgtttgcagagtagcccatactctagttatccagcgtttattggcttccaaagaaaagaaggacaaccaactaggattacaaataacaaacctagagatactacagagataatacgaaagtgagcagtaggacagacatctacgccccgatataagggtcggccgaaaattaaagctaagggtacttccgacagcacattcgatataccttatatcaactacaaaaaaccaaccacaatcaatttctggaaaaacggacaaaattgtacgaagaaaacataacatgaaagggtcctctagagacaattgtgcccttctcgaacataagtgttcgcacacagtaaccacgacaagcttaccatacaaattgccaaaacacaagagaacattgataaccgcccacacaaaaacgattcggagacacagagaaatctccatcaacaacaggcaattcctaagagtctatgaacaagatatacatagtcaaaacacaagcagacacgcatacctagtaacacaagcaaaattagctttgaacaaacgacagccagccaaaaacgaatcaaacacaaagaaaaaataacaggacatcgacacgaagctggagtaccacaacatcaaagaactagaaaaagcatatgagcaacaaaccttcagaggacacatgcagagcagccatcaatcaacaaaaagcaaacacaatgaagatcgacaacaaataaataaaacatctaaatatatacattatgactagacacaattgaacacaataaagatcaaatacacaaatacgcataataacaaaaacacaacaaacaattaacaacgaatcaaaaaaaatgaacacgacataacacctaaacagatcataattagcaaacaatatatccagataactacaactacaaacacacaatagatatatagaccaatataaaaatactacaaaaattacatcaaaattaatacaccatgagtatccgataacaaaaacaataacaaacacaganaatacaagacagtaaataagaaaagaaaacaaaataagaatacagagacgaactaaacacaacaaacaataacactatataacaaagaacatacacaacaaaaaagaacaagacgaaagaatagacaaaaagaaaaggacgaagacctataatcaatgtaatagataaataaatacaataacggaaaactaatacagagacaacaaaaaaataaaaatacgagcaacacagaacacaaacatcaaacacacatactaattatctacagatagaaaaaatagaataagaatatactacacaaaaaan

SEQ ID NO: 680939 - DNA, 482 bp, Homo sapiens
  misc_feature (212)..(212): n is a, c, g, or t
  misc_feature (286)..(286): n is a, c, g, or t
  misc_feature (463)..(463): n is a, c, g, or t
ttttcccccaagcgtttaagacggccccccttttgaggacacacctggtcaccctggcaggttcccggcacggaatctcccgggttcgactccgcctactcaaatcgccgccgcgctccaaacacagatatgagggagcaggattgttgagtaagttgaagaaaccaactcagaggagagagagaaggagaatatatgattgactgattagnccatgaaaaagacaggtgggtgggccttcaagttacttcactttctcccaagttttcagttccaattctgtttntcacttctctttacaagaagatccatatatttttggtcctgtccttgcaactaaataaacttgatcgttgcagctgttataaacaatgataagagatatatacatttaagtttttgatagtgcaatttccctttcaataaggtggtaacaatctatatcccagcctaggcagcagangaagactctgtctcaaaaa

SEQ ID NO: 680940 - DNA, 161 bp, Homo sapiens
aacacaaactccccccacccccttcttcatcagccccaagatgtgaaaatgacacggaagtccaggtggctctggcatttatagcactgacatacattcagcccagagaaagctctggtgacaggctctctaaacaagtccctgttcggttgagctgtaga

SEQ ID NO: 680941 - DNA, 260 bp, Homo sapiens
cgccgagctacctcgcgaggctgaggcaggagaatcgctgcactccggcgaggcaggaaagtcatggctgccgccaagtatgacaccacatgaactccagacgctgggcacccgagcgtagactccgatctcaataaaaaagaagtaagaaagtgactctcagagactaaccaatagtcattaatttgttcaaattagccaagtcataggataagcagggactgggatcatagtagcatattcaaagaaacaggaactgg

SEQ ID NO: 680942 - DNA, 319 bp, Homo sapiens
acgacattcaatgggcaggacagtctttcaacaaatggtgtcacaacaactggatatccacctgcaaaaatataaagttggactcttacctaacaccgtatacaaattaactcaaaataaaagacctagatgtgagagctaagactataaaactcttagaaggaaacacaggggaaaagcttcatgacattggatgtggcaatcatctcttggatacgataccaaaagcatgggcagcaaaagaaaaacagacacattagacttcgtaaaaattcaaaacttctggctcggtgcagtgctcacgcctgtggtcccagca

SEQ ID NO: 680943 - DNA, 355 bp, Homo sapiens
aacgtggtcatcgctcagttgccttatgttctctctacaccctctagtgctgaccgtttgtctgggagaatgcaggtagggggtgcactcatgcaggggatgctgtcgaggaacatacgtgtgtgagtgtggtttgctacagtcaggtcctctctggtcctggtggtggtggacacgaatgtctcatctctcgaagggtacataatatgattattcgtcaatgattgtgggtggttctggagactcagagattctttggatccatgcgtgggcctcacatgtctcttccatcgtcgaatcccatcacattgatggccggagatctagcttcaagcccattttctcttttctcttc

SEQ ID NO: 680944 - DNA, 329 bp, Homo sapiens
tgagtgagcctcttgggctcgaagtggacaaaggcataacccttagagccgttctcatcacacaccagctgacaggacagtatgtctccaaagagcagaaaaagtatcataaagtgccttgttatctatagcattggtccagtgttcttgtctgaatgacgtttcccacaccagcattttctcaatagagggatccctcgtgagaccacatgatgcggacctggctttccctataatcacatcaaagttcatggtgtccaaagcccgctcagcgtcggccggctgctggaagttgacgtaggcatagcccagggagcggcgggtgatca

SEQ ID NO: 680945 - DNA, 291 bp, Homo sapiens
  misc_feature (243)..(243): n is a, c, g, or t
ctggctgtcgtatacactaacagctataaccatgcactgggccgtcgtttaacactaacagctataaccatgcactgggccgtcgttgaacacaaacagctataaccatgcatgggccgtcgttgaccacaaacagctataaccatgcatgggcggtcgttgaccacaaacagctataaccagtgcatggcccgttcgtttgccagcaaacagctataaccagtcatggcccgtcgtttgccngcaaacggctataaccatgcatggccagtgcattggcctgcacagtta

SEQ ID NO: 680946 - DNA, 131 bp, Homo sapiens
  misc_feature (20)..(20): n is a, c, g, or t
  misc_feature (108)..(108): n is a, c, g, or t
gatcagacgttttacaaatncatgaagcgaattgctgcttgtaaggagcagattttaaggtattcctggagtggagagccactctttttaacctgccctacatcagangtcaccgagctcccagcctgcag

SEQ ID NO: 680947 - DNA, 116 bp, Homo sapiens
cccactcggtcgtgaggaagggcgtcgagctcgccgtcaccgcctggttggcggtgacgatgaagccctcgtcggggtcgagggcggcggcatcgactcgaaggggactagccctg

SEQ ID NO: 680948 - DNA, 186 bp, Homo sapiens
aattttttcccccccccccccccccccctggggggggccccccttttttggggggggggggggtttaaggaattttttgggcccggggtttttgcggggggccccccccccccattttggttttttttttttttccccccccggggggtttcccttttttttttttttccccccccccttttttta

SEQ ID NO: 680949 - DNA, 459 bp, Homo sapiens
ccattaattggaaaaacctaccgcgtttcacaaatcatataacctatctgttccagattacacatggcactcctggtctacaccaacaagacgcaatttcagaattctcaccactcaaattgtacatacgtagtctagtgtctgtctccttcagcattgagatcaccgcctccagcacacctgctcagcacccctgggcatggagggccacaccatctcccttaatctccgcatctgacctttatactccacatgtccttctgaactctgaccaggatgtccccagagcacttcccctgtggagctctggtgagtccataagccacacgggccactgatcacctgccattcaaatcagggagcagcgatcggaataggcagcattggcttgcactgaaatgaacacactatctcagatcgctacattgtaaaagtctcaaaagtagagaccatgtccca

SEQ ID NO: 680950 - DNA, 920 bp, Homo sapiens
ctcccgtggccactgtaatgtcagtagttcggtgactcgagtactgatgagtcttgctttcgtcttgtacttcaaccactcgtgaggccacgatgccactagtaccagaactgggaggagttagaagtcgtacagccgagaagcttaacccatctgcttgaccctatgaaggtacgtgtggctctcaatatattggcattctgatgggaacttgtgtgtaaaagataacacgattgatttacgattaccaaagggtcacggatgtatatgaggggattgagaacattacacagatcgactaatgcgatttatgataggcaaaggaaagcccgcagttgtaccaatgggaagactgacgttgaatggttcgaggatgacagactatgtcgtgtcactatagggacagtaaggtagtctcttgaattagcagaactgtgtcgggacagcagagtactgtatgtaactaagtgggctggtcatgaagcctatgaaggtcgttacgggtaaattgtctgtaacatcacttgatgagagctacgggatgcgaactgttacgagtgagaaggccttgattaactttgggaaatctgaccaccgagacttcatcatgtactttaggaaactggagactaataggatgtacagggatgaactggtactcgttctctggcacactgtggttttcgtgcactctcgaaactgaagaaattcaagaagaaaccaattctcctgacatgtcagtccaactctacttatatacgtgactttgtctgtcaccatttcggcacatccgagttattaggagcaatcaacgttagtgtcggagcacataatataagagtgttcatggctcactcgacaaagttgccgtgttactcggggcacctaatacagagagcgaatgaaagagcgaaaatagc

SEQ ID NO: 680951 - DNA, 150 bp, Homo sapiens
actgagtctcttatcttagggcataattcatacaacaattatcaatataaacccctgcatacccataccaacgccctttgttgatccgtcctatcaaagagtctatctctattcccagtctaggtgtggatatatatataaagcgcacta

SEQ ID NO: 680952 - DNA, 183 bp, Homo sapiens
gtctgattcagctgcgaatgaagaggacattcggctgttcgtgctggccaactggcagtgcgagatagttttcagcgaggggatcagctcttcgcgctatgcgggcatgtgaatcgacccattgcagataggtgttccaccgtgagttgctacatgtggtgccaccatcacgatggtccctcc

SEQ ID NO: 680953 - DNA, 910 bp, Homo sapiens
  misc_feature (886)..(886): n is a, c, g, or t
gagcacacccgtctatgtagcaaaatagtgggaagattataggtagaggcgaaaacctaccgagcctggtgatagctggtgtccaagatagaatcttagttcaatttaaattggcccacagaaccctctaaatccccttgtacatttaactgttagtccacagaggaaccagctcttgggacactaggaaaaaaccttgtagagcagagtaacacaaatttaacaaccatagtaggctaaaagcagccaccaattaagaaagcgtcaagctcaaagccattacctaaaaaatcccaaaatataagtgaactcctcacacccaatggaccaatctatcagcctatagaagaactaatgtaagtataagtaacatgaaaacattctcctcgcgcataagcctgcgtcaggattaaacacacgtgaatgaccaattaacagcccaatttatctacaatcaaaccaacaagtcattattacccctcatgtacaacccaacacaggcatgctcatagggaagggttacaccaacgagtcaacgggaactcggaaaatcttacccccgacggtataacaagaaacattaactctagcttcacagtataagaggcaccgcctgccagtgacacatggtaacggcgggaccctaccgtgcaggagcatatccattgtccttaatcaggacttgatgatggtccagagtccagcggccatacttaccaggatggctgcggaaggggctgccgagagagccaaggtattatacgaaggcgaaaccaggcaaacacacggaaatggggggcgagacacgggatggaggcgaagaaaacagaagggaagcagaacaagcaaaagacgcgcgcgtccgttcccgcccagcacacacaantcctgcacacgcagaaaaagaaga

SEQ ID NO: 680954 - DNA, 92 bp, Homo sapiens
  misc_feature (55)..(55): n is a, c, g, or t
tctctaccctgactaattggaagcgttttttggggtcggggtccgatttttgggngggggtcccccccccaggacaatttttaccccatttc

SEQ ID NO: 680955 - DNA, 327 bp, Homo sapiens
  misc_feature (45)..(45): n is a, c, g, or t
ttgcctggactagcacccagcactgagaaccacggaaggcgcctncggagcctgctgaggaaacacagcgtgcttttattgatttacttctgaacactacagttcctggatggggcggaggcgcgagttaatgtcggtttccctagaaatcactcaaggccggcctgtgtccttgatgccagggtcgggtctgtgactgccatggtcgctgcttgccaatgtgccatgtccgcagcggttgtccgtgggttccagctgtgggtccttcccgtgaaggcctctggaagtgactgctcggttcctaagcaataaaattgatcatggtga

SEQ ID NO: 680956 - DNA, 415 bp, Homo sapiens
  misc_feature (200)..(200): n is a, c, g, or t
  misc_feature (225)..(225): n is a, c, g, or t
  misc_feature (340)..(340): n is a, c, g, or t
  misc_feature (351)..(351): n is a, c, g, or t
cgtggtgaaacggctcctgctatctcccgaacacttccatttttttcaatttgtgtcaatgggagtggaaaccacaatttccaaatatattgaacgatttgttatcaatggaaataaaaaggatcgacgattcgtgtcaactttaattaatcagatagttgaaacagcagcaacatcaaagaagtggtctgttgaactgnaattgtatcgtgaacggcttaaatnaaaatcagtagctaatgccgacgataatcaatggttgctgaacattttatgtaacaaaattgttgaatagacttagattattttttatttttcataatttattgaatggtgcagnacagttgtgancgttgtaattttgatctcattttccaattttgtgatacaattctaataaagcaaattttacatc

SEQ ID NO: 680957 - DNA, 153 bp, Homo sapiens
tgagtaattgaggagtccgaggaggttagttgtggcaataaaaatgattacggatactagtataatgagatcaggttcgtgctttgatgttgtgtatggttatcatttgtttagaggtgacgtttgattagtctgtgcggggtggtgattagt

SEQ ID NO: 680958 - DNA, 312 bp, Homo sapiens
atgaagatagcatcattaaccatcagagtactgcaaactaaaaccacaatgagctcacacctgtaagcccagcctcccgaaatgctgagattacaggcatgagccaccgtgcctggccaacttgtgctttgcttgccccagccctgaagtcatcagctttttccagagattcttggttccttctggtggggaatggtagtaagtctgattgccttctcaacatattcccttaaatgtctcaaaagtaccttaagtagcgcggcacagtggcccatgcctgtagttacagctactcaggaggccaaagcagga

SEQ ID NO: 680959 - DNA, 273 bp, Homo sapiens
gtcgcttgaacccaggagacggaggttgcagtgagccgagactgcaccactgcactccaacctggacgacagagcgagactccatctcaaaaaaggaaataatcactattaatacagtgctgcagagccctttaggtggtggtgtgtgtatgaacataaatagaagtgggggctcggtacggtggctcacgcccataatcccagcactttgggacgccagggtgggtggattgcctcaggtcaggggtttgagatcagcctggccgacatact

SEQ ID NO: 680960 - DNA, 417 bp, Homo sapiens
ccggttgcttaaggacgctgtttttacatttactcttgccgatcgcgcgaacccagttgagctcggtatcctagggaacacgccttgcacgcgaaggggccatgagtctgacttccacgaacagtgagccaggcctgtgcatgctggcaatagacatctctactctgaggctgtgggtgaccagaatatggagaactttggtgtctccaacattgcctggagctgtcttgattggatcgcagcagggaccattgatgctgggtcagctaccatgggttatctagcttacgattttatgctaaagatcagcgagtccagcatgagaagccgtccgattcagaatgacaaccccaagatagcatgcttttgagatggaggtcatggataccgccgggtacagacgtcgattgtgggcac

SEQ ID NO: 680961 - DNA, 326 bp, Homo sapiens
tattcgttcagcaaaaggaagtatacatgtgcctatgctgaattcaatggattgaattttatactgaacattaacaaatgtaaacatttgtaaggctaatgtgaaaggttactgttaagggaagcttagttatcagcgaaatatatatccagattactagccatttctatccttgacttttctcctctagcaaccttttaaccttttaaagggggataacccccacacaagcatctgaacacagccactcatatatcacatctcttttggagggctgctttccgagtgacacagattgtggttagagaaaggatgacattcttgct

SEQ ID NO: 680962 - DNA, 320 bp, Homo sapiens
  misc_feature (11)..(11): n is a, c, g, or t
ctcgtgcgganaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaagatgggaagagggagaggagcagaaaaagtacctattggtgattgaagtactctgtacaacaaacccgtggacaagagttttccctat

SEQ ID NO: 680963 - DNA, 392 bp, Homo sapiens
cccgtctctgctaaaaatataaaaattagctgggtgtagtagtcccagctactcgggaggctaaagcaggagaatcgcttgaacctgggaggctggagtatagtggctcgatctcagggcctggctaatttttgtatttttagtagagatgggttttcaccatgttggcctcaaattcctggcctcatgagatctgcccgccttggccacccaaagtgctgggattacaggtgtgagccaccactcctggccaaaatttatttcttgttaccaataaccagcagagtaattttttaaaaactcaaatacatttaggaacacccatagataaaagatcaataaaacaaaaattaagtcagttgtagatctatatgccagtaacaaacaattag

SEQ ID NO: 680964 - DNA, 135 bp, Homo sapiens
cccagacggtagaatgtcatgcgagctccaaagaggaacgaaaccagctggattcagatcattcaggacacaatcaacaccctgaacagagatgaagatgaaggaatcctagtgagaatgaggaagaaaagaaaa

SEQ ID NO: 680965 - DNA, 365 bp, Homo sapiens
cgaccgacacgtcgtacttcgacttgtcgtagccgaacgcaccggccatgccgcagcagccggtctgcagcgtcgtcaggcggtcgcccaccacccggcgaagggccgacgcgctcgacgccgccccccacagggctttctgatggcagtgggcgtgcagcagcacccgctcgccgccggcgcgcacgcgcggcgcacgcggcgttgccccccaccttgcatcgatgaactgctccacgagcatcgacttgtccgccaggcgcctgcgcacgtccggctgcgtcgagcaccgcaggcgcagccagtcgtccttcaccgcgctcaggcacgaaggctccacgaacagcaccgcctcgaccgacggg

SEQ ID NO: 680966 - DNA, 1021 bp, Homo sapiens
agcgggacggtgaacctgagagggtgcgcgatggcgccagctggagtgcggctggcggaggaaggagcctggcggcgggttgggggctggaaggatttgaaatttccctgcccaagaatcaacaggaactctgtatatagaccagaaatgtgacatctatctttggtacataaataaaggataacaatatttgatgaaacaaatcttcaatcaagtataacattttgatgcttggcatctagactcccttgtgccctcactatgccagcggcaacctgtagactcatagccaaagaatctcgtgaacgtttgggccttggccacctggagtagtgacaggacgtagtgaacgcaaaatgtcgtcaacgattactccgaacaactactcacttacgttgctactggacaccgagatttccaggtgctggttgcaagagccatcggagaattcacggagcaactgctgactatcaataccaactatcgcggtgtcaatgtcgactcgtcacacagataattcagcgtacggactgacatctatgacatgagcacggagaataccctccaggaacttcaaccttggcagttcaactctcacaatctcacatttgacggacggacatgtatgcccaggactctactaccgagctactaacaaccatctggtatccagttccaaaaacatgaggaggacacggacctcggaaacccagtaccttggcaagaaccacttctgaccccctggagcggccatctgcgacacggggtccaccgggcggccaagacaccacacgagcacgacatccgcgactaccattacacgaccacatcctaaaccacactccgacactggacctgcaagcaaccaacctcgcaaccatcggaaccaccccccgcaccgggcacaggccccccgccgacgccacgaccggcgaacgcaccgcagcgccaccagcacagccacaccaccccagacgcggcacacacagacagcgcgaccacacccaacgcagccccacgg

SEQ ID NO: 680967 - DNA, 439 bp, Homo sapiens
  misc_feature (396)..(396): n is a, c, g, or t
  misc_feature (416)..(416): n is a, c, g, or t
  misc_feature (436)..(436): n is a, c, g, or t
gccccacctcgtaataccatcacctatgggttataatttcaacataggaatttggggaggacaccagcatttagaccgtagcaaccctctgcttcctcttgtcttgctgggatggaactggcctgtcttccctactggaatataaactccatgatggtagaaaccatgttgctttgcccaccatggatagcatgaggaagacgctggactcttccttcaagagatacgtgtgtgaatggacagtgggctcatgattcacataagagtcaacagctccggaagcctcttggcgtcactcgcattgctcctctgctgactcccgaaggtccttcttgtggatggaaacggggtactccaccaccgaggctttggggtggcctgcccctttggcgtccntaaaagaccttgcccttttntttggggttggccaagaaanttt

SEQ ID NO: 680968 - DNA, 140 bp, Homo sapiens
acggtaacaagatttaccacttttcctggtgccaagaaaggacgacgcagtcccacagtctggagggagtccgaggaattaataagttatttaataaaacattttaaaaaccacattggggggatggggataaggaaggg

SEQ ID NO: 680969 - DNA, 1252 bp, Homo sapiens
aataaagccccgtgaggcccgtgtgggtctctccgtgtgccctggggcgctttcggggtgatgtcatggctttcactctgactgtcaccttgggcatatgacgtcacgcgcagaccaccacgcccagaggccagggccctcgacgccaaaaccgaggactttcggtaggatgccacgtaggaagcagcaccccacgaactgtgcgggtagtgggccttgggtgtgctgcaagatcccaggaataatcctgggaggtcatccacgcattccattctcgcttcctactccgctcagaccacacacagaagaaacccccacccaagcgagcattgcccgaggctgggagggcactgggaggatggtaggccagggaaaacacccatcgcagagggaaaccccgggacccacaggataccacaggccacggcaaaaccgaaccggaaggaggcagaagaagcagagagaggaaagaggcaacacgaccagagaggaacccagagagaaaaagccaaagcaaaaagaataagacaaagcggagacaagatcaaaagcaaacacggcagaagaaccacgaagaccaaggggaaacacacaagaaaggaggacaagagaaaagacgctcagggaaacgacgtagaacacaaaagcaaaagccccgacgcaaacacagagaaggaaagccaagcagaagacacgaaaggacccaaagacaccactcaaaaggcaacccagacacccaaaccaggagatggacaagaaagaaacgacaacagaaacacaagcaaagaccactgcacaaacggaaaccgagaacaaggaaagaaaaagagaaaaaaaagaaagcacacggaaaaacaagagagaaaaccacaaaaaaaaagacaccaaccggaactgaaaacagaaacagcagaaaaagagaaaaaccaaaaaagaccacagaaaagaaaaaaagagcaacaaaaaaaaacgaaaaaagagtacaaagatcaaaaaagggaagtgcaaacagaaagagaagaagacccagcacagaaacaaaagtgaaatgatgataacacagaagagaaaaagggagagacaaaagggcggggccagcactgcaaaggagaacaacagacaaaagagaggaagcaaagaaacaagggagccagaagagagaagaagacaagagaagacagaggcaaaggcagcaaaagagaaaaaaccaacaacctagacacacaaaacgagaaagccgagagaagaaaga

SEQ ID NO: 680970 - DNA, 370 bp, Homo sapiens
cttcaatgctgattttccttccttctcaccatctgtcagcttcccctggacatccacttcatataaccctaatcactctactctcatcattattcatacgacattttgcagaatggaataaactacagtgatgctctggagctgacctatgagcttggcagatcacagtaataactaaagcttagaaagtctctatcggtggccgggcgcggtggctcacgcttgtaatcccaacactttggaaggccgaggcaggcagatcacctgaggtcgggagttcgagaccagtctgaccaacgtggagaaaccccgtctctactaaaaatacaaaaattagccaggcgtggtggcatgcccccgtggtcccagc

SEQ ID NO: 680971 - DNA, 117 bp, Homo sapiens
ggtccttggttaaacaataacttaagtggagggagggcttcagcctggtggcctggggtgggagactgggagggcaggtgagggagcaggccacttcgtgaagaaaagagtgcttgg

SEQ ID NO: 680972 - DNA, 271 bp, Homo sapiens
  misc_feature (180)..(180): n is a, c, g, or t
  misc_feature (267)..(267): n is a, c, g, or t
tcccaggttcaagcaattctccccacctcagcctccaaagtagctgggattacaggcatgcgcaatcatgcccagctaatttgggtaattttagtagagatgggttttcgcttagtagagatggggtgtttgccaggctggtcccgaactcctgacctcaggtgatccgcccacctcggnctcccaaagtgctggggttacaggcataagccagcaagcccggccgaccttcttctatttttccattctcctttccaaagccatggncatg

SEQ ID NO: 680973 - DNA, 203 bp, Homo sapiens
tctaccacagcgggtgtgacgcgaatatacagcctgaggtcgtcctcactcactgtgtttgaggaactgagggcagctggcagtgtgatgaggctggcctcctactaccgatttagatcctggaggccttccgtagagctgtgggagctgcagctggcataacgttagaggaagtatctggatcgggcgggctgggatctctg

SEQ ID NO: 680974 - DNA, 342 bp, Homo sapiens
  misc_feature (121)..(121): n is a, c, g, or t
cccccggggaacccggcccgttgctagtcaaggggtttttaaaaaaaaggaattttcaaagggccccgtttttttgtttttttaaaactaaccccccccccaaaggggggggcaaggggtnggggttttaaatgtcttcttttggttcaccccaagggttaaggggcccaacccgtggttttattttttaaaagaatttgaccccccagggggtttttcaacttggaattgggggtaaaaagcccttggttttttttttggactgggttttttttttttccccccaatcaaaaaacaaaaatatgggttttgggcggtttaaaaaaatggttttccccccca

SEQ ID NO: 680975 - DNA, 183 bp, Homo sapiens
cagttttgccccagccttaaaaggggtgtttaggcagccccttggaccccaaaaccccaaacaagggggcaggcgggggaccaggccctttcctttgggattttttttttttttttaaccataatggttttgtattgaaccccttcatattttttatatataatatatatatatatattttca

SEQ ID NO: 680976 - DNA, 512 bp, Homo sapiens
agcactttgggaggtcaaagcaggagaatcatttcaacccaggagttcaagaccagcctgggcaacatggtgagaccccatctatacaaaaaataaaaaaaaattagccaggtctggtggtgcatgcctgtggtcccagctactcgggagcctgagatggaaggatgacctgagcctaggtggtcgaggctgtagtgagccaagatcataccactgcacttcagcctgggcaatagagtgagatcctgtctcaaaaaaaaaaaaaaattaaaatataggcttaatttgcttcatcatttcctttaaaaaaagaaagacagggcaacatggtgagaccccatctatacaaaaaataaaaaaaaattagccaggtctggtggtgcatgcctgtggtcccagctactcgggagcctgagatggaaggatgacctgagcctaggtggtcgaggctgtagtgagccaagatcataccactgcacttcagcctgggcaatagagtgagatcctgtctc

SEQ ID NO: 680977 - DNA, 1663 bp, Homo sapiens
  misc_feature (1)..(1): n is a, c, g, or t
  misc_feature (56)..(56): n is a, c, g, or t
  misc_feature (991)..(991): n is a, c, g, or t
ntgttctgagtcgtgttcttctcctcgcagtggggtgggtggtagcgcgcccgtcnttgtggttgctgcctctgctcgtttgttgactactctcttttgtgtgaggttgttgccttcgctctcccctctgagctgtgcgaccaccgatcgttgtgtctgccggcggctccctccccgatgagagcctcacttgcggggggaatatgtgttgtcactgacttatgagataagttgtggtggccgcgggatgctgccccacttggaggcctccgcagtagcgccgccgccctgtcgcccccgtgtttgttatgagtgggtggggccccccccccaaccgccacactatggtgggcgcttgtttggtgttgtctttttcctccaacgagaacctctggttttgcttcttgttgtgggcccccgtcgtcctcgctttgttgctcgtgtgcgcccccccggctgatggggggcccccccctccctccccgaccggcgccacaacgtctggtgcccaccacatctcctcggtggtattgttgtgtgggtgttgtgggtggtggctccttcgtctgtgatagctggcgtccgtcgttttggtggaggaggggcggctgtctttttgtagccacaccgccgcaggattgtttgtggtagctaccgttgtgaggagtaccacccccccgccggagacgtcctcccacggcgcgttagaggaggagttgttgcccccgtcgtcgtcccaccgtcggcgggagcaaacaacagtcggggcccaccacaatagtatagtagaaggagcgtgtttgtggtgttagaccacagaaaacccacagcgttgtgttgaggagcattagtaatagggtacataatatgctcgctgtttgtgtggtgagggctcacagcgcccgccaccacatagcccacagcaggataatatcgccgtgagagtagctccccgcggcgaagagtactccacccacagtgtgtggcgtgntgacccacaccatcatatagtattggtgccccaccatccgaggcgctgttgtgtccacaacggtgtgctctcttgtatatgtgctctcgagagagagagcggcgccttgtatatatatatattatagtctctcgtctatagtagatagagttgttattatatagagagcgcccctctcgcgatacgcgctactagagagagcgcacactctatagagggtgtgtgcacgctcggtgtctatatagcgctctgagaggagaacctcttgtctccacacatgtgtggtggtggtctcgccacacgtgtggtgtgttttggacacacaaagagaagctcacataagaagtctcaccagaaggtggtgtgtctctccgctgggatccacatgttgagagttccctgctgttggagaattttgtataaattaacacctctaagtgtatactatccttatataataaatcccactgtcaaattgctaagacacacatccttttagcccgcgacctcttttctataggagaaaaacttatatgtaatataatttccttttttaaaatgcccgctgccttaaccttaaactataaggggaaccttcccgagggtcgtaaccccttgctgggttttctggtccacataaagttttatctattgaatgacccctggaatata

SEQ ID NO: 680978 - DNA, 182 bp, Homo sapiens
cacgtctacacggttgaactcacagatttgtaccggctcattaatctaataccaaggtggaacagttatcttcaatacaaagtcaaaatcagcaataagttctataatccattgctgatatcagataccagcttcaaggacgatttcttttcgaaggcttattccacttcgtgggcagcggt

SEQ ID NO: 680979 - DNA, 337 bp, Homo sapiens
gagtatactaacacctcatacaccaccatagtacacacacacggacaaatatcacccacacatcacacaacacatacttcacacatacaccacataccccacaccacacactacacatcacacacctcacactacatacctcatacacaatacatacctcacaccccacatacctcacacaaccacatacactacacacacatcgcacactacacacacacacaatacggctctgcaaggaaacgtgtgaggggtgtggtgtgtgtgcactgtgtgtgagatgtgtggtgtgtgtgaaatgtatgtgtgaggtatgcagtatgtgtgtgaggtagtg

SEQ ID NO: 680980 - DNA, 536 bp, Homo sapiens
  misc_feature (323)..(323): n is a, c, g, or t
  misc_feature (383)..(383): n is a, c, g, or t
ttttaataaccacaggatatttctttacattgatattctcacaaagaagaaatagaatataggctgggcgtggtgtgtcacacctgataatcccagcacttacggcaggccgaagccacgcggatcaccacgaggtcaggagcttcgacgaccatgcctagtaccaacatgaatgcaacaccctgtctctacgtaaaacatacaacaaattcagccagcgcatggctggcactgcactctgtacatcccagtctcactcagggagcgctgacgacagcgagaatcgcttcgacacctgggacggcagaaggttgcacgtaagnccaagaatcgcacctattgcgactaacagccctgggcaacaacgaggacgcgaaactctngtctcaaacaaaaaaaaaacgagaaagaatataacagtgacatctgaatctccactcaaggggatggccccaaggatatggtacctggtaatctcttcatgccactaggtgtccccagtgttcaacctccatgactgagcatggaagaagtag

SEQ ID NO: 680981 - DNA, 159 bp, Homo sapiens
tgtgataaaaattatatggctttcatttaagccaacactagtgcacaataaaaaaaatagctacttggagttcccattgtggtgaagcagaaatgaatctgactagtaaccacagggttgcaggttcaatccctggccttgctcagcaggttaaggatc

SEQ ID NO: 680982 - DNA, 779 bp, Homo sapiens
ggccatggagcagcgcctgctgtcaccgacttcttcgcgcgccgcgacccagtgagtccggggactactacttccagcctacgatcgccgtccgatttcatctccgcttgcaacctccgcgaccatcttctcggccatctcctgcttctgggaccagccagcaccgctatttgtggcttagctcctatcttgtccaaccaatccatgagctcccagattcgtcagaattatatccaccgaccgtggaggcacgactgtccacacgcctgcgttcaatttagtacctgcacggactcctacacctacctcgtctctgggcttctatttatcgaccgcgatgatgtggctctggaaggcgctgagcccactttcttcctcgcgacctggccgaggacgacagcgccgacgggctacgagccgctgtccccttcacggatgccaaaaccactgcagagcgcagactcgacaccatcctctatcccagggaccatatcaaacaaaccacagcctagtaatagacttaccttggaggataacatactccccactaacgaccatataaaaacgccattcgtccaatagggacccactgcgcacaaaacacacaccctgacacacagtgccactctctaatggcattcattacactgccaccttggcaatctctgccccgcaacagtgaagcccccactactcctggtatcacctattcccagggacccacatcaccttcacctacacctacagtgacacctgcacgactaaatcacaaaaaataa

SEQ ID NO: 680983 - DNA, 701 bp, Homo sapiens
caagtcttatgaaagtgtagaattgtggctttgtgtaacgttatgtcgttatgacacaggacacttccttgttgtcttctcgtagtgaaagggcgaagtaccactaatagggtgtatctcgagaaactgtagattgaagataagaggagacctaggattgttctgtcctgccttatttgaagattgttcttgattcccttgaattcccaggagagattctctgacattcacgtgtcagccactttggctctggagcctttcagagtggggacatgcaaaaacttcgtgtctccttcttatccccgaatgccgtcagcattacacttgacttccttaaaaccgaccatgattatgaatgtgagcctgtggacgaaccccgtagacataggtcagcttgtcggttacgtggtaagcaataaccgtcagggcttctgctgttgcatgcacaatctgagatggtgtcatcttaaaagagccaagtattcctcgtgctatcaggtgaagtggattcggtcctgctgggttttactttagtccctccatgtcaaatgttggagcctgagaaaaagctcatacatgtctcatgtgaagtgtccatccctctctgatgatctgtcttgtacataacagcaacgacatatcttgtaaggttttacggggactttcggaggaggggagtttggaacatcgtcaccacatgt

SEQ ID NO: 680984 - DNA, 171 bp, Homo sapiens
tcgcctcggtcacagatgatcgccgacgatcaccgcgttttgcacttctttggacaagcgcaacataccggccacggcgccaccggaagacacgccgcagaagatgccttcttcacgtgccaggcggcgggtggtgtcttcggcttcacgctgggccatgtcgatgatgcg

SEQ ID NO: 680985 - DNA, 271 bp, Homo sapiens
caggattactgtactcactcaggtctgcatctcattcccatctatagtaccactcaatagggaggacagctaaaatccacagagagtacaagggaaaccagccatgaacccaggacaagatcagtgcagacaggtcctgaggcccagcaccggacacacaactatgtaatggcagaagttaataatacatatgtgagtgataccttaactgaacacacccccaaatccatttcctctgcacataacccagatagtccacactcttaaaaac

SEQ ID NO: 680986 - DNA, 325 bp, Homo sapiens
ccatccgtagggggggctttctccgtttcgagcaacaatatgaggttgacaggtcctagggtcgcatttatggaggctaattggaactctaactaagtctggcccatgtttcgttgtcgtatagtagtcggtatagacttgtctcctagcctgatatgtgccctcggtgggctcatagcatatctcactcttctgctatcttgcaggctttgcctttcccgtgttcaggttgtggtatagaatgtggtgcgcactataggccttgtagtatgtgtagcaagacacatgtaaatcatagtgacgccccattggcggaaagtttgct

SEQ ID NO: 680987 - DNA, 265 bp, Homo sapiens
  misc_feature (83)..(84): n is a, c, g, or t
  misc_feature (141)..(141): n is a, c, g, or t
tgtattatgtaatgagatgccgggggaataggttatgtgattcggagtagggttaggatgagtgggaagaagaaagagggaanntcgcctacaccgggccatctgcggggtcagtgggggctgctgtatgtcttggctgcngaacggggaaggtgacataggcatcatagccaaagaggcacgtagcgatgcgggaccagtacccctgacaacgattattggagtgctttcctgctctcaacaaggacaacaatgtgaggtgatc

SEQ ID NO: 680988 - DNA, 249 bp, Homo sapiens
  misc_feature (67)..(68): n is a, c, g, or t
  misc_feature (125)..(125): n is a, c, g, or t
ttgttggggtgggaaggagttatttcaatggaggagttatttgcagattgcagagagatgagggaanntcgcctacaccgggccatctgcggggtcagtgggggctgctgtatgtcttggctgcngaacggggaaggtgacataggcatcatagccaaagaggcacgtagcgatgcgggaccagtacccctgacaacgattattggagtgctttcctgctctcaacaaggacaacaatgtgaggtgatc

SEQ ID NO: 680989 - DNA, 440 bp, Homo sapiens
ttctcatctgttgagaaatagagaggaagggtaataatatctagctttgtgaattcttgtgaggatcttctcccctcccccacctttaattataatatagggataatggcctccaattctttatttagtatggtaggagatctttcaaatgatattgcatataaagtagctggcacttaagagctaatatttacaagggcctgttttctcttccctccttaaaacagatttattgtccatcagctaacttgtttaactttttaattacaataagtccttagtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaaa

SEQ ID NO: 680990 - DNA, 126 bp, Homo sapiens
catggtgcgttctgctgtatcccagtacttatgaggaggcagaggccggcaggatagcttgagctacaggaattcaagaccagcctgggcacatggcgaaaccctgtgtctacgataaatacaaaa

SEQ ID NO: 680991 - DNA, 550 bp, Homo sapiens
  misc_feature (161)..(161): n is a, c, g, or t
agtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaanagaaaaaaaattatttgtcccaattcccccacctttaattataatatagggataatggcctccaattctttatttagtatggtaggagatctttcaaatgatattgcatataaagtagctggcacttaagagctaatatttacaagggcctgttttctcttccctccttaaaacagatttattgtccatcagctaacttgtttaactttttaattacaataagtccttagtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaaa

SEQ ID NO: 680992 - DNA, 149 bp, Homo sapiens
cgattcgcggctccttctcacctttccctgacaatacagcaagagcccactgagccagagaatgccacgacgttgactctttccacttagtcgaactcatgctgcggttgtcagcttcaccagaggaaagtgattaccaccagtagtgt

SEQ ID NO: 680993 - DNA, 847 bp, Homo sapiens
gagactcctcggtggtcgtgtcaccgtgtcttcccaggagactgagaaggaggagagcccggaaccaatggtccggagcggcgggcggagccgaagctgcggggagccgtccctgggtgcccccacccctggtgcgcctcagtggtgccgggcgaggtgcggggtgctcgctggtgtgcggggctcgccgcctgctgtcattgtgcggcggggcgcgctagcggcgccgagctcgtgggcatggggaacccagagaagctgagggggcggtaccggctgggccgagtggggaccgacgacggactccctgcgcgtgtgcccagcctcttcccgcgcagcgcgccctttgcctccctccggtaacggttccgccgagttgcgggcaggtaccgcctcgtttccccaagctgccgcgggtttcctccgagagctcttcgggcgcggggttgaggcccctatccccaaagaagagcaagcgtggctggctagacgcgtgtgtaaccccaacgagggcggcgaacccacgctggagttagacgctccattccatatgtcaacctggactgggagcccaatgttccctatagaacacctctaccgagcaccaaacaggcaaatggtaacccacacgacagtaattgcacccccaaaatgtcccatcaaactcctccgacacccttcattagcagagaacctacaacacaaacctctgggtgaacgacacatcacgatgttggaagaccatcttcttctaaaactatggccagtggtggcccggctgtcctgtgcaccagggcttatgccttggtccagactccaagatcgcccatcctggcatgttccaaga

SEQ ID NO: 680994 - DNA, 365 bp, Homo sapiens
  misc_feature (39)..(39): n is a, c, g, or t
  misc_feature (44)..(44): n is a, c, g, or t
  misc_feature (104)..(104): n is a, c, g, or t
  misc_feature (129)..(129): n is a, c, g, or t
  misc_feature (248)..(248): n is a, c, g, or t
  misc_feature (299)..(299): n is a, c, g, or t
  misc_feature (344)..(344): n is a, c, g, or t
tgcagctaacttccctggcattatgacttccagagtggnccagnctgctggctggggcatttctgcaaggcaatgggattgggcagccttggattcttggtggnctcctcggcacccctatgtgcgggntctacctgtctgccggacaaacggagggcggtacgagcaccaaggtgcatcggcagacgctgtaaccctcactttggggagaccttcgccttcaaggtcccctacgtggagctgggggncagggtgctggtcatgggcggtgtacgacttcgaccgcttctctcgcaatnacgccattcggggaggtgcgggtccctatgagctccgtggacctngggcggccagttcaggcctgg

SEQ ID NO: 680995 - DNA, 529 bp, Homo sapiens
cgttcttatatatcgtacatactagatcatcatagcagtgtataatgttgcaagtttttcaccgaggtgtgtagcatagtctttcattaacagtgtcttcttgatcccaaaatcttgttattggtaatgaacgtccagtgagtctattgttccttttcttgcctgtgctttaagtgtcacatctaagagaaagcattggctaatccaaggtcacaaaagtttacccctgtgacttcttctaagagtttgatatttactcttacatttaggtcttcgagccattgagttcattctgtgtatgagggacaggtccagatcagttcttttgcatgtgggtatccatttgcgcagtacctgttagttgacaagatcattcttccctcatcattagttatactttgcacctcagtagttgtgtattgaagtatgtctagttaaatcttttataggcaagcttgcatttgcagctttgtgctctgaaccatctaactgtattcaggctgcttgtggggggtcaaacctgtaatcg

SEQ ID NO: 680996 - DNA, 159 bp, Homo sapiens
cctgactgcttttcatgtcagtgcttttatcttcactgagaagccagagtgatctctgagctccctagcactgtcgtcaaagaccatctgtatgccatgctccctttgatgggtccataccccagctccgtgtgatgcccagtaaagcctgaaccttga

SEQ ID NO: 680997 - DNA, 192 bp, Homo sapiens
  misc_feature (182)..(182): n is a, c, g, or t
ggaactgtgacaaggaaggatagtgacaagatctgaaaaaagcagccctcttcccacactcaacacatgcagtaaacccagacatgcagggcaccattgtctgagctgtcactggagggctgggaggagacaggggatggggcaatggcagcctacccacccctcctcatcactgtccaggngcattcagga

SEQ ID NO: 680998 - DNA, 114 bp, Homo sapiens
ttcaatttctacacattgaagggaacaacacccttgatgcagaagatttagcaccactatctccgttccatctgggcttatatgtacttttattttttgggtgtagaaattgaa

SEQ ID NO: 680999 - DNA, 874 bp, Homo sapiens
ccacacaacagaaaacttaatcaacaaacgtgtgtgtgtactggctgctccactgagtggccattcccctgtctcaaaatcccttgggccttcctattccctgagacataacaatattgaaattaggtcaagttaaataattctacaagggtctctaagtgaaagaaaaagtcacaattctcttacttcaaaacaaaagctaggaatgattaagcttactgaggaacccatgtcaaaagctgagataggctgcaaggcctcttgtgccaaatagttaaccaggttgtaaatgcaaaagaccaattctttgaagcaaattaaaagtgctacttcagtgaagcatacaaagcgataagaaagcgaaacagccttatgctgatatggaaaatatgggtagaggtctggatagatgatcaaagcaagcacagattccctcaagccaaagctaatccagaacaagacctaaatttcttttaattctatgaagactgaaacaaggtgaggaagctggagaagaagaggtcgcagccagcagagagatggttcatgaggcttaaggaaagaagccgctccacttacctacaagtgcaggtggacgcaccagggcgatgtagaagcgcggggggtatccagaagactgccacgataagggctgggcggggtacaccaaacgagaatcaggtgtgaggacagccgaaggagcacaccggcgagatgccagcagagaagcggccactcccagccggaagcggcatacggcggcggggactaacggcacccgcaatcacgacaacggcggagagggaccccgggaagaagcggcccacaccaggcacacagcgggggagcacaacaccaggggcccgcgagtaaa

SEQ ID NO: 681000 - DNA, 191 bp, Homo sapiens
ctctaaagccaatggaaggaaagactcttcacatgtcgtcttggacacgtgattcggcagtcaccactactggccatctgatctataaatgcggtggcttcgacaaagaaccttgaaaattttagaaggaggctgctgagttgggaaagggctcctccaagtttgcctgggtctggtaaaccgaaagctga

SEQ ID NO: 681001 - DNA, 152 bp, Homo sapiens
tatctagaggatcccgacacaatgctactgagaggtcacatccctcttttcccaatcaatactaacttgcaaatattaatactatattatattttttcccaatagaatagcaaatggaggtatgttaacacattaaaaacttcagtagcttc

SEQ ID NO: 681002 - DNA, 296 bp, Homo sapiens
  misc_feature (16)..(16): n is a, c, g, or t
  misc_feature (190)..(190): n is a, c, g, or t
  misc_feature (218)..(218): n is a, c, g, or t
gtaattacagtatttncacgtagagacgggtttctccatgttggtcaggctggtctcgaactcctgacctcgggtgatccgcctgcctcggcgtcccaaagtactgggattacaggtatgagccaccgtgcccagccggtttttttttttttttttgtatagcaatggaagaatggcctcgtacacacgntagagtggaaagtcccaggcaccaaggnttcccaccctagaagcaagctcagggctttctcttcatccttccagggagagcactgagagatgatggggggttggca

SEQ ID NO: 681003 - DNA, 631 bp, Homo sapiens
  misc_feature (327)..(327): n is a, c, g, or t
  misc_feature (610)..(610): n is a, c, g, or t
gcacgaggggtgtccaggcggagtgcagggcgcagtctggctcacgcaagctctgcctcccaggttcacgccattctcttgcctcagcctcccaagtagtggcaggagacagatgccttcctcttatctcaactgcaaaaaggccttcctctttttctaatcctcctcagcacagaccctttacgggtatcccccggtgtcacgctgggggacggtcaggtctttcccttcccacgaggccatatctcaggctatcacttgggaagaaacctgggacaatacctggctttcctaggcagaggcccctgtggccttctgcagtgtgtngtgtcccagggtacttgaggttagagaatggtgatgacttttaacaagcatactgccttcaagtgcttttttaacaaaggacattctgcatagccctaaatccattaaaccttgagtcaacacagcacatatttctgcgagcacagggttagggctacggttacagattaacagcatctcaaggcagaagaatttctcttagtacagaacaaaatgaagtctcttacgtctacttctttctacatagacacagtaacagtctgatctctctttcttttcccanatctgacacagatagtggggt

SEQ ID NO: 681004 - DNA, 999 bp, Homo sapiens
gcacagattatcgtgaaaggccccatgaggaaccctgcggagggatttcaatcacatcaagtgtaaaactcagacttcttggaaagaaaacaaagaggctccgggttgacgaatatggtggggtaccagagagaggaactggctacctgttcggactattctgtaggtccatgtacagaacactgtagtcacaaggctgttgacattgcgtgcttccgttcacgaagatgtagtgtctcgtagtatgcgtctacattcgccctgtcaacgattgtttatccatggcagaatggagtctcttcgtatgaatcctccgcaaattttctcgaggtgaaataatattagtccgcagggattcgggacttagacccaggagtggttgactgtgtttgcagatactctcaaggaccccaggaacaggatgacacttcaagtccttgaaacggagaatgcacactttgagcttagtgacaacattcatgcgcggctttgcatgtcagctaatgaccaagaacaagtctacacatagacaaatggatagtcagggacacatcttttggcgatggtaatctactgttctcttgtaaaccaggaaccttgttcacgcagagctgtatgaataagatctaacgagtttatcctgggcttatcggcagacgtaagaatgcccagaatgtacatcttaagcacctacttggtgatattttcacgactgatggccaataaaagaccttattgactttggcacctgaacgcgcacaaagataaatcccaaggactactcgaggaggattcatgggaaagccgagtaccccaaaagtaaccggacgcacgacaaagcgatcgcgtggagaaggtgccgtttcacccagggaccacgttgctccccatagttaacaaggtcggcatcactggacgctggacgccccaagaacaggggggcaagcttacatgttacataaggcagatttagaggcatttattaggtcagacaaacaa

SEQ ID NO: 681005 - DNA, 597 bp, Homo sapiens
gctaaggtatgaaaggtagtatggggggtactagaccagtagggaggattttactttactatggccatatattaaccaccaacacctagacttctagaagtccagggcaccacacattagcagcatattttctaccatactggtgagggcatttcataacccatgtttccatgcaggggggtcgaaccacaaatcctaatggggaaaggtagaaacctggtttagatattggagagttacttagaattaaggaattttagagctggaaggcagttggactcagggcattttagatcatattactagtactttttggggacatactgagaagaaggttaattcccctaataggtaggtacctttggaccaaggttagaccatagattcagatccagtgagatgaaaatatcctaatttcttcaaaggaggggaatgatagccctgtcttttcaggatatcctttaaggttataattttatgaccactaaatagcattaccagatttagcaattttataggatatctacttcaattatatttgagacataaccgctaaaccatggttggttgttaatctgattttggacctgagtccct

SEQ ID NO: 681006 - DNA, 315 bp, Homo sapiens
  misc_feature (150)..(150): n is a, c, g, or t
  misc_feature (177)..(177): n is a, c, g, or t
  misc_feature (210)..(210): n is a, c, g, or t
atcagcggatttgcgtcgtattgggcgcctggatcaccagggctgcttttatctctggtaaagtggatattgttgacatcactgacccccacattgaccacatatacatggtttacatgttccaatatgactccacccatgagatattcnatgacaccgacaggggtgagaacgggnagcttgacatcaatggaaatcccacaccatctncgaggagagacatcctccaacatcatgtggcgagatgttgcgctgagtacgtcgtggagtcactgtgtctcacacatgagaggtgtgctcatggagggggagcaa

SEQ ID NO: 681007 - DNA, 651 bp, Homo sapiens
ccagaaagagggactcatatgtacgaaggtttaggggtgagagatagcttggcatggccaaggaaccaaaggattggtgtaagggaggaggctaaaggaacgtgctgaggtggaagagacaggtggggaccatgccacatgtggaggctccagtaaatatctctggttttatttgagacacattgagaaaccattgacagttttcatgtagggagtgacatgatcacattggatgctatttggagaatagatagaaggaatcaagattagaagcaatgttgggatgatatggtagtagtccaggtgagaagtgaaattgatgaggtagaatgcacagaacttgcgtggatgtctcatgggtttctggttcaagcagtggaattcacagtttaaagcaatggagaaaattggaggaagaagaggtaatttcttcccaatctccaccccttctatagatgagttatacatcggagaccacaggtttttagaagatgtaattctttacaaagagacattcattctagtatttcttgcttgcttgcatagtaggaagcttcgggccctgggacggggttggcaattctcagtctctgacacagtccaagtacttatttttggagacactgaatatgatgaatgattttctgcagt

SEQ ID NO: 681008 - DNA, 1339 bp, Homo sapiens
ctaagagcccgtgcgccgatgcattccgcgtccagacacctacgtacccgttggcgtcgtcgccgccagcatgcccaagagaataggctgaaggggatgctaagtggagaataatggcaaaggtgaatggactgaacctacagcagcaagatccgcggaggttgtctgctgatacctgctcctccatgagccagtagccctaagccataaaagaggcctcgctgccaaggaagggtagagacggtatccctgagggaagaaagggaaaagctgtatgctggaatacggtaggggaataatgcctgcagaaaatgtgagatgctgaaaagagagccaggtacagaaagctgaatggtggtggagatgccaagtgaagtgtgtggatttgtggataagctgtgtacttcgtggtggacgtgtacagtttgaacatacgtattttattatcaatgttttatagaaatatgctagaattgttgttttacttatttattattttttataagaggcatagtggtgtgtaggacagctacagatgaaaagttgtctacttggtgggtgaaagggggggaaaaggggcccttggtggtcctataagtaggaagtgctttccgaaaacgcgggattgcgcggtggcggggagaatagggcgccttgtcctcgttcgtagcttgggggggaggaacttcctgggtgggggcccgcccgggggggcggggggaatttccccgtggaatttgtgccccccacctttgtgctccccttgtgggtcgaaaaacgccttgtgtgccgttgtttttgatgcccgcacggtatgggggtcctggaggggccccgctcttttcgcccctttgcccgttgcttttcacggtatccgagcgtatgcagtcccctttaagggccaggacaatcttggtgggggaaccttggcccccgttaggttctggggtgtccccggtggtttctgcgccacggttgggagttttacccggtggttttcccccgttaaaaattggtgcccgtggttaaaaaaaagcaggagggggcccactttctagaaggtggggggcgtctcaaaaaaaaccggcccagagcatatatcgaccccgcgaagaaagggaggcggcaccgttgaaacaatggttgttaacccagcgtcttctgcgtagttgatgcacccccgccgaaataccgtgggtggaagtcacagagaaagaaatgcgggtcaggggaagagtgaatgagcaccgtccaaacggcagacagggtgagatgtcaatggaccacgccgccgaccacactgcagaggattcaacagaacagcgctgcgtcgacacaa

SEQ ID NO: 681009 - DNA, 867 bp, Homo sapiens
gaaatcatgagaatggcgataggtacttgttgctgtatgtaaatatcatatgcgctccaatcgcatgatgcaactatcgtcgtatcgtggtgctattgggttaatttggtaggcgtttcattagctggatcctggcttctgtgtctggtggatcataatcagctctcgacatcgtactactagcattggtcgtgcatacgatggtcgattacatgagtgtcttgtatagtcgagtacgttcacgaaggacgcagcacttctctactagtccatgaatgtcaggcctctcactcgttgcacgtgagacaacagaccttgctgatacttggcagaagagagctactacttgacgcacacattatacgcgcaaacagcgcccaaagctctgcgcgctccttgagcggggcactgacacagtgcagaccactacgtagctaattattccagtgcatggatttgtcatgtaggtgatcatattcaccctgctttttaaaatcgccatataaccagcaagaggattcgtcacttaagtcaccagttgttctcaccatctgcagcagactagctagttgaagtggcccaacatgaacgcaacgaaagactctctcgttgtctagcgccctcagtctgtctttgacaaaatccatcgttggctactcagagttatgccacgtccaacagcgcacctcactgcacgcggcagactgggcaaccaaacactgatgctgtcatgacagcacctgttctctaggcgagcacacctcactttgctccccaagtcctacactgagagtaactcgtcaatgaggtctcccctgaaacggacgggcacatgaataataagacagctgtcacttcttaagcata

SEQ ID NO: 681010 - DNA, 392 bp, Homo sapiens
tctcaacaccgcatctcaggagtttaaacccgttcctgggtggaaaaatatcgcccaaaatgtgtggatgaagttgctttccaggaagaagtggttgcagtgctgaaaaaatctttagaaggagcagatcttcctaatctacttgtatatacgagaccaccctggaactaggaaaacacatccactcattattggcagcagcatagagaactcttatgggcctgaactctttccgacttacagagttcttgcagttaaagtgcatctgcatgacacgtggacattcaatgtatgttacgagagcaaagtgacaaaactttgtgctcacattaactgctgtcagagaagtcgctacagatgggaagccgtgtccagccattttaagattgcgg

SEQ ID NO: 681011 - DNA, 157 bp, Homo sapiens
agtgggagtgctcagttctctctggtcgcctggatatttatgaaaaggacgccagtggaaagggctccgctgtagaccgaagggataagggttcgatatcagaagggagcgcttatttgtatccctctctccacattaactggaacgatttaaagtg

SEQ ID NO: 681012 - DNA, 215 bp, Homo sapiens
ggggttggggggggggggtttttaaaaaaattttttaccccccgttttcctttttggggttgggttcagtttttaagcggccccaggcccgggtttttttttttggggccaagccccccttttaaggtttttttccggccggttcttttcttgggggggggagggtttttaaagccccttttgttttggcagggaaaacaagattcccaacccca

SEQ ID NO: 681013 - DNA, 91 bp, Homo sapiens
  misc_feature (47)..(47): n is a, c, g, or t
ccttcttttttctgtttgtttttagataaaaattttgatgaaaaaantgaaaaaattctaataaaagaagaaaaatggtaaaaaaaaaaaa

SEQ ID NO: 681014 - DNA, 142 bp, Homo sapiens
cgtctcgatcgcggagaatctcctgggaatgttgcttcttttgattttcctgtcctcctctccttcgttggatctgtttctctgtgaggaaacacttctgcgtgaaatgtttcgcctacggatctgaattctttctccacag

SEQ ID NO: 681015 - DNA, 789 bp, Homo sapiens
caagcaagaattctgtatttgtcaaaactgttaaagaataggggcactcaaggggacattaagatatttccagataagcaaaagctaaaggagtttgttactaatagatctgccctacaagaaatgctaacgggagtcctccaggctgaaataagatgctagatggtaattgaaagccatatgaagaataaagaaaactgatgaaagtaactacatagaggttgaaaggatggaaaaagatattccacaccagaagagagctatatagctgttttattatccaaaaaaaccaggtttaagtccaaaagggatccaagagacagaattatatatatgtaaatataagatattaatctttcagaagatgtagcattataaccacatatgtacctaaccacagaatcctatatattagccaaatgaagactggagagaggatagcagtgtacattatcatttgagactaagtatcacttcatatgattagcacacagagagatacaagagcagaggatgacagtcatgaccactgcacctagcagatatgtacagtacactcacacaaagatacacatctctcaaagtggcccatggaacaagtctcccagatagaccatatgtttgatcacaaaacaagttttatacatttaaaaaagattgaaatcatacagtgtgtcttccctaaccataatggaatgaatctggaaatcaataatagaaggaaaattggaaaatacacagatatgtagaaattaaataacagagtcttgtacaaccaatggcttatag

SEQ ID NO: 681016 - DNA, 1208 bp, Homo sapiens
ggtcctcagaggatgcctggagggtggagtgaatacactattgtctgcagcctaaggcgtgagcgggctggggaagctgcagtaccttctctcgcatacagcactcgtagatcggacggccggcgtcattgcctgtgtggtctctaacgcgggtgtgcctgtgcaagtttccccagagaactgaaaacactcaggggtgggccaggagtgcccctgtccccagaaaaaccctttgcatgccgtgacggtccagagcatgtggatgcaggagatggatgtgctggcgtactgactcatctgaggcagctctcttttctggaacgtgagttccagcggatggtctggagatcccgctggcaggatgacgaggggcaggatgttgtctggagggatcactgtgaccgtggtcagaagcgagggacggggaccgagaccctggcacaatgcaggacagtcgctggcacacgaccacatgggagaaggaggggcatcatcgcgcgtggctcgcatacagtaccacgagacaaggacacagacgaacttgaacgagcagacgaaaaccgaaggcagcatcacaccagtaaacatcggggaaggaaggcaagcagagggagcaacatgcgaggaagagtcctgcgggcagagcagcagccgacaggagtcggagggctcccaacgccccggggatactaccatcgcggagcgcactcgtggccttggttcgaaaggactggagagtattaacgcaacacgaaccaacaggggggccaagaaagccttgaccttcataaggcctggacacaacaaaaccatgggggcacgcacggattactacacacgagcagggaagaagattccaaagcaacagcagctcaagggtttcgcaaccacgggggcgacgggggcacaagcaaggatgacatggcggggaaaagatcaaggaacaacacttggtagaacccaaaggggaccaacaagaggttctgacggggagccacgattgaaaacgcccgtcaggaaggggacccaagagacggaaaacggggaaaggcgaagaaaaagtactggaggctaaggaaagagccagcaagagtaacaagcacacaaaacttgtacagagcaacagagggatcagcaagagaacacggggatgagtgagcagaacctatacaaaaaacgcacaacagatggggaactgagaagaaccc

SEQ ID NO: 681017 - DNA, 521 bp, Homo sapiens
cctctgaagaaaatcatggaagcatgtgcaggcggtttttcctccagtgttggttacccaggacggcaatactactttaatagttcaggcagctctggatatcaggattattatccgcatgcaggccagatcactatgaagaagcacccaggaactatgacacgtacacagcaggactgagtgaagaagaacagctcgagagagcattacaagccagcctctgggaccgaggtaggagtcttgcgcccttcagttattttaaagcatacctcatgtggtaaggtagtctgaaaaagagctatttgttgctaattaaattttaaacagttcagaaataggatatgtagatgtaatatgtgtgcagattgtgattactaagtatggggtgtgatgccttattcccagcaacctaagcttattgagtgccagactgatgtatgtattgattaagatagagatctaattttattcctgctgtactagaagcttttgaattaaagaaaagaaacttataattctta

SEQ ID NO: 681018 - DNA, 806 bp, Homo sapiens
  misc_feature (420)..(420): n is a, c, g, or t
  misc_feature (490)..(490): n is a, c, g, or t
  misc_feature (672)..(672): n is a, c, g, or t
gtgaaggcttgcaggacgtactggatagatgttattcgactccgtcaatgtactttgaactacctgactcattccagcactacagaagtgtgttttactcattatgaaggaacagcacatcagctgcgtcctttacgtggacaataggtactttactttgacggcgacaagtcttcacctggcgttacagatgggagtcatattcccacaataagcagcccttagtaatccgagagatgtgattcctgcaggcaggacctataggcaagtgaagatttgaatgaaagtacagttgcatttggaagcccagacataggatgggtcagtgggcatgggtctattcctattctcaaaccatgcgcaggggcaacactgtgtcgcatgtctgaagacaagtggaccacacgttacgtgtgacancgtacacataacatgtgcagcacatgccgggagtgatcagtcagacattttaattcgaaccacgcatgtntgggtagctgcttgctcacggatttcattttgcaggcatgtgtctgagcttgtatacctgctcaaggacattgacatctcatgagtgtagctcatccggtgttaccctggtttgaatgaacctaacctcattcgatgtgtcttcagtgttggcttgatgtaactgatccatctagaacacangaagggtacttggctgaggattgtatatacaaccaccaactgatgttgcaattggtaacccgcttgactgctttgatagagaagcccaggccttagcctcaataggtgcaagacttaggagaacacactgaagc

SEQ ID NO: 681019 - DNA, 244 bp, Homo sapiens
tccacttcattttaacatgtttcttgcacaatctgaacttaatcctgtcgcttaggctggagtgcagtcctgtgatttcagctcactctagcctctgctttacaggctcggatgattctcccacctcagccacccaagtagctaacaccacaggtgtgcaccactaatgcccagctaatttttgtatttctgtagagacgggtattcatcatgttggccaggctcagaagtgcaggaaacaaga

SEQ ID NO: 681020 - DNA, 224 bp, Homo sapiens
  misc_feature (59)..(59): n is a, c, g, or t
  misc_feature (118)..(118): n is a, c, g, or t
ctcatgagagtgctaagataacgttgcctggcgatgtgctcgcagcacacacgataccncactgccgcgcatgattgtctcagaccgcgagcatacaggtcactcatgtgactcgtanatcctcctgtcgcgagtcctgttgccactgccaccctgctctacactgacacagagccaccatacgcgatcgtacagtcctatcctattcctctcagtacatcatc

SEQ ID NO: 681021 - DNA, 867 bp, Homo sapiens
ggaatttatataggccgcttcatagccccacaatttgtcccactttttttggtggttgtacccctgggatgggttattaatctcccccccaatatttttttgaaggggccctctcccccatagattctctgcgcaaagacaattcctgggccccaaatatatgatccgaatccttgggcttctgggtatgaatccctcagaaggggtggcttaagacaacagatgtcttgggttctccaaaccggactttgtaggatgagtccacaccacccaagtggggcacacaaccacgcagtctctctgtaagtttggaacctcgtctgaggtcgacggcttatcagatgctgaggaacgttcacgtcccgtccttggggatcgacctgtggctccactgagggaatttgtgaggcccgcctctggaggtatcaccccttatgggagggtggagggccccgtatccccctttcaagatggggcacgctccaacggggtcctttctgcacaccctgatgtcacgagcgtggcacaagaccacgggcaagagggacatgctcccggccccaggaggtatgaggcccctgctgaacatcagagggcaaacatggagggctgaggagtctccacctaccacgccgcgctgtcgtggaaaatcggcgagggagcactttaatctattggggaatgcccttggagcagcagcaaactcccatgcccaaaccatcccaaaggcccccaccccccggattttggatggcaaaatggttttgagacccagacaacccaaaattttggggcatttaaccaccagaaccagggtaaacctttggggaacaagaggcccaattaaaagttcagagttcattggga

SEQ ID NO: 681022 - DNA, 787 bp, Homo sapiens
  misc_feature (41)..(41): n is a, c, g, or t
  misc_feature (44)..(44): n is a, c, g, or t
  misc_feature (55)..(55): n is a, c, g, or t
  misc_feature (134)..(134): n is a, c, g, or t
  misc_feature (379)..(379): n is a, c, g, or t
  misc_feature (382)..(382): n is a, c, g, or t
  misc_feature (387)..(387): n is a, c, g, or t
  misc_feature (397)..(397): n is a, c, g, or t
  misc_feature (401)..(401): n is a, c, g, or t
  misc_feature (404)..(404): n is a, c, g, or t
  misc_feature (417)..(418): n is a, c, g, or t
  misc_feature (484)..(484): n is a, c, g, or t
  misc_feature (511)..(511): n is a, c, g, or t
  misc_feature (548)..(548): n is a, c, g, or t
  misc_feature (566)..(566): n is a, c, g, or t
  misc_feature (578)..(578): n is a, c, g, or t
  misc_feature (602)..(602): n is a, c, g, or t
  misc_feature (611)..(611): n is a, c, g, or t
  misc_feature (613)..(613): n is a, c, g, or t
  misc_feature (623)..(623): n is a, c, g, or t
  misc_feature (629)..(629): n is a, c, g, or t
  misc_feature (633)..(633): n is a, c, g, or t
  misc_feature (638)..(639): n is a, c, g, or t
  misc_feature (769)..(769): n is a, c, g, or t
gggcggcgttgcggccgcaggtttgactcccgtgctggtgnggnccagcagccanaaagctcccgctgccattgctccctgtactcccgccgtcactgccgctgtccaatcccctcccccggggcttgcgcggnggctcccacacccctcggcccgtgtacgcgctctgcacctgcctgcccgaaaacatgttgcagacaccagagagcagggggctcccggtcccgcaggccgaggggggagaaggatggcggccatgatggtgagacccgggccccgacctgcctcgcaggagcgccccaaggaggagcttggcgccgggagggaggagggggctgcggagcccgcctacacccgggaaaggcgccgagggccttgncgncaaanccttggaaangcgnagngcctaccgccgcnngaatcggacggtggcggagttggtgcagttcctcctggtgaaagacaagaagaagagtcccatcanacgctcggagatggtgaaatacgttantggagacttgaagattctgtcccggacatcatcgcangggccgcagagcatctgnggtatgtctggntttgagctgaaacagtttgaccgnaagcaccananttacatcctnatcaanaaantaaannctctggaggaggaggaggaggaggatctggaggagatggcccagattgggtctgtaatgatgatctgggcttatctatatgagaggtaatagcgccaggaggccaggtctgggagatgctgcgtcggttngggggtgcaacctctaaa

SEQ ID NO: 681023 - DNA, 1665 bp, Homo sapiens
  misc_feature (341)..(341): n is a, c, g, or t
  misc_feature (406)..(406): n is a, c, g, or t
  misc_feature (548)..(548): n is a, c, g, or t
  misc_feature (1427)..(1427): n is a, c, g, or t
gtagggaacagcaagcgccttacgagaggcggcaacatagggagcctagagaagtaaagtggttgaatccagttgttcgtaacgaaagcattgggtgtgagtgtggaaagctaccctgctctagtggttctgcaattagtccagagacagtacttggcagaagacgctgtcggtgacccagtgactccaatggagacccacaaagtcgcaaatctggatgggtctgtcgaaggcgtatcgatggtgctaggtgcagaggtggaggtcttcagagctgtgaatgtataggcaagcaagtggatggcagagagttgactcatatctgagaacacacaatgtcnaagggctgaaatgtcactgtgggagaggcatggtggtctaggggcattaagagacacttgacgcntgggatcgtgaaaccctgtgcgccactggtgccagtgtggcactcatttactccgtgtagcacgtgaatagcagtgcctgggtgctcccctatggaatcgaatataggatacattggtccagctaagaaactggaagtctgnagaggcgtccaacggtgtcgcagtgctgcagtggacactcacacggaaatagaggtcataccgtataggcatatccgcgtacttggattcccttggttggtttgtggcgttttgtcaccgtaccagaagacatcggtcaaacaaacgtccagggattgagccgaatacgtaagcactatctctcagtagacttccaaagagattgcaaaagcaacgaggttcgtctggctcggaagatattccccggggaggatctggacaccgtgaccttgaactggcgctacaccactctaattgtaactcgccggaacgtaacggggattggcatggaactgaacatttcgcgacctttttggataacgaacatgctctgggtgccaaaccctacacaatttgtggaaattacccaaagaaaggaagggcgacttgtggggaacgagagcgggactcacctcagggtcaccaaagacggtggtccgtttggcgccacaagacttccgtagagtatcttaagtcgaccttgcattccccgactgggaagatgtggtgtcgttctaccggaattactgagcaacacgagagaagcgttcacacaccacaattggccctgggcaacagagtgaacagcccccccaacgggtttttgtgggaagattccggggagggtaaaagcccttctcaatggcggagtccatctcaccagtgagtctggcaaacggggcccccagttcatgatttcactggggcgaaaaaacaaccgcgccagacatggcgcccgcaaaccgacagacaacccggggggcgcgccaacagaggtatagaaccgcaagcgactgagctgtgggaatataggcaacgcgcaaccacagcgcgcccaanagaaacaccgcggtcaaacggggtcgcgacactctaaagactacgcggcaacacgctcaagaaggggggcaacaggggaaggggcaacagagcaaacaaaaaaaaagcaccaaggcgcacatatgaggtgcgtagaacgacacggtcgagaagtgcgccgaggcacagggggccaccaccccagccattggccaacggcacaagtcaggcacccaacaagaccactactgaagcagac

SEQ ID NO: 681024 - DNA, 758 bp, Homo sapiens
ggatgagccaggtgtgctggtgcgtgcctctaaatcccagctgctcgttagactgaggcgggagaatgcttgagcccagtatgggagggttgcagtgagccaagatcatgcatcgcactccagcctgggcaacaagagtgagactctgtctcaaaaaaaacaaaaaaaggaaaaaaaaaaagaaatgtagaatcccggctgagcgcaggggctcaggcttgtaatcccagcactgtggggggctgaggtgggcggatcacctgaggtcaggagttcaagactagcctgacaacatagtaaacacggactctacaaaaaatacaaaaagtaggcgtggtggatgtgcaccggtagtcccagatactcaggaggctgaggtgggaggatgctcgagcccaagagatggaggctgcagtgagccaagactgtgccatgccctccagcctggatgacagagcaagaccctgtctcaaaacaacatacataattcggacgaaagaaagaaatggcagaatcccagtccccaccccggacctccgtgagtcagtctgcattagaataagctcctcaggcaattctcactgtgtgtgcgcacgttggagaatccgtggcaagcccaccattgcctcgtggcctaattagcaggccagggttggcatcatgaacggacggcctttctctctatttcccattttgtgttacaggcctggggggtaggagatgaagtttttggcggaatgtctggaggaatttgtcca

SEQ ID NO: 681025 - DNA, 404 bp, Homo sapiens
  misc_feature (1)..(1): n is a, c, g, or t
  misc_feature (20)..(22): n is a, c, g, or t
  misc_feature (40)..(40): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (103)..(103): n is a, c, g, or t
naaaaaaaattttgttaatnnnaaaaaaaaaaaaaaaaanggaacgccttttttaaaaaaaggggcgccccccccaccaaaaaaatacnttnanaaaaaaaanccacacatactatgacctaatcccaaaaaccaaacagcgcttaaactgtaaaatcaaccaccccaaaaaaaacagaacaaaaaccgccactaacctatcaaccataaaaaaacccattcaaccaaccacaaaacaacaaacaacctaaaactccataaacagcaccccacaaaaaaaaaaaacttaatccccccccccaaaaaaaaaaaacaacagataacaacacaattacctccccaaaaacaaaccattttaaaaaaaacacatacccaaaatcatactccccaatataaaacaccca

SEQ ID NO: 681026 - DNA, 912 bp, Homo sapiens
atgacgctgttccccaaccgttttcctccgagcccctagcaaccccgcgtcctaatactagctacctgactcctacccctcacgtgtcatggcaagccatcgccacttatccagtgaaccactatcacgaagatagaaactctacctcgtctatactaatctccctacaaactctcgcttaacttataagcagttcacagccacagaactaaatcatatttcatatactctcttcgaaagcacacttatccccaccttgccctatcatcacccgatgagggcaactccaggccatgcatacgcctgatactgcaggcacatagtttccttattctatcggccttagtaggctcccttcccctgactcatcgcacgtgtgcatttacacgtcatcaacagcctaacgtgattcgctatagcgattctactactcactctctactgcccatgaactatcggactcctgtagcctagtaacgttcatgagtggactaggcttacacggatgagcgttctatagtactagatacctcttttcacggactccagttcattgactttccttaacagccccaatgttcgtaaaggcccgcatcggtggtgtcagtatgtactatgccggcagtactcttagaaactaggccggctatggatataatagcgccttcgaccactcatgtctcaaactccctgtactatcatcacgtatgcctacccccgttccttggttctgatcgcctgatgaggctataacttattgacgaagtttccatcttgaccttacggaccaaaccttgaaccctaagaattcgctcaattgcggtaactctttcaactccagccattatttggccttcgtaagtcaccagggcagtactccatttccaaaaccaccctgaaagggtttcaacc

SEQ ID NO: 681027 - DNA, 119 bp, Homo sapiens
  misc_feature (3)..(3): n is a, c, g, or t
ctntaactacgaggactatgtacttcacctacctcgagatcaatcccctatcacgtgaccaaagatggagtctatgtccttgactaggcggccaaggtggacgccactgccgagtacat

SEQ ID NO: 681028 - DNA, 378 bp, Homo sapiens
gcgtaaggctaccagcagtgttggcagagtggaaggcctgcagaggtggtcggtgaggcagcgcggagacgaggtaggcacaccccagccatcacgcaccaacctatcctcctcaggcaccagcatctcacagccccgtccaccgcctcatccaccgagtactccaccatcagcaatccatgtgtctctctcagtgcatgatctgcaacccccggagccccatgacccctaatattccagacccaaatcctgagcacgacgcacgatcccgggactccgggcaccgccgtggtggaccagcagcattccgtggagttcgactccccagactcaggactgccctcctctcgccattcctccgtggcctccggcatccag

SEQ ID NO: 681029 - DNA, 499 bp, Homo sapiens
gtccggggtcggccagagagagtccagagcttctgtgaacctggagctttcctaataaagtgtgctccctgggcatgtgagagtatctacagaatgcgtggtgtggcctcggactcaggtgtgtgcatcctccctgtggacagatggatgaagcggaaactccagacagacggaagcgcggtctatgacgaaggcctagccaggacacagtcgcacgtggagatgtcagcacatgcgggggtatgggagaggctcacgggctcttcgctcattacttcctatgacctgtaagcccccgtctgcttcgagacttcctgcctttgcttcgagttgtcccgcctttccagaccgaaccaatgttcatcctacatgtgttgattgatgtctcatgtctcccttatcatgtggcgcgtgccaccgagcgctcatcagaatctcaggaacgtcacgggtgctcaccggttgcctctcccaccttctggggcacatccgtactggg

SEQ ID NO: 681030 - DNA, 205 bp, Homo sapiens
  misc_feature (13)..(13): n is a, c, g, or t
  misc_feature (16)..(16): n is a, c, g, or t
  misc_feature (22)..(22): n is a, c, g, or t
  misc_feature (33)..(33): n is a, c, g, or t
  misc_feature (37)..(38): n is a, c, g, or t
  misc_feature (40)..(40): n is a, c, g, or t
  misc_feature (60)..(60): n is a, c, g, or t
  misc_feature (88)..(88): n is a, c, g, or t
cacccccccaacntgnactggnacacagacccnaacnncnacacccatcaccaccaccantacggtgaccccaacccctacacccacnggcacacagaccccaacatcgacacccatacaccaccaccagctacgtgtgaccccaagcaccacacacccactggacacacagaacccctaaccctgagcacccatagaccaccac

SEQ ID NO: 681031 - DNA, 154 bp, Homo sapiens
tctagaggatccctcagacagctggaccccccgtacacctaagactttgagtattcccggaagctgcccgggtgtcatgggaataacgccgccagatcgctgttcgcagtcgtatactaggtcggaactactgaccggtatctagatcgtcttg

SEQ ID NO: 681032 - DNA, 405 bp, Homo sapiens
  misc_feature (392)..(392): n is a, c, g, or t
atggtcgtctctagcaggatcccctcttctccgaaaggcaacatgaggagagggctctgcagcctgagacggggcctgaggactgtgcggaccgagagctacgcagacgcacttcagtgtgcttatagctcttcctgctggaggaggaggtggtggtgtacttgatggtggaactgccgcctccaagcagagctgaggccacccccaatggctcttgccactgctggaactgaagccacctccaacagccaagaccactgccataggagtagctgcttcctccacccaggcctagagccactgccgacaccactggcaccgccatagccactggagacggtggactgcaccacagagatgttgcctttcggagaagaggggatgctgctagngtcgacctacaag

SEQ ID NO: 681033 - DNA, 625 bp, Homo sapiens
  misc_feature (4)..(4): n is a, c, g, or t
  misc_feature (248)..(249): n is a, c, g, or t
  misc_feature (269)..(269): n is a, c, g, or t
  misc_feature (272)..(272): n is a, c, g, or t
  misc_feature (274)..(276): n is a, c, g, or t
  misc_feature (278)..(278): n is a, c, g, or t
  misc_feature (281)..(281): n is a, c, g, or t
  misc_feature (287)..(288): n is a, c, g, or t
  misc_feature (297)..(297): n is a, c, g, or t
  misc_feature (308)..(308): n is a, c, g, or t
  misc_feature (320)..(320): n is a, c, g, or t
  misc_feature (323)..(323): n is a, c, g, or t
  misc_feature (325)..(327): n is a, c, g, or t
  misc_feature (330)..(330): n is a, c, g, or t
  misc_feature (336)..(336): n is a, c, g, or t
  misc_feature (346)..(346): n is a, c, g, or t
  misc_feature (351)..(352): n is a, c, g, or t
  misc_feature (358)..(358): n is a, c, g, or t
  misc_feature (366)..(367): n is a, c, g, or t
  misc_feature (378)..(378): n is a, c, g, or t
  misc_feature (383)..(383): n is a, c, g, or t
  misc_feature (389)..(390): n is a, c, g, or t
  misc_feature (392)..(392): n is a, c, g, or t
  misc_feature (469)..(469): n is a, c, g, or t
  misc_feature (477)..(477): n is a, c, g, or t
  misc_feature (512)..(513): n is a, c, g, or t
  misc_feature (517)..(517): n is a, c, g, or t
  misc_feature (532)..(532): n is a, c, g, or t
  misc_feature (549)..(550): n is a, c, g, or t
  misc_feature (616)..(616): n is a, c, g, or t
gtgnccccacagagtcttccaggccagcaggagcagcaggccccgattcccggctccctgtggcccagggtgcgtgagtctgggactcctggccctccaggcccctcctctcccagagaccctgatgcagcttgtgagctggaccctggagcccagctgccccctggatgggtcccaggacggctgaagccagcgggctcagggccgtgtgcgtcatggcctcggggtcctcccatctgctcctgggnnatggggggggttggtgggtnagngnnngnggngggcgnngaggggggnggggtgggggngttagtgatggnggngnnnggnggtggngtgggggggnggtgnngtgggngtggaggnnggggggggtcnggggnggggcnngngggggggggggggggggcgtgtgtgtgggggggggtgggagaggggggttggtggttgggggggtgggtgggggggngggggggngggggggggtggtgtttgggggggggggggggtgnngtgnggcgggtggtggggngtggggttggggcgtgnnggtggggcggggtggtggggtggcggtggtgtgggggggtgggggggtggggggggaggggcccgnaagtggccc

SEQ ID NO: 681034 - DNA, 419 bp, Homo sapiens
atggtcgtctctagcaggatcccctcttctccgaaaggcaacatgaggagagggctctgcagcctgagacggggcctgaggactgtgcggaccgagagctacgcagacgcacttcagtgtgcttatagctcttcctgctggaggaggaggtggtggtgtacttgatggtggaactgccgcctccaagcagagctgaggccacccccaatggctcttgccactgctggaactgaagccacctccaacagccaagaccactgccataggagtagctgcttcctccacccaggcctagagccactgccgacaccactggcaccgccatagccactggagacggtggactgcaccacagagatgttgacttgtccaacgccttcgccattcagcctgcactcctcaccctccagcagccttgc

SEQ ID NO: 681035 - DNA, 194 bp, Homo sapiens
tccgcaggtagagctgcccctctctgtcactgacttccattcttatttctaagtagtcttcactcataccacttctgcgattctgtttttcactattgtagtttatgaaatagggactacttttcagccgggttcggtggctcacgcctgtaatcccagcactttgggatgccaaggcaggcggatcacgaggt

SEQ ID NO: 681036 - DNA, 554 bp, Homo sapiens
  misc_feature (10)..(10): n is a, c, g, or t
  misc_feature (64)..(64): n is a, c, g, or t
  misc_feature (108)..(108): n is a, c, g, or t
  misc_feature (110)..(110): n is a, c, g, or t
  misc_feature (129)..(129): n is a, c, g, or t
  misc_feature (173)..(173): n is a, c, g, or t
  misc_feature (370)..(370): n is a, c, g, or t
  misc_feature (453)..(453): n is a, c, g, or t
  misc_feature (460)..(460): n is a, c, g, or t
  misc_feature (479)..(479): n is a, c, g, or t
  misc_feature (538)..(538): n is a, c, g, or t
acaaaaaganccctttcaattcaaatacattcctcatttacagattaaacataaaacatcaccnacagtcgccaagcatatcgcacatcacagacaagcatttgtctntntccgtaagtcttcccagantttccaactttatacttttttttgtaaaaagatttacctttctnatgcaaaaaaaataaaaatgcagccggtgtttggctattaaaaactaaaacaaaaaaacctttaaaaatattattcctctgccttgcagaaagaaggaagagggtatagaatcagggagtcccacagggacttgaaatttttaccagattcacgtccagattcaagcgggaccctaaccctgacccctgtaaaaccngggacaaagggcccagcgcgtcccacccccccgattccccaaggggtccctgcgctgcaggaagaggcactagaataggagcnggatgcngggaatggacaggaaaccncaggattctctcctaaagtccctgcccagccaccctgtcgctaaggtaatcactcagcnctacctctccaccagc

SEQ ID NO: 681037 - DNA, 994 bp, Homo sapiens
ggggagcgggatggagcgggcgcgcgggccggaggcgaggccgactgcgcctgaggaggaggagtgaggcgggggcggccatggctgctgtggtggtggcggcctgcgggtggcgcgggaccggcggtcctgcatggtggccggtctctaccggggctgtgcgcggtgcgcagccggcccctgggcctggggctcgtgtaccccggcagcatgagcagtctacccaagtggagccacggggatcggggcaggcccgaaggggggcagcctgacgggaagcgggggtcaggggccgaggggcgaagctccagggccaacgccctttctacgaaccggtaacgagaacaaggatccagctgctggggcaagggtcagaaccccaggcgtggctttaggcaagtcgcggccctggaagaaaagcggccggttggaatttcgggaacagcaagcccatgttgggggggcattacccagggcgaagggtgaatttgttcacttcacgactggtggtggacaacaggaaagactagtatggcattgggggaaaaccaggtctggtgaacacagaaggggattacacgattaaagggggaccgagagatgttctacaaagtcacagagttttataaaactatttggaaggatgggtaaacagaaagagaaagttggcgagatcgaatgttagagacaaggatttggggcaagcaatcaatttgtggcaagcaaaacaggaatcacatgtcctacaacgcatgtgattaacattggggcagaaacgttgggatgtggatctgggaacggggggctacagtcctggtaccaaaaagtgcatatggtgggcttggcaaggaaaggtggaaggggataaggagtttaatggaagagagaaagggacagggttactggagcttcaaagtatagatggagttttttaagtttcgaaggacagagaggtgaagattgaggcaggcagagtgattatatatcaatgacc

SEQ ID NO: 681038 - DNA, 434 bp, Homo sapiens
ctctctaccatgcatcgctggaacggtaaagagtggaacaggctcatcactatgtagaatgataacgaaagggagaaagtggagtgtagggaggggtgtgctacatatttattaaaccaccagtatctcatgttgaactctgcagagtctcaccatcaatgggatcgcccaagtcattcatgaagaatctgctcccatgatccagacacctctcaccaagccccaacttcaacactggcaattataatttaacatgagatttggtaagggtatactttctttcttttccttttctttttttttctttctttctttcgttctctttctttcttcttcttcttttttttttttcccgtaggggggaattggtcccattgggttgctttgaaaagtcctttgggggatttccgcgtttttgacgcaccttttatttg

SEQ ID NO: 681039 - DNA, 435 bp, Homo sapiens
gttttcataattttagacggtgtgagatcacaagattaacacaaattatttttgccgcctaaactttcaaaatcgaaacagcccgtgacaaaaaattcgacggattgattgccagtttgatgccggctaagattcaagttttttttatcaagctgccctgaaaaatagcagtttgttccgaccaagtgttctaaatccgaacatatttttatttcattattttttataatttcgtaaaaacttttattttgtttaacttaaccgggaacgcttacgtggcacgttcattgcttaatagtattccaggctacaaagctcaaaatatcaaggaggaaatttttatgaataacgatggatcaggaacagttcgcgaggaagcttcggcaatcggcgacagaatcgaaggtaatgtaaaagacgcttacgggtcgacgc

SEQ ID NO: 681040 - DNA, 1136 bp, Homo sapiens
ctgtcggctgtaattaaatttggttctgatttgtcacaacttgtgtgtttcgctctctgctatgtcccctgtgtaagctacggttgcatgttccccttctttgtgtgcatttctcgctgtgtcctctgtttacattcacgctctaattccatcacccatttttggtgcgtttatctatatgtgttcttcacctcatcgcgttgttcccttgggtttatatgtttgttaatgactcttactctattgaatggtctctctcgttccccatttgctcgagtgtcctccctctagtggtgttcttcccaatgctctccctcttttcctaccccgcaatggtccctcaggtgcctcaagtgttaatggggccccatggccgataatccggtccggtggtgctgtatcgtctatcctttccaatccgttgcttggtggggtcgctgtgttacatcgtgttgtggtcatcccttcgcgctaaggtgtgtttgttgggaatcatctcatgtgtgtatacggacagtacttctatactcggctgcgtcactcgtgaacacacattggtgtctttgacgctttttgtacaagtctccttgctcctccgtacggttggtgaatctatggctctcaagatgctcttgtgtcttgtctctctattctactcctggctctcctatctcctaattccatatgtggatatgatatgtgatgtgaattgctttgcgaacttgtgagtgcaccacttgaaagccagactggtcaatgatgggtgacagcttcctattcctcgtgtgtacttcttgtccagttccttttagaaaaacaatggatgccgcatgaggacctcccaacctctggctatggggtcaagaaacagccagcaagagttaggggccttagggcactgggctgttgttccattgaagccgactctggtcctggccctgacttgcttctctagctctcaaggcctctccagtattgcacctgtccccaccatccactcagcctgtcctgcagcaaacagctcacaccctcgcacctgtccatgttcccaaagctactgcagcacctcaaggcctgttgatataccgccctacctgatgtcaaaacaagggtgtttggggggcggctgtgtgttg

SEQ ID NO: 681041 - DNA, 224 bp, Homo sapiens
  misc_feature (191)..(191): n is a, c, g, or t
tccttcatcatacctaccttccttccttctttctttctttctttctttctccttccttcctttctttctctctttctttctttttcttttgagacagagtctggtctgtggcccagcgtggagtgcagtggtgcgatctcggctcactgcaacctccggctcccaggttcaagtcattctcctgcctcagncccaatgagcggctgggattacaagcgcacgca

SEQ ID NO: 681042 - DNA, 325 bp, Homo sapiens
  misc_feature (15)..(15): n is a, c, g, or t
ggccagaactttatnctaagagacttgaagctgggtgtgacggtgcacgcctctggtcccagctactcgggaggccaagacagaaggatcaccttgaggccaggagtttaaggccagcctgggcaacatagcaaaacctagtccctaaaattaaaaaaaaaaaaaaaaaaaaaaaaagggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtat

SEQ ID NO: 681043 - DNA, 266 bp, Homo sapiens
  misc_feature (33)..(33): n is a, c, g, or t
ttcaacggagatattgtcagtacaagatctagnaatatgcatataacttgacagcttgtatagaaaacactctaaagttccagaactgtaaagatattgtctgtgagtataacagaactgatgttgcaggcgaaagcctgataaaaatccaatcggaaagtgccccatattgtgaaagcgctgcgttccaatgaggccctattgagctgtgaatgtgctatcaaccagcttacgctttctacgtataccccaatgtgtctacagaa

SEQ ID NO: 681044 - DNA, 523 bp, Homo sapiens
  misc_feature (414)..(414): n is a, c, g, or t
taataatgctgagtaaaagcacaccaataaaaaatttgttttttaagacggagtctcactctgtaacccaggctggaatgcagtggcgtaatctcagctcactcactgcaacctccacctcccaggttcaagcgactctcctgcctcagcttcctgagtagctgtgaccacaggcacacaacaccatgcatggctaattttggtatttttagtacagatggggttcaacatgttggccaggctggtctcgaactcctgacctcaggtgaactgcctgccttggcctcccaaagtgctggaattacaggcgtgtgttaccatgctctgccaaaaaaaaatttttttttttggagccggtgtctggtccttgtggcccaggctgaagtgcattggctcattctcagctcactgcancctccgccgagaaggctctcttttggtcttggcccctagctacggatatggcacccacggggcaggatacttactgcgtattgaagagaaatcccagtttcctatccgg

SEQ ID NO: 681045 - DNA, 377 bp, Homo sapiens
tagatccccatacagagtatcgctttaaaacatatacgttgaccctgaacaacacaggattaaactgtaaggtctactttatatgtggatttttttcaataaatatattgaaatattttttggaggtttgccaacaatttgaaaacacttgcggacaaaccaaaattaagaaaaagagttgtcatgaatgcataagacatatgtagcctatcttatgatttactacgataaaatatacataaatctattaataaaaagttgagatttatcaaaacttatgcacacaaactcttacagaccgtatatggtaccattcacattgagagaaatgtaaacaaacgtaaagatgcacacggtactctgtatgggggatctcg

SEQ ID NO: 681046 - DNA, 756 bp, Homo sapiens
aatgaagcatcttgaagcgggtggcagctccaaagcattggatgctggataataatttgatccggtgtgtttgataacaacgtccatccagcgttccccacaagtggagagagtgtctccccctcatcattcacctgaggaaccagacgttgagtatgccctgagaggacgactgaaggtagggaagagtttgcatgcatgcggcttcattaataactcgatggcaatggtccggagacgtgaatataacgcgtaccccgtgctgccctccactggagtgtcatcagcatttgacgaaggacgggagagaattttccgtctgactctagtgacaccaagggttcgctttgctgtaacaatcgtattacacctgagagaggccaaagtacaagtttgtgcaaaggtgaggacacagatctatatgtggcgccacgaagagagggaatacccttcatctggtgacctcatgatgtccgcgaaccatggcggtaccccgatgcccctcattcaaggtgaatgataccattcagattgattaagagactggcaagattactgatttcatcaagttcgacactggtaaacctgtgtctggtgacgtggcggtgctaaacctaggaagacatcgctgtgatcaccaacagacagcaggcaccctggatctttgacgtgcttcacgtgcaagatgccatggcaacagttttgccactcgactttccaacattcggttattgggcaagggcaatcaaaccatgt

SEQ ID NO: 681047 - DNA, 228 bp, Homo sapiens
taaattaacctttttttagaaaaaaaacaatgtatattatgttcctgtgtgttgaatttaaaaaaaaaaatactttactgggatattcatggtaatatataaagggtttgggtggaaatggaactttagttaggaaaaagctgggcatcagctttcatctggtggtaagtggacaccaaggtgtcataatattctttatttggggaaattagtggtattttataaaaa

SEQ ID NO: 681048 - DNA, 132 bp, Homo sapiens
atgtcttacgtattggcacactgaggaaataacacacgatctgttgtcattgtttaacaggaagatcacatttgcaaaagagattctgaggaggccttaggacacaacttgcttataggttttttttttttt

SEQ ID NO: 681049 - DNA, 1032 bp, Homo sapiens
cagagcggctgctatcggtgcggcgaaagaggggcactggtccaaagagtttccgactagcatcgtctcaggccgcgctggccagactcgaccgcagacaactactaactgcagcaactactggacgcagctgcagtacagccattacaccatgcagctatggggcattcattgctacttacaacaacgcgctacggagcgctcgatgcctactacaagcgctgccgtgctgcccggatccgtatgcagacagctgcgcagcctgccagcctgcgctccgctgtactaacttacgcagagcagaccctgtcccagctgccacaagctccagcaatacagccatggcccagctcaccatcacctccacactctctcgatccctacgatagacacctgcttgccgacctcaggcagctgcctgccacagcctgcctgctgccgcacgcacgccgctgctgctgctcacctgcacgcttccacttcatattacgggcgcggatcggacccccctgcgtcgcgctacagccccagctccccacctgtcggacgacgggctaccggttacgcggcctgcagacgtgcagattgtcccagagccttcagcagcccagcgcgacaacttctcctgtacgaccttggcccggctatgagccgggacccagctcatgccgcatcgggccgcggcactcagccttcttcaacgctgcgcggctggcactgtgtgtgggctgaccctccgcgctgcgcgcatgcgcactgcagaacataccccgctattagacgggtacgccccattctcgcgagcacgacactcacacacctgcgccgctgcaacatccatacaggacacccaatgcaccctcacgttaacccctttgcataacgattctaaacattcctattccatatccatttccccttacatctccctttcacaacatatcactagtacctcatgaccttcacataactactttaccacccactccacgtcaacattcccacacagcccacagcgatcacacactccta

SEQ ID NO: 681050 - DNA, 287 bp, Homo sapiens
caggtacggatcatctaagcgcatgacagtaagcatgacctagctttaaaaggacggcccacgtgccatcccagacgagtcatgaggccccaatggggttttactccgtttctcgcagtctggaggggcagccatgaaaactccaagcgccccttggcataagaaggagatgccccagactctccacgtccagaaactggtgggatctggctcatggggaggggcagagcggcagtgataggacttcaggtgagcccaaggggctgggggaacagacccagctactg

SEQ ID NO: 681051 - DNA, 265 bp, Homo sapiens
cctggtagctcaggtctgcctcataaaagccctctttgaaaataaggaagtacaggctgaatatccctaatccaacaatcccaatctaaaacttttccagtgtcaacagtatgctctaagaagcattttggattttcggattaggaatgttcagctgttaagtataatacaaatattccctaatctgaaaaaatctgaaatctgaaacacttctggtcccgagcattcatttctttcttttttctttcatcattttttttttttt

SEQ ID NO: 681052 - DNA, 991 bp, Homo sapiens
gaggaacgagatggtggtgctctggaggctgagtgcccgttggctgtgccctaggatgccgatgctctgttgactatgcgaactccaggtggctcacgtaccgtgctcatgatctcagcgatttcttcagagaccgagctatcccatagagtggtgatggacgatgcgagcatatactaactggtacatcgatgcctatcattgcatggctctcataggggtgcatgcatttccagctggtacatacgtcggtagagcggatcagtacaaagctcgttggtatgcatccctgtgtggtactgctttatgctcgcggacgtagcttatacttgtgaaagttaccgcttggcttgcatgcggaatgtgatctaaattcctcatggtcatgacttgctccctgtcaactcgttcagtaggtgcaaactggagtgtctctctgagcactatacgatatgtttaggcatgaactactgttactaatggggagatgctctgttgcagaaacccgctgcgcatagggcagaggtactttgtgagcactattcacgggttatataccgtttcagcctgagtgcatgttgggtactaatccaagttatcaacgttatgtggagcttatcatgtgacatgctgattgccatggctgtggatagtctctgatccttgtatggacttctataacttatggaggaagtatgattgtaatgacctctattgccttctgcttggtccatgccagttaaggctcacaaattaaggaacgaaattaacaggattaagttccattggtgggacagccttcgttctctttaattcacgaagaattattttccagcaattttacatctttgacggaacaaaggtttggagagggacattatatctaaagtttgtgaagacatgagttgctatattctgggtgagttcaatgggggttgggataccaggttctttataagcactcacgagggtatatattaagcatgatgta

SEQ ID NO: 681053 - DNA, 572 bp, Homo sapiens
  misc_feature (21)..(21): n is a, c, g, or t
  misc_feature (36)..(36): n is a, c, g, or t
caacttgttcggccaagacangcttctattgttccngaagattggcaggccacgccttacggcagccaattgggaagaccccgttctggggagtagaccccctctgctgtgtgtgggagggctacccttggggcttctcagagcctggggtgtggggaccccggccctgcagggtgggatgcagggaagtctttggccgaggcgggcagccagggccccaagtatgaaatctggacgaatcccctgcatgcctcccagggagagagagtggcagctcggaagaggtggggactggcccagcacgtccgcttgccagtgcctgtggggccacgggactgccgggagggagagatgcagcccaggacagtgccagcccagcctccagcaccggcctccccgagggctcggagccagagtcctcctgctgccccaggaccccggaggacggggtggacagtgccagcccctctgcccagataggggctgagcggaaagctggagggagcctgggtgaggaccccggcctatgcatagatggagcagggctgggcagcccagagcaaggcggccgc

SEQ ID NO: 681054 - DNA, 380 bp, Homo sapiens
  misc_feature (85)..(85): n is a, c, g, or t
tggagtctggggacttgagcatgagctcaatcaacgtcgatgggattcggatgtcctcccagaatcttctggcgaagatctgtgntcaccaccatttttccgttgtggagcgagtggactcctgcgactccatgtacagtcggtccatccagggtcaccatgtctgcctcctggtgatagaagggtgagaactctgtctcagctcgacgggaagtgcagtgtactccacggtactgagcaacttgttagaagagatgaaggtgacgctggccacgtgtcgagagatgtctgcgagacccgcaccacccccgccggagcacgctccccagggaccgcaggccctgacgtctctcgccctctcctcagtcgtgttgtacttg

SEQ ID NO: 681055 - DNA, 181 bp, Homo sapiens
ttttttttcccccccccccccccccgggttttggaaaagggttccccccccatcttggtttccccaaaaattttggggggggaacccttttttagggggtttttggacccccctaacccccttttttttttccccccggggcccccccccccggggttgggtcccttttttttttggggga

SEQ ID NO: 681056 - DNA, 1105 bp, Homo sapiens
agcagaggggtttattataggaacattctcaaaccgcaagcggaaaagagtgttccgatacaggtgtggatgtggggagtggagattccaccttcggagttacacagcatttcagaggggccctccgtgccgtggcacgtttctttcttcttcccgttattcaccttaagaccctgtgagaacaccccaccctctgtgtctagggagaagaacccaaaagagaaagccttccctcccgtgtgtggccgtggcttcccatcaagggaacgagtccgtgtgttttatagaagacaagaaacaaggtcgtggtcactttcagaacaggattcccaaccccccaccccaaatttcaatgtggtcgaccggtcgtgagacagccagcttctcaatgtgggctgtgcacaagcgccttcttttcaggtgtgagttcaaaggagaacacgagcggggacaccaggggagcccatagggtgacggatgtgctcacgtgggccgtgggtgctcacaccagacatctcacagtgcctcttcaacattccggtgacaccagaaacttccaggggggtccattacattcccttgagatcgtgaaagtggaaatccgagacacagagggaccgttaagacacgcaggagaacccaggccgagcggcgcggcacagcaccgtgatgggggtgactctacatctccaggctaacatctctaggggcagctctagtaacacaaggaccctctgactggggagcactgggccgggacttgccgaggttaatcactttcacaggaacctttcgaaaacacttgcttgacagacagcagacaagaaccgcgggaactcccaagtgaatcgcattacccaggcaagcgtaagagcgacgtgaccttcaagatcaaccagaaacgcgggaacagacacctactccaggaggcacgaaaattaacaaaacttacagagggcccgtcaggcacacaccaagcgcccatgggacacataagctataaagcggaggggttaaaccccaggagtgcgcctacaatgaggcctacgaaaaccccagaaacattccgtcacacccggggtactaggcgccccaggggcacaag

SEQ ID NO: 681057 - DNA, 802 bp, Homo sapiens
ttccccaacagtgtgaagttagactaactttacacagcacattaaaaaaaaaaaaaaaaaaaaaaaaaaaaaaaaaaaaaaaaaaaaaaaaaaaaaaaaaaaaaaaaaaaaaaaaaaaaaaaaaaaacaaaaaagaggggggcgcgcgcggccagatatttctctcctctcttgtggggtagcgcgctgtgcactagcagcaccattgttttattgtaaaaagaggcgtggcctcgtactgtgggctgtctttattattatatagtagctgacggcgctgggtcgcgcgttttatatataacaaagaactcagcacatgcggcggcgggcgagagacaacgcggcgcgccgcgctgtggtgtgtgcgtcttcttttgtgagagacagcggcgctctctctctttctctttgtctgtgcggggagagagagagagacagcatagtgtgtgtgtgagagagacaatattctctctcatctctgtgtgtaatgtagtttatatatatatcagcagcactctctctgcagcgtgtcgatgcgctatgctgctatcattatcacaatatctctcatcatatcagagcagcagagacatgatgatgatgagagcagcagagcagagacgcagacacacatactcacacagcatgtcatgaatattctacgtagtcgtagttgtcggtcgcgcggcgagagacgagagaagaagtataatatagtagtcgtagatcgcagcacgctactcgtcgtctagaataatcatgatcttacttactgactcttatccttatagtacatgtagaa

SEQ ID NO: 681058 - DNA, 112 bp, Homo sapiens
aggaggaggtactgggagggcttgaaggacaagtaaaagttcaagtaaccaagaaaggggtatctacggggcaaaggtaacagcaattgtcccttcaaaccgggtaccgagc

SEQ ID NO: 681059 - DNA, 394 bp, Homo sapiens
acttagaggatccctcgaatcgacggttctccgttttgattcaataatgaaagaaggtatgtttctctatttaaaaaattagcagtagaaaacaaaacaacaaataaaagtgtcctagctccaatattataatcaatcgaatattacttggcttcagtccataagactgtctcctgcttactctgacctagcacatcccctctcactcaggccacaccagccagactggccttcttgctgttactgcactagaccaagcctgtttgtgtacctctgcctacagtgttttccacagaccttggcattaattacaaatgtttgagaagaaaggaaacagcagtaaaaggctggatcagggtcatgcaaaggcaaagactcaatataaaagcaaagc

SEQ ID NO: 681060 - DNA, 191 bp, Homo sapiens
cgcctagatggctgatgtcgccgagcgttgactattctcatacaaaccacaaagacattggaacatctatccctatttatttcgtgtgcattgtacctgtagctcctagtgcacagttcagagacctccttattcgagccgagctgggccagtccaggcaaccttctaggtaacgaccacatctacgatcg

SEQ ID NO: 681061 - DNA, 1110 bp, Homo sapiens
  misc_feature (1)..(1): n is a, c, g, or t
ncgacgggggagaggaaaacttacgggctaggtagcgaggcctgggttgttcgccgctgctgtcagcgcgtctgaggaggcagcgccgggggcccagccgcccagcccgcgcacgccccagcggccggccggagcccagaccccgcggcgaagacccctgcgcggcagcctgcgttccccttcccccgccggctgcaggagctgccgccgccggcattgagcagagggacggcgggtcccgggagagcccccttgcctcgcgcgcggcttgggaggttcggaaggtggccccggcagccggaggcccctgccatgcgcctgccgccctggccttggccctttcggcccgcggcgcctcccttttccccttccgccttccttcggcgctggctttggcccggggggggcacctggcgggaagccccgtggctggcccgtgccccaattgtggcgccccgtgggcggccctcgctgcgccggcgcttttggcaccgggcggcgctttggctggccagcgccggggcgggggtccccagtgtggaagggccccttcacggggagagcggggcccaccggcgtgggccccccctggtggacgcccctttgcggcccggttggaaccttccaagccgcccgacgctgaggtacaccgccaggacatatcagcgtaggctccagtcagggttaccccatttccgcacgtggcacataggcgaaattttgcacgcgagagaccccaaggaagttccttccttgggtaccttacggggacaagcttcccccagtttcgggccacatgatctaacccctacgccggagtagcgggaaccttagccgaaattctttccggtgccccccgaagagctcaaagcggtctttccacgcaagggtgcttttttcacgagacacgaaaaccggtggcgggtgacttctgtcccagccccaaactcgtctgtgcccgaggggaacaacaccacgacacggggtctcaccaacgctgctccctgctcctgctggagacacgctgagacagggcgtgcctctctcttttgatgcaaccccccaagagacgtgatgaactttcaggcgcaccacgccacgaggaccccg

SEQ ID NO: 681062 - DNA, 426 bp, Homo sapiens
tcgcgtcatattgtttgtcactgtttgattattttttcgcgatgggtctcaagtgactgtacagcacgtgtctttgttgtgacatgatattccttcttatgtctcccttctttgttgttttcctctggttcttcccgggtgtcctcatctgtctgaccgtaagtcttctactctggagtcgcaggtccatcttgtaacaatgtgtcatttctgtgaattcacccaggcgtggataagaaaagttctgaagatgatgaaataattaacacattttttaattcatttaatttttcagaagctaattttttaactagtgtcttagttgaaatttctttttgtgcaaaatcagaaactagtacttgattattttgagcaagttgacttaaagctgaggcaaaagctaatttgcgaacttttttgtttaat

SEQ ID NO: 681063 - DNA, 152 bp, Homo sapiens
acgcgtcgacatagcatttaatcatcaatactgccattggccaagcctccgattaacaccataagacttggatcttactccgcaaattgacggccgctgaacgcagcaaattagttagcatccacaaccgagcaccataacccttagaagaa

SEQ ID NO: 681064 - DNA, 130 bp, Homo sapiens
ccactcttctctggttcccaagatggggaaaaaggggggaccagtacaaggggaaagccgggattttggagtcaacttagggagtacgttggagctgcaagctccacgcgaccaaggattggacgccagg

SEQ ID NO: 681065 - DNA, 376 bp, Homo sapiens
atagggcggaataaaccacacgctcattgtgatgctcctggccgcggtgcagatatccagccatgagaatcattatgccttctaccatatagcccagcatctctcctcagcgtatgatagtattgcacttacttaccccttgaaagtcgggtgtgggttagtgactagcgtcggccagtgaaatgagacaagtggaagttttaagagccaatacatgactcacatacttttttcccctctggtagttgctctgtcagtctttatcctgtaataaggattacaaaaagcagagcacccagccagtccttaatggatctgtaataataataaaaaataaaaccttgttgtataagctactgatatatgggattgcttg

SEQ ID NO: 681066 - DNA, 526 bp, Homo sapiens
ctttttgctatctacagggaactatcatacagtggctccgtggtgtaattaacacacctgcctggtatcatatcaaccatagtactacacctcaagctatcacatccgaagacactatactttgtacgcctggttcacgattttctatcgcagagagctacccccatcaacctcattagcagagcacatgcatgagcacaccgcactgaatgtgcagagatgaatgcaactctcagtcaacacttggacctcacgttttccaccatattctgacatagatgtgatggatgcgttgatatgactgttcaacgagactgtcagagtagccaggtgacagactatcacactgtgtttgccacagcatcacaatggcactatctctgaactctacggcattctgtgtactcaatctagactgtcaataacccacacttggtgtgaccggaccctcacagttacctgcatgtgacaagtttagtgtcagcaacattaaccccttctttactgggtggcttatagccgcgcc

SEQ ID NO: 681067 - DNA, 125 bp, Homo sapiens
cggtacatctttgaagcacggtgaaccacaagtataagatacttctactccctccttgtgcgaccgatcatgcaccccttaccatctcattaaaacctaaccacggtaagccacggtcaacccac

SEQ ID NO: 681068 - DNA, 109 bp, Homo sapiens
cgatccctttaatgaaagtaaacttggtttcagaaaccgacgccctgatttattttgactttaactaacatccagatgggtcatcaccctctcattcaaatgaatacac

SEQ ID NO: 681069 - DNA, 886 bp, Homo sapiens
  misc_feature (873)..(873): n is a, c, g, or t
ggccaaccggagtacgtaatcccagcatttgtgaggccaagtgggtggattgcttgggcccaggagttcaagaccagcctggcagcatggtgagactccgcctctgcaaaaaaaatttaaaaatgtggcagatatggtggcatgtgcctgtggtcccagctactttgggatgctgaggtgggatgatcactgtgggcccgggaggttgagatgtgcagtgagctgtgacttgtgccactgcaactccagcctgggcaacagagttgagaccctgtctcacaaaagaaagatgacacagtaattggttggagtaatgtgtaaaggtccagtgaatgtttatcatggacagttatacgtgataaagccagttaagttttgggtttcatagttcaaaaatacttaagggctcaaatggaaagctttatgtgtcagttgatactaaaagtgcagtgttaaggagaattaaaaaacatgcacattttcagtttcataacaggtttctcttggttaatttctaaaataattgatacttgtggaggtcataaccttttagatttaaaccttattagtgcaatatgtactatgttctatggctgaagtttatcagtacgtgtttgaccagtcagaagactggttcggaaagttggtgataaggcagacttatgcattaataaggactaaactggatatttgtatatgggggactttataaatctttagctaataaatactctaggagtagaaaacaattttggtgtgatattccacttggtggaagggggcgggaaaaacggaaacaaatgtggaaaaactgtgtgggaaaaataaaaaaaacacgtgggggtaataatacacataagggcggggacaaangtatgtattattt

SEQ ID NO: 681070 - DNA, 123 bp, Homo sapiens
ggatttgctggtgcagtacaactaggcttaataaggagctcgaattcgagaggaggatagcttgagcccaggagttcaagaccagcctgggcaaagtggcaagacccacccgttcctacaaaa

SEQ ID NO: 681071 - DNA, 224 bp, Homo sapiens
cctgctgctgcagtcgtctgagtatcccgttacgctgaactattgtgcagtctgtattcatcatgggttatgtgttcctgcgctgactacaattaatgacatgcatatcagctactacaccaagctgttataaggatgaaatgcagttagccagtgctcagtatagggcagttgctttactactacgtaggttgggtggtgtatgtgagaatctgtatactgcc

SEQ ID NO: 681072 - DNA, 773 bp, Homo sapiens
catacaattacatggaaattaaacagcctcctcctgaagtgacttttgggtaaacaacgaaattaaggcagaaattaagaaattctttgaaactaatgagaacaaagatacaacataccagaatctctgggatacagctaaagcagtgttaagaggaaagtttacaggactaaacacccacatataaaaagttagaaatgtctcagttgaacaacctagcattgcaattaaaaaaaaaaaaaaactagaaaagattaaagcaaaaaaccccaaagctagcagaaaaacaattagtcacaaattagagctgagctgagaggaaattaagatgtgaaaaacctataaaaaagtatctgagtcccagttttttctttggaaacactcaatataagactagatagactggctaactgggcactatataaagaaaaaaagagagaagatcccaataaacttgatcagaattgacaaaagggtcttaccatcaacccaaaagaaacttcaaaaaactctcagagtacttattgaacacctctagtgctttgcacagagacctagaaaacgcttagaattaaataagatactttccctggaaacgtaacaacctccagaagattgacccagaaagaaattgagtcccctgaagagacccataattgagtcctgtgaatggagtctgtaataagggggctataagccaaaaaaaacataaaaaacacaaccaaaaaaaatcttttttgggcggtctcgccctccaaaagttctcaaagact

SEQ ID NO: 681073 - DNA, 543 bp, Homo sapiens
taagggtggagaggcatttttattcttgaaaaatttatataaaaaatttttatgacacttgattccaaattgtttgtaccaattggcttgacataataaacataaacataggggcaatttaaacattggcagtagtttatgtaagtcaattcaggggcagggcctggggaactattttaagagaaacctggggtaaaaaaaatttttaggaagcagccctgtaacaatgtacatttgtagatcaggggctaaaaatccactttgaatgaatcccaagaagcaaagggtgtacaacatccatcacacatttgttttaaaaacaggatgtttttaaaatgataatctttttacaggtaaacgttcccgttttaataactattgagacccccttgggatgagctccagatgccctggtgactttcaccaagcacccctgggccattgtttaagggatccatcttaatcctggggctttaagaacatttttttttgtttaattggggttaaggccccattttcaattcttcataatttgcatggcgt

SEQ ID NO: 681074 - DNA, 213 bp, Homo sapiens
tcacgtgtgtcacgtgcgtaagcacatggtgcccacaccaagacatgccttcacctgcgagactgcggaaagtccttcaagcgcagcatgtccctcaagggtgcactcactgcagcactcagggagagaagccgtacagacgtgagaactgcaatgagcgcttccagtacaagtaccagcggcggtcacacatgagcatcctcataggcccca

SEQ ID NO: 681075 - DNA, 789 bp, Homo sapiens
gctcttggtgaatggggttcttccttggggatttaccggatggtccggtgcttccaatataggatgatcccgtgcgactgttcctcacccccgcttcgacctcacactttcgggatgtctgcgattcctgactagaggagagcgacgagcgtgctgatcctgaccccgttgtgagctgggcaagaagtaggccaagatcatgtaattattctcgagttcaaaggcaacggaaaaataatgctcgactgtgggatccacctctggtctagaaggcatggatgcatcattccttatattgatttaattggacccagcttgagattgatctccatattaattagtcatttccatttggatcactgtgggagctctgcccgtggttttctacagaagacaagtttcaaaggaaggaacatttatgactcatgtcgcacaaaagctatttatcgatggcttctttctgattatgtcaaagtctagtaaccatatcagcagacgacatgctgtataccgagacacggatttggaagaacagcatgggcaacaattgaaactatcaactttcatggagattaaggaagtgggcgggcaatcacgttttggtgttaccaatgcaggtcacgtttctaagagcccccatgttcatgcattgcgatcgcaggcgtgaagcttttttgtacactgttgatttctcaagaccagcagatacggcacttaatggagtgaattcctatattaagctgagttcttatcatgatcttcttatgggacatatctgaaaacgtgaac

SEQ ID NO: 681076 - DNA, 311 bp, Homo sapiens
gtggtcgaagcccatgctgacgtgccctctgagcagggccaggcccattagagccagctcagccatctcgccccaggcctccttgcaagtagccaccttccttgacgatagccgcgccggcgctcaaagccataggcctagtagacccacttgcgcaccgagtcgcgcagctgtgcctgtccgtcggtgaagctcgatgtccatctcacacccccagggtcatctgagcgacgatgttgcgttgcccttcgttgcttccgccgtagatcgtcgtcttgcgcatgttgacgtaggtcgaggcccgtgttggt

SEQ ID NO: 681077 - DNA, 537 bp, Homo sapiens
  misc_feature (164)..(164): n is a, c, g, or t
  misc_feature (328)..(328): n is a, c, g, or t
  misc_feature (352)..(352): n is a, c, g, or t
agaaatatgaaatcataatcctttggattatttagtccaataacatggagtattttcttctgggtctgtgaatttcatgaaggtatcagccggtcattaaaatttggaaagttcttagtccaggggtatgattgaagtatcaggagctgtatccaagagtcctngtagagacctttccataaatctccttgaagaaaaagcagtttgggacggtaggtgatggtaagtagttggaggaagaatcaaagcaacggtcggccagtcttcctgaaatacagaaatgacatcacagctgctatgtggattaaggagaggaagaagtcctatnctggtagaagcagagacttggacngtcaacgatgtggagctttcctcgccagtggggaggctaggaacagagcaaacatagagcccgctatgcttggtagtaattggggggataaccagatttggtcctgatggctgaaacttcccattaattgtccaagaatacggtgccggggggtaagagttcgggaagcaagacaagtagaggtt

SEQ ID NO: 681078 - DNA, 678 bp, Homo sapiens
gagatatttattactgttgtgtgggctttacagtcttaacatcgcaacccatgatgacttaccccttggtccgaaagcacgtcattctacattatcacccactggatgctgatacctcattggctaagcaagcaggtccgcctgttaggaatcatctcaaacagcccaagctacaccgtactttgcttctaagagcctaatactatccttaatcccagacagtggcctacccaccctcagacattcaggatattagagggtgtggccatggggtatgtcatattaaaggtcctgattgatgctgacaacatgttactgtcaacctgggtcctttcgaccttaaagctacacaaaatgtagagtttatatgctactcgagtattctgtctcttctaagctagcaagaaacgaaatgaccatttgtgggcgagatctgatttcttcacaatgggtcaacttttaaggtgtatggtgtgaaatcccttttgacctggcacgactgggtggttcgatatgattcaagacccatcaacgtgtgagctcttgaatccattttgctctgtacagacacgaagacgttcacattatgagtaggttgaggcactaccgcggctatggatgttaaaagaaggcttggtttgcaatcctaaaatctcgaacaccttgcgtttgaaaaag

SEQ ID NO: 681079 - DNA, 466 bp, Homo sapiens
  misc_feature (164)..(164): n is a, c, g, or t
  misc_feature (257)..(257): n is a, c, g, or t
  misc_feature (281)..(281): n is a, c, g, or t
agaaatatgaaatcataatcctttggattatttagtccaataacatggagtattttcttctgggtctgtgaatttcatgaaggtatcagccggtcattaaaatttggaaagttcttagtccaggggtatgattgaagtatcaggagctgtatccaagagtcctngtagagacctttccataaatctcccagtcttcctgaaatacagaaatgacatcacagctgctatgtggattaaggagaggaagaagtcctatnctggtagaagcagagacttggacngtcaacgatgtggagctttcctcgccagtggggaggctaggaacagagcaaacatagagcccgctatgcttggtagtaattggggggataaccagatttggtcctgatggctgaaacttcccattaattgtccaagaatacggtgccggggggtaagagttcgggaagcaagacaagtagaggtt

SEQ ID NO: 681080 - DNA, 999 bp, Homo sapiens
aggagagaagatacgcagccctccgtatggaggtgtctaaaaggtgtccactctggggaagagccacagtcctcgtaccagtgccaagcaagcttctatctgcatctgctctcaatcctgcatctgcaccgatgagtcctccggctgcagagctcctctgccagctatggaggtggtttcgggggtggctcttgctcagttgagaggagggcgtggttgtcgtctcccttgttcccagatccgcggttttgtcgtcgtgcggcgtggactcagacgtgtgtcggctattggcaggcggtgtgaccgtgttggttctattgcgctggaaggcgtgcctgcgtacctggcgtttgggatggtgggctatcgaggtggcctttggaggtcggctctggagttgcgccattcgcaggtggtctttgggtggtgggtttagctggtggctttggtccgacttgggggtgcgttgctgaatgagtagggcactccttcagcttggcaaactgacgacatggatcagcacgattggcacagatacactgtcaaaagaagcgacttgaggtttgcctatcgctgggaagaacggtgcagcaggcccattggtatggaggtgacaggcgcgttgaccctggaggggtgaaggatcctgatgatctgggtaccctgacagcagatccccagtctaggtgacctgagcggggaacataaaaggtcgctcaacttactagtatcgtaggaagaggcttccggctactatgattcttgaccgtcaagcaattgaatagggaacggggtcatgcctcgggagattctgacgagtgccagggcgtggttggtggacgaaggagctgggctcgatgtttgataatggagcctggctctggtgcgcagagcgtggggtggccatgattaatggtctttggccgggtgggggttgggggagtccggttaagggtgaccggggtgaggtgtgaggtgattagagtacttttttgaacc

SEQ ID NO: 681081 - DNA, 281 bp, Homo sapiens
tcatacagagttcaccgatacgtgtacaccaatgttcatagcgcgcattcttcacaatagctaaaaggtagaagcaacccaactgtccatcaatggataaatgggtaaacaaaaataattccaattctaggtatatacccacacgaagtaaaagcaggtacttcaacagatctgagtacaccaacattcataggagaattctccacaacagccaaaacgcagaagccactcaagtgtccatctaccgataaatggataaacaaaatgtagcgtctagacac

SEQ ID NO: 681082 - DNA, 793 bp, Homo sapiens
  misc_feature (10)..(10): n is a, c, g, or t
  misc_feature (67)..(68): n is a, c, g, or t
  misc_feature (70)..(70): n is a, c, g, or t
  misc_feature (88)..(88): n is a, c, g, or t
  misc_feature (116)..(116): n is a, c, g, or t
  misc_feature (216)..(216): n is a, c, g, or t
  misc_feature (223)..(223): n is a, c, g, or t
  misc_feature (232)..(232): n is a, c, g, or t
  misc_feature (277)..(277): n is a, c, g, or t
  misc_feature (340)..(340): n is a, c, g, or t
  misc_feature (344)..(344): n is a, c, g, or t
  misc_feature (375)..(375): n is a, c, g, or t
  misc_feature (389)..(389): n is a, c, g, or t
  misc_feature (437)..(437): n is a, c, g, or t
  misc_feature (455)..(455): n is a, c, g, or t
  misc_feature (477)..(477): n is a, c, g, or t
  misc_feature (527)..(528): n is a, c, g, or t
  misc_feature (530)..(531): n is a, c, g, or t
  misc_feature (535)..(535): n is a, c, g, or t
  misc_feature (546)..(546): n is a, c, g, or t
  misc_feature (549)..(549): n is a, c, g, or t
  misc_feature (557)..(557): n is a, c, g, or t
  misc_feature (571)..(571): n is a, c, g, or t
  misc_feature (575)..(575): n is a, c, g, or t
  misc_feature (586)..(586): n is a, c, g, or t
  misc_feature (639)..(639): n is a, c, g, or t
  misc_feature (649)..(649): n is a, c, g, or t
  misc_feature (705)..(705): n is a, c, g, or t
  misc_feature (723)..(723): n is a, c, g, or t
  misc_feature (781)..(781): n is a, c, g, or t
aagggggggnagtactatccccgggggcggaaagaaaggctaagaaaccactaaaagaataatcatnngnaattctcacacacaattnaccactctgaaaaaatatccaaagaaanaaaaacaactcaaatcagtaaaggatgtttttgtaattatagtgtcccctttgtacggtttaaaacaaaagtaatcaaattcctttgggccagggcggcnaaaatcnacagtttgngtcaaaaaataaaataaaataaaataaaataggcccatttttccnagaaaaagaatctttcctttcactgaaaagccacatgattcaagggcggggcaagtacggggnggangtgtccatataatccattataaatgtttccngctttaggtgtgcnggccattgtacaaggggaaattttaaaattctaaagcaatgtaaagtnttgcagtaaacaaatctnagtaggtatagtggtaatgtcnttctgtctatgttaaactgtacatcaacccacctttgcgttttaaatagnngnntttnacatatatgtnagnacatttgnttttatcttagtgntagnaaaattttagntttaaaaaacagtattttctctttaatgtattctcttaacatgtcaggtagcngttgtatagntaaccaacacgtgttaactctgtttccaatttcaaatcaagtccattttcctatgngccctagtagtcaaaagntcttaaaaaaagtaaaagtttgtttataatcactgtttaagtatatatttccccagtngtgtttccgtgt

SEQ ID NO: 681083 - DNA, 247 bp, Homo sapiens
aggtacagtggtcacagagcaagggggtgcttcatgaggggagcctgtgcttgccctcctggagaagctctggcaggtgctggaaggaggaggggcagagactagtgctcgatacccctcttggcatcactggcaggacagacaggtcctgagggcaggactggcctcccctctgcgcctggcaaccagcacaggtcacttaggtgagccgagggtgtagacccttcaggctgtcagtgcagaccag

SEQ ID NO: 681084 - DNA, 470 bp, Homo sapiens
  misc_feature (218)..(218): n is a, c, g, or t
  misc_feature (232)..(232): n is a, c, g, or t
  misc_feature (235)..(235): n is a, c, g, or t
  misc_feature (408)..(408): n is a, c, g, or t
gattcggcaccagggtgatcacgaacaaatggcgtacgttaagaaggatcaggctcccgcgcaggagacgcagcgtgtgcttgtgaagatgacgagccgcaacgcaaaggcggtggagaatgtgatgacggagctgctcctgcacgctcgcaacgagaaggtggtgctgcgtggccctgtgcgcctcccagacccagcacgctgaaagtcaccacccngcaaaacgccgtgngtnaacggcaccaacacgtgggacacttacgagctgaagatctacaagcgtcttgtagagctccgcgccgccgacggagcttgtgaagaagattacatccttcccctattgacgctggcgtggacgtccgccatcacaatcccacacgaccagttagcctgccccgcatgtggganaaggtgggaggccgcgccgcaactgtctcatgccatcttggggggaagagtttattttcccc

SEQ ID NO: 681085 - DNA, 373 bp, Homo sapiens
cgggtgcgcggtcacacctgtatcccagcactacgggagtcgcggtggagcagatacagcccaggagatcaagactatcctggccaacatggtgaacccccatctctactaaaaatacaaaaattaggccgggcacaggggttcatgcctgtatccccagcactttgggaggccgaaggcaagtggatcacctgaggtcaggagttcaagaccagcctgaccaacatggagaaaccccatctctactaaaactaaatacaaaattagccaggcatggtgcagcatgtctgtaatcccaggcactcaggaggctggggtaggagaatcacttgaacccgggaggcagatcgggccattgtaacacggtctctca

SEQ ID NO: 681086 - DNA, 799 bp, Homo sapiens
attctgacatcacggctgggagcacagcatggccgtggcgcaacgagtgctcttcagcaaggtagccgatggctggaccctgcccgaaaactttcattctccgaatggctgttccacatggcaagaggaccatggaggagctcgatcttcgggacattgatgacgacgtaccttcgtctgcattgagctgcacgaggcacacccttattcatgctggagaggtgtttcacatgcgtactaggccatgacgacggtgtgactgtagtctggacgcaccaatggcaaagcatgtggtcgtgctgctcatgttccattgcgtggggagccatggactcctaagtgtcacgcatcgtagggtcttagagactatgctagagcgtgatccgaagaccatgcccctgcaccatatgatgaccatggctcaccgtccgttagacctgtccaccgtagcaccgtgcacgactgagtctcccctggcggaaggaggggatgacgaggatgacacgtctatgtgcttacgcgtattaggttcgaggagagacatgaaaaatcactgaatgaaagtttgaatttgtggccggacctgcccctctcaggccttctaggcatgtgtctgagggaagtctcctgagtgttagaagtgttattggcaaagcaatccaataaaataagctacctattatgccagaaaacaaaaaaaaacccgggggccaaaacgggggggcgccaaaagggtttcaatgcccggcccagcggtccgcattttttaaaaggggaaaacgggcccaaaggcgaaaca

SEQ ID NO: 681087 - DNA, 119 bp, Homo sapiens
gaaataaagcgcaagacagctggctgtgtgcagagcggatcgacaggagatttccgggagaagaagctctatgccaatatgtttgagaggctggctgagagaggagaacaaggccaacg

SEQ ID NO: 681088 - DNA, 321 bp, Homo sapiens
tttttttttacataagtgaatattttgataccagcaactttcacaggggtttttggctgtctttggattgatttgtaatgcgcccaccctgtgttcagacagagattctgtgacacctgctgccactcacttgccgtggagcccgtccgtggcagtgtcccgagtgctgcataggaaaggcctgggtgctgagcagggcacacgccttggaggacggtgtggacacggtcacgtgtgcactcctccacatcccattgacactgggtcctacagactctcctgctgctcacttctctcaatcttcacaccttccgcgtcgac

SEQ ID NO: 681089 - DNA, 324 bp, Homo sapiens
  misc_feature (78)..(78): n is a, c, g, or t
  misc_feature (154)..(154): n is a, c, g, or t
  misc_feature (162)..(162): n is a, c, g, or t
  misc_feature (200)..(200): n is a, c, g, or t
  misc_feature (241)..(241): n is a, c, g, or t
  misc_feature (253)..(253): n is a, c, g, or t
  misc_feature (297)..(297): n is a, c, g, or t
  misc_feature (319)..(319): n is a, c, g, or t
cggcacgaggcttcaagagaattagatgccaagaccaagactagagccgaggtgcggcggcggtggcggaaagcttgnccgcagaaaggcactgggcgggccggcatggcagcatccgctctccgctctggcgaggaggaggtgttgcccatgnccccgggncccacaagttactactacatgctgcccatgaaggtgcnggcgctgggtctcaaagtggcactgaccgtcaagctggccnatgacgacctgnacatcatggactccctatagctgcccaccggagacccacagtancttgacaagagctggcgcactncccgg

SEQ ID NO: 681090 - DNA, 379 bp, Homo sapiens
  misc_feature (354)..(354): n is a, c, g, or t
  misc_feature (373)..(373): n is a, c, g, or t
tcggcgtggtcttgaactcctgggctcaagtgatcctactgcgttggcctcccaaagtgctgggattacaggtgtaagccatcacacccagcctcaatgctcttttaacaagctccacattaccaacttgtcaaaactcatgctactcatcctgaataaacataatgactaaagcaggatacactgaatgctcccaactggtatacctgaacatttctattcctataaattaagttgtatgtttacatgagttgtattttttcctcaaacctactgacacaagttgtacttactgtaactggttgactgaaacactttttaaaccgatacaatggaatggcaaaaagggttgcntctaaaaattaaatttttnttttct

SEQ ID NO: 681091 - DNA, 365 bp, Homo sapiens
atacctgttgctaattgctaactggattccctgtggtcagataacatattttgtctgatccagacccctttgaatgtgttccaggccttcgtcttgtgcctttagcgtgtggactgtgtggacaggagaacctgcagagtcgtctgccttggtctttttgcttatctgttttccagagacagctctcctcctctggccccgtgtacctaccacctccttcagccctctctgagccggcagaggagcaccgagtatgactcgctccaccgtgacttctctccaggctgtgtgtttgggatttataagataggttaagtctggaaagttttttggatcctttttttaaaaaacataaaacacaaaaa

SEQ ID NO: 681092 - DNA, 159 bp, Homo sapiens
cagccccgcaagacggggactatgggcataaactgtggtttgctccacagatttcagagcattgaccgtagtagtacccccgagtcgtgtatctggtaaagtggttgggtttagacctccgggaattgcatctgtttttaacgcctcatgcgggggctg

SEQ ID NO: 681093 - DNA, 630 bp, Homo sapiens
aaatggtgcccagttttgattgcttaaaaatgtttgcatgatgacccaaccttaaaaatgtgacacaccactggtgaaatgatgaatgtggttcactggtgtgaatgatgaatgcagaatggccccatgggctgaagctgggaagtgatggagaaaaaatgtgctggtgcccctgctcctgagggagggagatggatgaatgtgagcaggctgctggctgctgagcccaatgtgccaatggaccccttcgctcacctgcccaagagtacctttgtgtttggatgaatttaagcgcaagtactccaatgatgtgacacactctctgtggcactgccatatatctgggagcactttgataaggacggcttggttccctgtggtactcagagtatctgctctccctgtaaggaactcatctcagacccttcatgacgcttgcaatctccatccacttggacatgtctccagccgactgggacaggctgagcgaaggactggcttccgcccggtgtattcctttttgggaaccaacaataggcagtccacttctggagtcctggtcttctgaggcaggagcttgccttccggtgagtccagtggctggtggctcgcgtctcccttgcggcactg

SEQ ID NO: 681094 - DNA, 240 bp, Homo sapiens
gtcgaccggcacgcagcaggttgctgcgctgaaagatcatgatccatgaagtcaccgatgcggcaaccagggtcagcattaccaactgcactacaacgctggcattgctgaccaggctccacatggaggaatggtcgacgacgttagcttccacgctttatctcctgctctgagtgtgtacccgcgctgctctcgtcggcaaaggccgtacgcagagcgtctggaatggcgcggggtttg

SEQ ID NO: 681095 - DNA, 643 bp, Homo sapiens
gctttctggtgttagatcgagctaccctctaaaagcagtttagagtggtaaaaaaaaaaaaaacacaccaaacgctcgcagccacaaaagggatgaaatttcttctgggacatcctccggcttctcccgttactggatcgtctggctccctagagtccttcgtgaagctttttattcctaagaggagaaaatcagtcaccggcgaaatcgtgctgattacaggagctggggcatggaattggggagactgactggcctatgaatttggctaaacttaaaagcaagctgggttcctctggggatataaataagcattggactgggaggaaacagctggccaaattggcaaggggactgggcgtgccaagggttcataccttggtgggtagactggcagcaaccgagaagatatttacaggctctggcaaaggaagggtggaagggcagaaatttgggaagatgttagtatttataggtaacataatggctggggtggtagctctatacattcagaattgggttgggctacacaagaatcctcagaatttggaaaagaactttgtgacagttaagtggtactgtggcaccattttcgtggacctacaagagggcatttcttccgggcaatgaccgaagaaattac

SEQ ID NO: 681096 - DNA, 114 bp, Homo sapiens
tttggggttttcggtttttgggcccgggaaaacaaaggaaaggggttccctccccccttcctttttttttcctccgggggtgggcaaaaagtcccccattaatgggcggggcca

SEQ ID NO: 681097 - DNA, 553 bp, Homo sapiens
gcacgagcaaaaacagtggccaatgcagtcgaagtttccaaagaaagtcaaaaggaactaacacgctctgttgaaaggaaggaaagcccagaaattagagattatgaaagagcatacgatccgaaagccctgaaaacagacgtaacaaagttgacagtagacaatgataataaaagttacgaagaacctcttgaaaaagtagaagggtgtattttcccattaccaaaagcagaaacgagattatgggaattgaaaaaccagaaaagaaacaaaataataagtaaacaaaagtacttactgaaacaggcaattaggaatttctcagagtatcctttttacgcacagaacaaacttatacatcagcaggctaccggacttatcttgacgaaaattatatcaaagataaaaaaggaagaacatttgaaaaaaataaatttaaaacatgattatttcgatctccagaagaagtatgaaaaagaatgcgaaattttgactaaactgagtgaaaatttaaggaaggaagaaatcgaaaataaacgtaaagagcacgaac

SEQ ID NO: 681098 - DNA, 220 bp, Homo sapiens
  misc_feature (115)..(115): n is a, c, g, or t
  misc_feature (156)..(156): n is a, c, g, or t
  misc_feature (192)..(192): n is a, c, g, or t
gccctcccggcctccaaggaggatctgttgtgcacaccgcagcagtaccgagcctcgggcagctacttcggcctggaagagaacggccgcctcttcgcgccgccaagtcccgagncgggcgaggcgaaagcgcagcgccttcgtggaggtgaaganagctgcccgcgcggccagcctgcaggaggaggggancagcgacggcgcgggggtcgcctccgag

SEQ ID NO: 681099 - DNA, 124 bp, Homo sapiens
tctatcatcggcaccatatagcatctagaggtccatgcatacttaatattatacttaaattcaatacgggtgccgatgaatagcctgtaatttagaatgagtccactttaaatcctttaacgag

SEQ ID NO: 681100 - DNA, 139 bp, Homo sapiens
tggaggtcaccatattgatgcctgaacttagtgctggacaccctgatctgcatagcgcactacagcccagaactcctgggctcaatctgatcctcccacctcagcctcccgagtagctgggactacaggcacgcgccat

SEQ ID NO: 681101 - DNA, 126 bp, Homo sapiens
gacctagacactcgatatgagaaacgttacgagagagagcgagagagatgtgcacgtgagagtacgaacgcgagaagccatcgagagtcagtacttcgcgacagcgagatatacacgctacctgac

SEQ ID NO: 681102 - DNA, 443 bp, Homo sapiens
  misc_feature (148)..(148): n is a, c, g, or t
cggtatgtgctcagtacaatcttgctggaagaggcagtcttcttagcatggtgagctgagtcatggctttttttgtagctagtcctgtccctggcatccatgtgatgtttggattgagtaaactttgttgccagtgggcagtgcatgntggacagtatcagagtaaggctctccccctccagagccctgagtttcttggggtgcatgaaggttttctttagaatcagaattgtagccagtttcttttggccagacagcatgaaatacttggatataactgaaaagggtggggtggagatgggtgtggcagtgtatggtgtgtgatttttattttcttctttggtcatgggggccaaggagaaaggcatgaatcttccctgtcaggctcttacagccacaggcactgtgtctactgtctggaagacataaccgagcgtggcaat

SEQ ID NO: 681103 - DNA, 638 bp, Homo sapiens
acttagactgaggaaaacattcggcccgcggaaacggacgctggacaacgaagggattccgcgatctgcgggaattgggcacgagcagaacaagacgacccagctacggacgatgttaccacaattaaaaatttaaatacctcatatatcctcattcaaattcatctacctaatggccacttatagtctatccactacaatatcactcatatctacgtattcactgtctgtactattatctacatgagaactgttcttgatctgacaaagactacattgaccacagattgaaattttactctgactgtaaagtttacatacatgtgcacacacatactcacacacctacacacacatatgtacatacgcaattgtatatatatttgaactttctcattatatatataaaatacacttctatataacgatgtatctatatatgtgtcatcccaacttaactcgtcttcttatatctctcgttgacaatcccacatccatatttccctacttacacttttttaacatcaactacctgatgtttacttaaaaaacttccttattttattagttttttcatctgaaagcaacatctatattctaaattaattccctatataattttcgccctttcacaaacg

SEQ ID NO: 681104 - DNA, 128 bp, Homo sapiens
tccgataatcagcttccacccttactacacaatcaaagacgccctcggattacttctcttcattctctccttaactgacattaacagtattctacaccagacctcctaggacgatccaaagaattata

SEQ ID NO: 681105 - DNA, 244 bp, Homo sapiens
tatttttttgtgtccaagttagataacgcggttatcaccatcgattggacaggctgatctcgaatacctgacctctagtgatccagccatctatggctcccaaaatgctgggattacaggtgatgagccaccgtgcctggcgcatcaactacgcgtagaataccgtagtttggagataggagacaggatctcgataagtccgccatggctgatctcgaaatcccaagctcaagcgatccacctg

SEQ ID NO: 681106 - DNA, 1768 bp, Homo sapiens
tttttttttttattttatccttctggggacccatccagtgagtcctatttaagatctcatgggcatatcataccccacctgggaaagtcatcttataccaaaccctttaacaggggaactcctcgtggctacacagtggtggtgtgataaaactcatatataacatctcattcattatgagatgagagtggctgcgtggtacaatattgtgacgtggccgaggtaatacctcatctccagcatctttctcaccataagaccgtgggagaaaaatctcagagactcccaccaataaaccccgtgagagtctaccaatatctgccgagacacaccagtggactataacctcaatacaaaagagaggatatcacgacacggcgagaaatgttggtcgtgcgaagtgcacccaccacaagggcgacaccactatcatcaccgatgcaccgaagcgcgcgtggcctcacactgggcggagcactgaacaagacgagcgctggacccaccaggaagcacacaccacaaaaaggcaccaggggagccaaagaaaagcgcggacaaaacgaacagcgcacacaaaccaacaaagacaccggcccgcaaaacaaacccaacaagacaaacaaaacacaacacacaacccaacaaatctaaagcgcaaacacagaaaaacacaacaaaaaacagaaggacaaacgaacaaaaaacaaactagcgccacagaaccgaaccaccacacagaaaagaagagcaccggccaccaccagagaataaaccagaacgccagaacaccccacaacagggaaaaccacgagcaaactaaaggaaacaacacaaaccacaaaaaacaaccacccacaaacaacaaacagtagaaaccaaaaacacacacaacaggcacgccaccacaaagtcgaaaaccaacaccaaaaaaacataaaaacaaaacacccacacacataaacacaacaaaacaaagaaaaaacaaaaaacaacaatcacactcaaaaaataaaggaacaacacacaaaaaaacagaaagagaaaagagacacaagtaaccacacaccaataggagcgacgcaccaacacacataaacactacacaacacacgatataccacaagcacatatacacacaacaccattagaagacacaaccaaaacaatgagctaaacacaacacacgaccgactaacaacaacaggcgacaatcacaacacacacacaaaaaagcagccaaaaatcaacaaacaaggaagcaaaccacccagagcgcacaacaacaaccacaacaaaagaagacgagatcaaaaacagcaccaaatcgaacacaccaccaacagaacaatcataaaaaaataggactggacatccagcactaagacacacacaagcacagaaaagacaaaccaccaaaagccccgaaccaaataacaaccaaccaataatcggtacacgaacaaaaccatagagaaacccacacacaagagagcagaaagcaacatacacaaacacaaacccaccacacgcacactaaagaacgcaacagaaacaagaagagcaaaaaatacagaagacaagagtaagaaatagagagaggacgaagaaaccggacacaccacgagcacgcgacaatgagatcacgaggacaacataagataagaaacaagcaaacagaccaagaagaatgaataacagagaacatacaccactatcggcaaccgaagccagtacacatgaccaacatacaaggtaccaccaagaatag

SEQ ID NO: 681107 - DNA, 340 bp, Homo sapiens
tgggcctcagtgtcttgatgtatcattcatggagcaggcaaaaccagacgtctgggaagaccgtgaacttaaggagtctgattctccgacacaggctggtggaccacgtaccccactgagaccacctctcagggtgcctgccctggttcctccccagcctgagtcaactgtttggactgcaaagagggtggggacggggggttaaccctgttccccccaaacctttggaggcccaggtgggagggttgctttagacccggagtttgagaccagcctgggcagcatagcaagatccccatcttttaaaaacaaaataaaacaataaagactgcaaaaaaaa

SEQ ID NO: 681108 - DNA, 245 bp, Homo sapiens
tttttttgaagaattgaaattgcccccccacttgcccggcccggtttttcccgtccggaacgtttttaggaaggggaaagctgggttcttccttggggaggggaggaatttcaaacccttcgttagttcccgtttggcccgtcccaacgcccggtttttcggcatacgggcaaaaagacccaaggaacccccagaccaggtttttgaaaagaaaaaataaacccctcttggggacttggggtcca

SEQ ID NO: 681109 - DNA, 1135 bp, Homo sapiens
tgctccgctgctgctgtcagtgacctggcgacatggagtcccagcgggacctgagcctggtgcctgagcggcttcagatgacgctgaacaatgaactggcagctggaagttgaaatgtgcggaaacaaaagctggcagaaccaggaggtagagaaggagaacatgccactttttctgtctgccacctttgctctggtgatgcgagctggcctgtggaagatgcttctgtgagctgctgctggaggtcgtgtctgatgcggctggaggaggctggcctctctggctccagggtgctgcagaaactaatcaactgactcagtttttatatacctatgcctgcttacggaccttgctgggcagtggaacaatgaaggtgctgctggctggaggttgcagggctggccctttgtgcccagatgctgtgctgcccgggggcatgcataccccaatgaaagcgtaatacgcatatcaaagaaccctgtggggaaatgtgatgctagcattcgtcttaccgaaaggtagaaccgctggatccctggcattcaccccctgggcaaggttgaaagagcaatacaatgggaactcccccggcttggcccagatgaatgggcggaaggggagacccttccggccccccaggctggggtcatgccggttaactcccaaccctgggaagtccccaaaggtctttgggacgacagcagaagccaagccgcacgtttgcaacctatggcggccgacgaggttcatattgtggaccggaaacttggacgccaaacttgcaacagggtcaggaccagtggtataattgggaaagagttcccccaaaaatattcacccttggctaggttaaagcccgaaaatggggccccaatatgccattgcaaaggtcatagggctacattagccggcatccctcaggtagatccaaaacccctccatggattatccacatggcggcaagtgaacctggcacagttgaaccttgggccattccataggggaaggaaggggcccttgccgcagacacagcatcccggaattaacaaacaggtaacgagaaagaagacaaaccacgaatatactatcaaatgcagcgagtgaacccaggcagagagcacaagccgatggaaga

SEQ ID NO: 681110 - DNA, 81 bp, Homo sapiens
ccacatcccccataggtcactgtgtggccatctaccactttgaagggtccagcgagggcactatctctatggccgagggtg

SEQ ID NO: 681111 - DNA, 241 bp, Homo sapiens
ccggctcgacaaaagtcatccatgttgtagtatctatcagtacttcatatcctttttattatcaaataatattatattgtttaggtctcccatatttatatttattcatatcatctcttcatggacatgtagggtagtttcatgctttattggctttcatgaagtaatgctagctgtaaacactttgtagttcaacgtttctagggtgaacatgttacttatttcacactttggacgcgga

SEQ ID NO: 681112 - DNA, 161 bp, Homo sapiens
taaacaaaacaaacacttcccatgtctaggaagccaagcccagtggctccccatcacagtgtatgtataatacctgtatgaatttgggggggggggtgaatgtcttgcctccaggtcccaaactatcttgaagtccctggatctgtcggaaagtgacattc

SEQ ID NO: 681113 - DNA, 320 bp, Homo sapiens
ggaccaggcttgtcatgcttggagagagtgacctgcggtgctgcgagaagtgtgagctgaccctggacatgagaggggtctttgaggactccaactacagcgagaggaccaccgaccttgacgtccaactgctgtgactgggccacatagtcacactctttgaggccatacatgccaactgactttcggacagtgagcttgctgcgcgcgggccttagcatgtctgacacgagaccctggtgacaatcgtgtgctaccacaagattcgagagaagggggcctatagcaccgagcttcgatcttgacttcagtgagaggcc

SEQ ID NO: 681114 - DNA, 937 bp, Homo sapiens
  misc_feature (318)..(318): n is a, c, g, or t
  misc_feature (603)..(603): n is a, c, g, or t
  misc_feature (644)..(644): n is a, c, g, or t
tgaccaatggtgcctgtttatcattgggatgaccatgaggaaggcgcaggttgaggactgagctaatctgaaatgaacatattattgacaggcaggctgaggtccacagaggccagggacgcttccatctgaccccttgtccagcgctccttgcgcctgtgctgtgtctacttcctcgaagaaaagtccacacttccaactgcaaagtgcctagatgccaccctgggcagcaccaggccctgggagtgctcctggcctccctcatcgctgggcactgggagccgtgtgtccctggctgcctctgaggctgtgatttangaggctgaagctgacccaccgctggcaccaagcgtccactgtgagataacaatcacctagaaatgatgtgcatttacggtgtgcttcaggagaacacacagaaacttaattgctagaattaaaaacttaactcactttgcctttcagcaatgaaaaacacattagctgcttatgttccccttataccattatttttgtgaaaagaaattctgaatatcttctcttaatggatgtaaaatatggattgtctcaatgaattgcatatttattctgatgatctttgcngattcctttcctgctctaaatcctcccctaccctccttatnaatgctcatgggtgtgaccttctgttagatttccaggaacagccttctgctctctgataactacatgctcattcccaccaaagcaggagcccaaccaggggtaaaatgactggttgccaagaatgctgaatgggacatccatgagcagacagtgccgtctctccttcagaccttgttactctacctgcaattaaattactgaagagagagtgcacaagtgcacacacatgcacacaccacacccacaccacatgccacagcatgcacacccaacatccacacaccacacacat

SEQ ID NO: 681115 - DNA, 333 bp, Homo sapiens
ccaggctcaccctggagtgggggtggattcttcggaagctgctttcaaacagatttcccctggtttgtggtgtcctctctgtgccttggtttttccagtaggaggaggctgttagggcttaagaccatccctgcaagaaaccccatactctatacatgcttaccgggttagcatgtggccagcattgtggagtgttctagaagttcttgactatccctgtgtggaatatgcctgccatcccagcacttgtagaggcagcaagctgagataagccttgtctacatagcaagtttcaggtcagccagcgctccaagataagaattagcttaaaaa

SEQ ID NO: 681116 - DNA, 941 bp, Homo sapiens
  misc_feature (12)..(12): n is a, c, g, or t
  misc_feature (71)..(71): n is a, c, g, or t
  misc_feature (95)..(95): n is a, c, g, or t
  misc_feature (99)..(99): n is a, c, g, or t
  misc_feature (131)..(131): n is a, c, g, or t
  misc_feature (135)..(135): n is a, c, g, or t
  misc_feature (194)..(194): n is a, c, g, or t
  misc_feature (215)..(215): n is a, c, g, or t
  misc_feature (220)..(220): n is a, c, g, or t
  misc_feature (224)..(224): n is a, c, g, or t
  misc_feature (235)..(235): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (286)..(286): n is a, c, g, or t
  misc_feature (310)..(310): n is a, c, g, or t
  misc_feature (460)..(460): n is a, c, g, or t
  misc_feature (602)..(602): n is a, c, g, or t
  misc_feature (626)..(626): n is a, c, g, or t
  misc_feature (644)..(644): n is a, c, g, or t
  misc_feature (718)..(718): n is a, c, g, or t
  misc_feature (732)..(732): n is a, c, g, or t
  misc_feature (804)..(805): n is a, c, g, or t
  misc_feature (817)..(817): n is a, c, g, or t
  misc_feature (845)..(845): n is a, c, g, or t
  misc_feature (902)..(902): n is a, c, g, or t
gcacctagaggnacttatggctccggctgcggtggctcctgcggctctggctctcttgtcggccctggtcncagctgaggtacatatttattccnctgnttgtgtagaattgtgcctctcccgactctttnatgngcgtttgtgagaatttcttccccctatgaactaactcttttattctctcgaggattgcnccatttcttttgtaggtgtgntctgnaacnagggtttctcnttccccgatgactnctntantagtggtcgtggtggcccaatcattaatccntcctctcaggagatcttgccaaangaggaacagtatgatctgaagacaagtagatgtctctattagcttcccaaaattcattgttgggatttctgaacacatgaagaaagttgcagtgttttcctcttggacattgttgtatttcaaataaaccacaaatcgccattttcacancgggtcactgggcagaattcacattgcagctgtcgtcctgcataccaacgaaccagattaaacagagaaagggctgctatggcattcatatcttcacgacatggatactgaaacatatacatttgcccctcagggtgagggntccaaaatttgcagctagaccttngaactggaatcactttcncccacagttctttgaactcggggcaacacatccctcataagaaatctaaggaactgtttggtaggtttcttccntcgctgtaatccanggcttgcgtcaggggtcataatcatccctcctgcactgctccattccaaacgttgtaaacatgctcttaatnnaaagggtaggantagatgttggggaattatgtttacgtgnacatctgtctccaatctgcagctcctgttttactgtagaagggacattagctcgatncttctccattactctgaaatccacgggtggttctgggtt

SEQ ID NO: 681117 - DNA, 866 bp, Homo sapiens
tggccccaaagaagcaattttttatttgggtgaatgctgacggcaaacttctcccaagaaaaaacaaatatgggaaatgttgtctcgagacaagaaagccttagggaaacttttagggctagaatacaaatttcccacaagggaaaggcacggacctctggggagacttgggaaggctccctcagccatttcagcaccagtgcggacagagcctcttcaatagtttgatacaaccattgtgcgtgctccctcagtgccctgtcccaaccgagcattcttcttaatttctttcccctcgtgtttcaatcttctctgtccaccccgaggtgtgtgcaccagagaaaacgagtgcccggggatatctcagcccacccctagtgacagggtgtgcccattttctcccttctcctgttgtttccaaaacccccccccggagaagtgtccttctccgaatttaactccctcaatttagggtcgtccccccgtgtgtattaggcgtctctccgtggcgccgcccaagtggccccccctctaatccaacatatttccacccccaccacgtgtgggtctgttgttcccgagggggacctctgtttgccccatctccaccccgtgggtctcgggggtttcaacacgaggctttgtgtaaagggctcctccttttgaacttcttggcgagcacgagggctctctcgtggtgaaggctcaccactttcttttgcaccttgtttcacagttccttccgggcaaaatttttacccccccctatattaaagatttaattataaaccaccttcccctcatttgaagcttcctccaaccccattaccaaaacttttcccggcattgatgaaaacttcggggtc

SEQ ID NO: 681118 - DNA, 236 bp, Homo sapiens
  misc_feature (175)..(175): n is a, c, g, or t
  misc_feature (186)..(186): n is a, c, g, or t
  misc_feature (218)..(218): n is a, c, g, or t
acaaaacaaaaggttggtttttggaaaagataaacaaaatcaataaggtacttgctagactaaccacgaaaaaaaaagaaagatggtcttaaataaaatcagaaatgaaaaaggaaacattgcaactgataatacagaaatacaaaagatcatcagaaactattgtgtacaactntacactaactngaaaacctagaggaaatggatagattacaggncacatgcaacctaccaag

SEQ ID NO: 681119 - DNA, 933 bp, Homo sapiens
aaaaaaaacaacggcaggagcaggcccgggtggtaccgcgagcggacgcggcagcgcctctgtatcgctttttcttatttttcccccctttcccctttcttttttaattatttcttttcttttctcccctgcactaaaaaatcctcgaagggacacggaaggggcaaagggaaaaaggaacagcacccagaacaaagaacaacaaaacgcaacaaagaaaagaagcgaagcaaaacaaacagacaacacgagacagacagcagaaaacaaacaaaacacaaaacaagcaagcaagaaacacaaaaaacaaaagaaaacaaaaacaaaaaagaacaaaggaaaaacaacaaaccaagacgaaagagaaaagagcggaagaacaagaaagcaacaggggacgaacaaaggaccacacacacgagaagaaaaaacacaagacgagcaagcagaaagacaaacacaacgaaacaaacaagcgagacacaagacaaagccaagaaacagaccaccaaagaaaaaagagaccacaacaaaacgaagacaaaaagaaaatacacagagaaatacagaagaaatgacagaaggaggataaagaactaagaagaaacagagagagaaaaggcaaaaagaaagagaaaaacagaatagtaaatataacaatactcctaggggaaacaaaaacgcgcaaccacaggacaatgaagaagcacaacaacagcggaaaaagagaacaaaaaaaaagaagaaagaacagagaacaaagcaacacaggaaagacagcaaccacaggaagaaaaaaaagagagaacagcgacaaagaaagaagaaaaaaaagaaacaagaacaaaagaaaagagaaaacgacagacaaccagagacagacaaccacacgaaagaagaaagaaccaaaaggacacaacaagaaacaaaaaa

SEQ ID NO: 681120 - DNA, 169 bp, Homo sapiens
  misc_feature (113)..(113): n is a, c, g, or t
  misc_feature (142)..(142): n is a, c, g, or t
ctagctattacggtgttcctctagctattacggtgttcctctagctattacggtgttcctctagctattacggtgttcctctagctattacggtgttcctctagctattacgntgttccccttaattggcttgagtggaagntcaggggcaaggaacaccaatagctag

SEQ ID NO: 681121 - DNA, 211 bp, Homo sapiens
cagggtcgctctcgggtggatgggtgttgcttgatcccgctgttccagcgtcgaagaaccattgggtctgccggtttgaacttgttctgggaagctgtgcgtacaccgtgaatggaggctttgtgaatttcttgaataacctatagactgtggtctaaggtggatatggggcagagccaaaataacatatcttttaaattcggcatgcatt

SEQ ID NO: 681122 - DNA, 340 bp, Homo sapiens
tcagccggtacagacttctgtcaccaagatgataattcaacatttctttctctggaggacccaagcaggacaggcaacagagcttatgaattccacctgtggtcaacgagttgtagactggaaagacacctgcttgagaagtgacaaggaccacaccggagttaactattttggtcaccttacattttcttttttcttttttttttttcctgagatggagtttcgctctcatcgcccaggcgtgcagtagtggtggcgcgatctcggctcactgcaatctccacctccgggttccacgcatttctgttgcctcaacctcccgagttagctgggactatag

SEQ ID NO: 681123 - DNA, 471 bp, Homo sapiens
gcacgaggcgcctacatcgagggggccaagggaacttctacccaattcaggcccttgctctgggagcccgacagggatcgctgatgccaacgatgcctgtgtctcatccaccgggtcaacccgcagatgctgcggctcaacgccgacccccacttcttcacgcacgactttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccgcccgggaccacaaagccaccgtcgctgttaccgacggtcatcgccccggctgggcggaggaggagacgcccatgcccctcatgggaaagtggagaccgggacacc

SEQ ID NO: 681124 - DNA, 392 bp, Homo sapiens
tattagtgttttatctcttttgttttttgcttaattcttttttgaaatccattttttccccttttgtttcttttttaaaaccacccaacggccggggggggtaacacgacgtgctgaaaaaaaaaccgcctcaaatggctggttacgtcccctgacggaaaacccatgtttccccccgccaatttttggtggaacacgggggggggaaagggctcctcccgccccctcttaaaaaaaaagcgccctttgtattgcaaaaaaaaatggggcggcctttcccgttttatcccccccccccaaaagggggaaaaaaatttggggggggggggcccctctgaagaccatgctgctgtgcagggggacaatttttgaaaacaaaaacacccccctcc

SEQ ID NO: 681125 - DNA, 318 bp, Homo sapiens
  misc_feature (1)..(1): n is a, c, g, or t
  misc_feature (314)..(314): n is a, c, g, or t
ntgctcggtcccagtgtctgagaaggtgacatctgagcaaaggcttctaagaggcacattttactagagaagttgtattgttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctntctc

SEQ ID NO: 681126 - DNA, 375 bp, Homo sapiens
  misc_feature (19)..(19): n is a, c, g, or t
  misc_feature (43)..(43): n is a, c, g, or t
  misc_feature (63)..(63): n is a, c, g, or t
  misc_feature (81)..(81): n is a, c, g, or t
  misc_feature (101)..(101): n is a, c, g, or t
  misc_feature (130)..(130): n is a, c, g, or t
  misc_feature (133)..(133): n is a, c, g, or t
  misc_feature (144)..(144): n is a, c, g, or t
  misc_feature (153)..(153): n is a, c, g, or t
  misc_feature (165)..(165): n is a, c, g, or t
  misc_feature (177)..(177): n is a, c, g, or t
  misc_feature (208)..(208): n is a, c, g, or t
  misc_feature (243)..(243): n is a, c, g, or t
  misc_feature (258)..(258): n is a, c, g, or t
aaggtaccagtggatgaanttgatggaaagtttctacggtcanaaaaggctgctgtgtggaanctataaagccatgtgganatttggcacctactgtcaanagttggctgcccttgaaaaggagcgcagncanctttcctgcancttggctancttcctaaccanctgttcagaccntctgattttacatttactgaataagatttgnagtaatgaaagtctgtagtcttaaaactctaaaangttgtactgcctccnagcagcagtatttatagtaacgtaagctattaatgctaactcttgcatgtcaagaaacattagtcttaggaattcttcaaaaaatggcatcccaatgaaaataaatttgatgactat

SEQ ID NO: 681127 - DNA, 180 bp, Homo sapiens
tgcctcctgaccgatcatggtgcttccccacgtggccctgcatggcatggtgtgacctatgctcttgaattgtgagtaacacacgctgtacgtaatggcagtcatctcctgacccatttcctcaccatacctgaataataataaaacctattgtctcagcatatttgggctgttttaaca

SEQ ID NO: 681128 - DNA, 751 bp, Homo sapiens
  misc_feature (9)..(9): n is a, c, g, or t
ccacaaaanaattgtgggggggtttcgcaaagttttagtgttttaagcaagtgtggggatttaccatcacccccggtttttttccggctcccccgagcccttagcccgggtcctttttgtccaaaaggtcaaaaagtccacatatggggaaaccttggcttccctttccatgggtttacctcctgtccagggtggaagtgaataagaaggcctggaaaaactgggaaaatatttattaaaaatttaaaggccattcattcagtggccagtgggaattaactctcccaaggcaagtgaaaatgaatgattgacgacggttgatttccacatcttactagattttaattcttaaggatttcaaatgaaaccagaaggtggttatgtaaaaggcttaaaatgttcttatgtttaaagagattctgttattagccccatgaactcggactatgaaatttttaagccttttatttttctaactatattactgtagggctggatattaggtgtcatataggaaaccccaaagttattgctgtttgctaaagccaaaaagcaggaaatttttgtaaatgccaaactgttgaaggcccataaaaaaatgtgtactactgacggggcttttactaggcttcctgggggggtaaaagtcgaggtattgctggcattcagggggacatgatgggactaaatgttttccattaaagttttttattttaaaatttaaagaaaaataaaatggctttccctcaga

SEQ ID NO: 681129 - DNA, 331 bp, Homo sapiens
  misc_feature (16)..(16): n is a, c, g, or t
  misc_feature (18)..(18): n is a, c, g, or t
  misc_feature (33)..(33): n is a, c, g, or t
  misc_feature (40)..(40): n is a, c, g, or t
  misc_feature (47)..(47): n is a, c, g, or t
  misc_feature (54)..(54): n is a, c, g, or t
aagagcccttttatgngntgaccactaataagnaaacccngttgggnttttaanaaaagcgctgtacggctcgataccggatatcgtcgaccagctccgttacatattctttgcagaagtaaaggtatgatatagttatatagtgttcggctgtaaatgatgctaaatatacttatgcaattaagggcttacagaacatgtgaaacttttttactttatgggaataaggaatgttgcacctccacatttatgcttctggatgtgaaatcatgtaattatttctgctgttatataaagtgccatacttttaataaaggaaaatgtacatatg

SEQ ID NO: 681130 - DNA, 147 bp, Homo sapiens
agggtgtatgactcctgactggcgtcagatggttgtaccactgtggttttgatttgcatttctctgatgatcagttatgttgagcttcttttcatgtttgtggacatttccacgagtcacacaaacatgaaaagaagctcaacataa

SEQ ID NO: 681131 - DNA, 611 bp, Homo sapiens
  misc_feature (5)..(5): n is a, c, g, or t
  misc_feature (19)..(19): n is a, c, g, or t
  misc_feature (35)..(35): n is a, c, g, or t
  misc_feature (44)..(44): n is a, c, g, or t
  misc_feature (54)..(54): n is a, c, g, or t
  misc_feature (67)..(67): n is a, c, g, or t
  misc_feature (100)..(100): n is a, c, g, or t
  misc_feature (115)..(115): n is a, c, g, or t
  misc_feature (133)..(133): n is a, c, g, or t
  misc_feature (322)..(322): n is a, c, g, or t
  misc_feature (434)..(434): n is a, c, g, or t
  misc_feature (583)..(583): n is a, c, g, or t
  misc_feature (585)..(585): n is a, c, g, or t
gatgncaacgtcgaatggnaattttgttccccttnttctttggnggactttggnatacgatgacttnccattttgtgcaagttgtgcattgcatacctcnagggggcgccacccncatatttatgaaatgccnccccaggagttgcacagacatagtttacatgccaataacagttgctctggttttggggttgtcctgggttgctctggaactgggaggaactttatttctggccattagaggccctgagcatgacattgagtatcctttcaagaaaggagaaatgttgaacagagaggacctcatttttataactcttgnccatcatctagttacggagcatccacttttcacccctgggccatatccatttgacggatgaaaaatcatcaaattataatatcatggcttttacttttgatagcttctgccnggaacatggcggtaacagcttctcattttcaattgattcattgggggagaaaatatacacgactgccctaagactttctattacataccatttgtttgacgggatttctttagtttctgtagcataacttattctaactggtcctcaancnctttgcaataaaacctgagattgtga

SEQ ID NO: 681132 - DNA, 105 bp, Homo sapiens
agatccctttccatcccgagcttcaagaggaatcggtaatgtaggagaagaatctgagcagggaaccgtctgtttcctggagccccatgttaggaccccagtaaa

SEQ ID NO: 681133 - DNA, 451 bp, Homo sapiens
  misc_feature (2)..(2): n is a, c, g, or t
  misc_feature (45)..(45): n is a, c, g, or t
  misc_feature (258)..(258): n is a, c, g, or t
  misc_feature (270)..(270): n is a, c, g, or t
  misc_feature (273)..(273): n is a, c, g, or t
  misc_feature (311)..(311): n is a, c, g, or t
  misc_feature (326)..(326): n is a, c, g, or t
cngtggtcttagttgctggagcaggctgagtgtccccgcgggttntgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggcccgtgggggaatagggaagtcactctgagctagaaattgtngaagaagaaaanaancaaccttcctagccttggaaagcctgtccctgcttttnatagaattattgccnttttgtaggaattacagtagcaaaccccaggctgccgctgaattcctaaagccacattctggataagaactatcctagagaatgagcaaaagtaggaaattcagtcgacgcggccgcgaatttag

SEQ ID NO: 681134 - DNA, 285 bp, Homo sapiens
ccgcgtagccgccggtcgctacggcctgaacatcgccgatgtccaggccgtcatcgccggcgcggtgggtggcgaaaacgtctcggaaacggtcgaggggcttgcccgctttccgatcaatatgcgctacgcgcgagaatggcgtgattcaccacaacggctggcagaactacccatcttcacgccgatgggtcagcagatcacgttggggaccgtggcacgtatcgcgatcaccgatgggccgcccatgctcaagagcgagaacgcacggccctccggttgggt

SEQ ID NO: 681135 - DNA, 121 bp, Homo sapiens
ctgcctcagaagggagccaccgtgaacctctcgagtggctcccaaccgcagtggcttttcgagacatggcccatacttctggcccggctggacgaagcgaatgccgaccctttggcctctc

SEQ ID NO: 681136 - DNA, 426 bp, Homo sapiens
  misc_feature (1)..(1): n is a, c, g, or t
ncaccaagttcttagctctacttggcaaaacaggtctccttatggtcagcctttcagcgcttctcctcatgagcgccaacatcatccataccagctttcggttgctcttagggtgccttgggcatgtgtgttctaggcccatcaagtgcagttggtatgttcatctgtatcgccttctcacacagtgtgaatatgtctgcatgatgtgagtatgttacagcattaaactctgtggcaatgtatgtccaggcgacttgaagagctgaaaagcatggttgcatgttcacgcatgatgcgttgcagcatctggtgggtctggcacttagtggcgttctctcatgcgagttacacatctggttccggtcctcggtagacacgacgtctacccacgaaagttgatagggcagccgcttgaattggtcgtcg

SEQ ID NO: 681137 - DNA, 152 bp, Homo sapiens
gcctgttgccaagaagcagcagcaactaagtgccattacagggtcttgacagcggaacctgtgccgcgtacctgtaaattacggcactaggcaatggcgggcaggcttacaaaggcaaggccggttttacaaaggacttgcccgagggaaga

SEQ ID NO: 681138 - DNA, 1161 bp, Homo sapiens
  misc_feature (1161)..(1161): n is a, c, g, or t
ggccagagcgtcctcgtggaagtgacatcgtctttaaaccctgcgtggcaatccctgacgcaccgccgtgatgcccagggcaagacctagggcgacctggaagtccaactacattccttaagatcatcctagactagttggatgattatccggaaatgttatcatgtgtgggagcagacaatgtgggctccgaagcagatgcagctagatccgcatgtcccttcgcgggtaaggctgtggttggtgatgggctaagaacaccatgatgcgcaaggccattccgagggcgacctggagatagagcaacccagactctggacgaaactgtctgtcctcatatccgggggaaatgtggcgcttgtgtgttcaaccaaaggaaggacctcacatgagtagtcagggacactgttgctggccagagtacaggtgccatgcgtgctgcccgtgcgtggtgccattgctaccatgtgaagtcgactgtgcccagcctcaggaacagctaggtctcgggcccgagaagacctccttttgtccaggctttaggtgatcacgcactaaaatctcgcaggggcaccattgaaatccgtgagtgctgtgccgcgtgctcaatgactggatgacaaatgtgtggagcgcagcgaaggccacagcttgctgaacattggtcaagcatcgtcccccttctgctttggggctgggcatcccagcgaggtgttctgaccatggcagctctacaagccttgaagtgcgtgatattcccgaggaaatctctggattctcgattccgggacggtgtccgcagtgtttgcccgtgtgctgcttggcgatgggtaccccgctgtggcttagtaacccttttatcgcgagggtcaaacgagtccgggcttgcctggggaccgttacactctccttgggaaaagggcgaggggctcttggggaccaacattccctgggggcaccccctgcggtgtccccacgtgtctgtgtgtggtctcccccatgtgtaacagaaatggctgcaggaatctatgtgggtgtctccatcacaacagacccactcgttttagaaggaagctctccaacccgctgcgcaagggggagacgctgtgccacctgcatcacatatcacatcgttgtcctgctgtatcgtcattctactgn

SEQ ID NO: 681139 - DNA, 1254 bp, Homo sapiens
ggtggctggaagacatggccactccagctcggtgttgagcactgcgacgcagtcgtcaccgcctttagtgatgatgattaaaggtggtgagctgtggccttgaaaaactacgtcatgtgaaaactcgatcatctatacaggtgcttaaagctgtagaggatctatcagtgatgaaatttcatgtgaaatggtgcagtcagcctcagttttccagaagccggaacaggatcctctagataaggccacggtgtggcatgctgctctgaaccaggacctggagccggaccaaagtgccatgtcgtttaaatgtatagtctcctcagtccggatgccaggatgggactcagtcagcagttccttgacctcatgctgcacgtaatctgtgtacctctaatagtaatcgccagtgcgatttctattgaggcttcaatcttataaacggacagtgacacgcaacattgaaggattaaatgtctagggagagaagccttttctggccaagtgcacgtgtgaacaactgaagatgttaccaaactgacgcgaaacaattttatccagtatcacttcacacctcggtggaatagacactaggagtattacatactactagcagaaattcggacttgggggaacgtgggcgcaggggatagtgtaaacaccgttggaaatttgaaaccattgactataattaccctccgtggtagcggacacggaacgccccgttacaccgaagggacaacactttggaatggcactccttgcaaggttatcgagacaggaacgttacactgcctttgaaaagacacacaaagttaacaacaagggggaattgcccgggccatttggattgcttgtcccttcctatgggttataagtataacgcacaacattaacacaggttgaagtcattgggcagaaagtccattggcggtaaaacgagggggaggtatggcgccaaacccccaatagaaacgccgaatatttgggcgcttaattacacggacaaccctttataagacaccgtttcaccacacgtttcacaattggcacacggcgacatttggcacataaacacacagggttacattaccatatggagtgtgttcttacccggacaaaggaagattgaccctatttcgctacggggaaaaacgaatgaaatcactagctggcacacatacggaacaatacaattcaagggagggtattctacacattgtgtactgggctagccaacaacatcaggtagtggtc

SEQ ID NO: 681140 - DNA, 789 bp, Homo sapiens
cctagatgccgcttatacgaagctgtcatatgaaacatgccatatgcatagtatccatgagtactcttggaaatatggcattcctcaagttgtttgtgagggtgccgaaaggactgctggtcatgttcaaagcactgtatggaacgagaccgccctctcataggatccaaccagtggagtgattatcttcatggaagatgattgtgtattccagtgactacctcattcatttcctatagagaatcacccaggccttggtctgttctaatatctggaatcctctgtctactacgagtacatctgtcacacagaatgttacccacttactccctatgttttctgatcacatagaatctgagaggggaaataaaacttataagttgttgagtccaagattgacaaactccgttgtcttaaagggctaagctggggtgacaggtgcagcaggccaggcataagtattagggagcaagggaaactgtgggaaactgaatggcagctatctcataggaggatgaaattctactcttttacaaggtatttcaaggccaacaaagcatcactctgggctggggttccatgcacgaactaccaactttttagccccaaactatgactacctcccttatttctagccgcgggcattttcactgtcactgtgtatatggcctaacgtgtctatccgtttctggccttattggctccctcggctgggtatggagtgcatgattcccatttccatcgcacacccttcgcctcatccgcaacgcgaataccacaccctgacgg

SEQ ID NO: 681141 - DNA, 580 bp, Homo sapiens
  misc_feature (34)..(34): n is a, c, g, or t
  misc_feature (283)..(283): n is a, c, g, or t
  misc_feature (292)..(292): n is a, c, g, or t
  misc_feature (345)..(345): n is a, c, g, or t
  misc_feature (371)..(371): n is a, c, g, or t
  misc_feature (383)..(383): n is a, c, g, or t
  misc_feature (397)..(397): n is a, c, g, or t
gtgcacgtgggtttggttgtcgatgtaggaatantgtagggtttgcttaaggttattgggaattagagttcggttaacgagctggcttttatcggtttgtaagatgatggctgacgaggttttgggtagtgggttggttagttgggtgtttttagataaagaggttatgctggatgctgtttaagtgctggtggttgagatttttagtaagagctctgtggtggtgtagagtattaaggttaacttgttgtatttttgcgaccatttggtggttgagagcttnaatagtggngttctggaactgagctgctgtcagacccaagactcgtgaagttcgttccggcnacgactgagaacaggaactgaaaacngtcacttctcangctctgagagcctngtgtcccaggccccagccagggggccggccttgtcccgcctcatccacagaaagggaggatgggcgatgacagttgtttctatgccttctgacccagtttcccagtttataactttatgacaatgagtttttcaagcccaaggccttattttcaccccacaaacaataaagcaaagtaaagaa

SEQ ID NO: 681142 - DNA, 203 bp, Homo sapiens
  misc_feature (137)..(137): n is a, c, g, or t
  misc_feature (152)..(152): n is a, c, g, or t
tccggccaatgatgtcatctaggaagggtgtggcatagaagactccccacacagaggtctggggcatttcaatgcacctggagtagagcaggcagaagagtctgagaggagaggccagcgagggaggagggaaaccngaggatgtatttccnaaggaagaagaaagtgtccatcctggctaacacagtgaaaacccgtctcta

SEQ ID NO: 681143 - DNA, 345 bp, Homo sapiens
  misc_feature (1)..(1): n is a, c, g, or t
  misc_feature (45)..(45): n is a, c, g, or t
  misc_feature (110)..(110): n is a, c, g, or t
  misc_feature (136)..(136): n is a, c, g, or t
  misc_feature (148)..(148): n is a, c, g, or t
  misc_feature (162)..(162): n is a, c, g, or t
naggcccgggcgtcaggcccagtcactgtgccggacccgtgccgnggcctaatactgcgtctggaactgagctgctgtcagacccaagactcgtgaagttcgttccggcnacgactgagaacaggaactgaaaacngtcacttctcangctctgagagcctngtgtcccaggccccagccagggggccggccttgtcccgcctcatccacagaaagggaggatgggcgatgacagttgtttctatgccttctgacccagtttcccagtttataactttatgacaatgagtttttcaagcccaaggccttattttcaccccacaaacaataaagcaaagtaaagaa

SEQ ID NO: 681144 - DNA, 134 bp, Homo sapiens
attcttttgcaaatggcagctcttgctcaaagaccggaaagggggggatgtcattttcaagaggggtcaacctgagttctgtaaatggaagattctattttcccgcctcgcctgtcctggcgaatcttatgccg

SEQ ID NO: 681145 - DNA, 486 bp, Homo sapiens
tcatccttttgacattatgtgaatattttactggaaaataagactaataaattgttaaaagtttttaaaaaaaaaaaaaaaaaaaaaaaaaaaaaaaaaaaaaaaaaaaaaaaaaaaaaaaaaaaaacaacaaaaaaaaaaacaaaaaaaaaaaaaaaaaaaagaaagaagatagagtagtgtcgactttctaggaatgagtatatctctgagtcagcgagaccgtcacttgtctatctgtcattcgctaccttctcggtagtctcacagacgcgcgctcggcgcctcctcatgttgctctcagcgatgcgtccgatctctcgcgggccatctgtaccgagtactacagagaagctgagggagcatgacaagtcgacgcggctcacagagacacacgtcacagtgacagtagctcgagatgatcctgactccagctactgcagcacgaattgacagtgccatccgagcgccagcgactaccggata

SEQ ID NO: 681146 - DNA, 1193 bp, Homo sapiens
ggaggagctgctcttcatgaagaagaaccacgaagaggaagtaaaaggtctagcaagctccagattgccagctctgggttgaccgtggaggttgatgccctcgcgaagatctctaggacctcggcgcgaatgatcattggcatgatcgagtcacgaggtccccaatattgatctgagtctgggctcggcaagaactcgagaaggcagctatgactaagatagcgtgtgtctcgagcgatgattgacggaggagcagccacaaggtggatcacgcagatcagtcgtgctagacgcgttagtgcatgcctggcattgaggagcagacagcgtcagcagacgccttgagggagcagtatcgagttcacacgattccctttgtgatgtactcagtaacacctcggtacattcgctagtagatgcacaacttctgcaaaggtcgcaagtcatctgagaggaatgcaagtcactggaaggggatgcgttggggaagcgacctcagccctagcggccccttaacaaggaattggaagacagaccttcgagatcgtgggaatcccgttgctgtccatcgcttgaatggtgcacgcaagcttggggcaactagtaactccggagagccatgtaaagggcatccaagccgtcccatgtgcacctatgggtacgtcatagatgggctcctgtcttggtaatcatttcgagggttccacaagctcgcgaggcgtctgagaattcggccgagcactaatccgggtctgaccttgcctttggaaacgtgatgagctgatggaacttttaaattcttggggtagattgccctttgggaacatgcaagcaaaacttccaattgcaaaaaccaatcccaaaaagaaaccaacacaaaccagacgggaatacggtgggatggcgcaaaacggtgggtaggttctgaagaaccaaatgaacaacccaaaaggtttctggaagggccatttaaaggcccaggcaagaaagccaaggggttaacccttttggggccgaggccagtgaagggccacctttaacacaacagtttcccagcaactttccacacacacacaacgacaacaaacaggggggcggagacacactacttaaaaagatatcctctcgaggggggggccccacaatattacaagggttagcgccaggattctttgtggacacagagggggccc

SEQ ID NO: 681147 - DNA, 101 bp, Homo sapiens
cccaaaggggggggggggggggtttccctttttttttccacttttggggggcggggggggggattttttccttccccttttaaattagaccccggggttta

SEQ ID NO: 681148 - DNA, 845 bp, Homo sapiens
gtggcggagtcagcagccaggtctccatttgtcagccatggagctcattggaacctgtgtgagattctctttattgaagtagcaccagctggccctctcctccttcaccttcttgactgggtccgactgcacatgtgcgaggtggacagttgtcggcagatgtcctgggcggtgacaacccaagcaagcatgaaaacttctgggacctggtgactgttctggtgcttcagggccggctcgatgaggcacggcagatgctagccaaagaagctgatgccaacccctcttgtgcaggcatgttggcggggtcctgtggggaccgtgtagtgaggacaatgcccattctcagctggctggtaatactcagacatttgacagagtgggagctgaaggtggcagcactggcgtgaggagtgtgaaagacacttacaagacaacacatttgcagccaacccccgtctggagtctctctgcaagatcatgctgggagatgaggccgccttatggagcagaaggagcttctgagcaactggtaccatttcttagtgacgaggctgctgtactctaaccccacagtgaagcccattgactgcacttctatgcccagtccagcctagacatgttttcttggaggtgagagcagtccagaagcactggacaacatcttgatggcggctttgagttcgaacatttcaccaggtgatcacaagagtgcagcatcgcctgaggcactggtggttcgtaatcaactcacagaacttttggtcactgcggattctccagtccaaaaagtctctattgggtctaaatgagagaatcctcctggggggtacggccagacggtg

SEQ ID NO: 681149 - DNA, 840 bp, Homo sapiens
gggtgggggtgtgggcagggtggtgtagagtgtgcctggactgcgtggtcggggtcggcttcccttcggtccccttggggacgcgtccccgcttcgggttacccctcccgcgggtctgttacgctctctttgggggttttctctccccccccgagcccgggccgccgatcctttggtcggagaaccgcccgcaaaactgtccgttgccgaccccttgatcgcaaagttccccgtgtctccggtcctcggaaattattccccgggtcttcttgtcccctttttgctcgcccgggtatttaaccaatatacacttggggccgcaccaccaagactgttattcacgcaagcggttccccaaatcccggtctcgtcacatagggggactcttgaggcgccggacaaccccacaatgtggaatatagcaagccccagagtacccaaggaaccccctgggagaagatatcaatccacgggaacattccatctccacgtatctacagtcggtatacctatttcccccccaagaggctggttgatccccctccgtcagattggaggagcaaagtctctccccctgtcagggtttaggagacccccaagcaaattttgggcggcgccaaccacagagcctcagaataatgaaggtcgactgaacccccaaggccgaggtgcccacgtgccagggtgttcgtggaggcaaggttgatcgttattcaaacaccaaatgcgtgcgggcagctccatcacgaacgatcaatgattgtgcagaaactccccgccgccgcaatttgaagaaatttggggtttgttcaaaacaaaggccaaaacacccacaaaaca

SEQ ID NO: 681150 - DNA, 189 bp, Homo sapiens
cttccaaccccatataaccgttctaatgcaggccctctggatgaactttgaagagtctctgcagaccacagggacacacagttttgacggcatttggaaggccagcttcaccaccttcactgtgacgaaatactggttttaccgcttgctgtctgccctctttggcatcccgatggaactcatatgggg

SEQ ID NO: 681151 - DNA, 226 bp, Homo sapiens
gtggctgctgtcggggggtcgcctgttcgcgggggtgcggcgggctcctgggggtcgggcccctttcggggttcgggtgtctcgtgtgttcccctccccgggtcttttctgggttgcgggttttgtgtgggccttttttctttcttggccctcgcgttttccgccctctcttgggtttgtgggtgcctttggtgtttgcctgtgcctgtggctggcgtgccccgtg

SEQ ID NO: 681152 - DNA, 192 bp, Homo sapiens
ccacttcaggtgttccctgcatggcccgcagccgcctggactaccgcacgctcgcgaatcctggaatacggaccgcggctcctatttctgtcggttttcggaactgaggccctgcttcagagggccggccgggggcgattcagtattgcgccgctagaggtgaatatcttggaccggcgcaagacggaccag

SEQ ID NO: 681153 - DNA, 418 bp, Homo sapiens
gatgccagctcttcttgggtccaacctaaatcttttcgtcgcgcccgaattctgaaaccaagaccctatcgagaggagttctattcatctccaaagaatgctcagccgatgactatagttccacggactaaaatacccatttgattgatttctccataccagatcggcaactggctccggcgacaacggcacaaagtattcgcggggcttatgcgtgcataaaatctccacgacgacacgggtgtcttgcaacaaaaaaccccgcgtttgcggggtttatcttgcgatcgtactttctaatatcaatttggtgccgaaggtgggactcgaacccacacgcttttaagggcggcggattttgagtccgctgcgtctaccattccgccacttcggcgcggacgcgaagtatagccgggac

SEQ ID NO: 681154 - DNA, 203 bp, Homo sapiens
tgatgagccggcccgtattatgccagctacacttcatgctcttgaattctattatatccatgtgcttgtgagcaaattcacatatacttaagcctaagtgacttctattgctttcaaccaaatgtcactgactctgaccccattgtatgtcgcaggagagaggtgtggaataagaggttgttgaccttcaagcggatcagcga

SEQ ID NO: 681155 - DNA, 717 bp, Homo sapiens
  misc_feature (159)..(159): n is a, c, g, or t
  misc_feature (191)..(191): n is a, c, g, or t
  misc_feature (229)..(229): n is a, c, g, or t
  misc_feature (259)..(259): n is a, c, g, or t
  misc_feature (266)..(267): n is a, c, g, or t
  misc_feature (301)..(301): n is a, c, g, or t
  misc_feature (310)..(310): n is a, c, g, or t
  misc_feature (318)..(318): n is a, c, g, or t
  misc_feature (341)..(341): n is a, c, g, or t
  misc_feature (353)..(353): n is a, c, g, or t
  misc_feature (357)..(357): n is a, c, g, or t
  misc_feature (361)..(362): n is a, c, g, or t
  misc_feature (364)..(364): n is a, c, g, or t
  misc_feature (368)..(368): n is a, c, g, or t
  misc_feature (398)..(399): n is a, c, g, or t
  misc_feature (407)..(408): n is a, c, g, or t
  misc_feature (410)..(411): n is a, c, g, or t
  misc_feature (414)..(415): n is a, c, g, or t
  misc_feature (423)..(424): n is a, c, g, or t
  misc_feature (431)..(431): n is a, c, g, or t
  misc_feature (447)..(448): n is a, c, g, or t
  misc_feature (460)..(460): n is a, c, g, or t
  misc_feature (474)..(474): n is a, c, g, or t
  misc_feature (487)..(487): n is a, c, g, or t
  misc_feature (504)..(504): n is a, c, g, or t
  misc_feature (506)..(506): n is a, c, g, or t
  misc_feature (513)..(513): n is a, c, g, or t
  misc_feature (515)..(515): n is a, c, g, or t
  misc_feature (524)..(524): n is a, c, g, or t
  misc_feature (575)..(575): n is a, c, g, or t
  misc_feature (596)..(596): n is a, c, g, or t
  misc_feature (601)..(601): n is a, c, g, or t
  misc_feature (699)..(699): n is a, c, g, or t
tcaactgaatggaaataatttaaaaataagcaaggcttaaattggggtctttcaaaaaactcaaaacattcttggtgactgtatctttaacaaatggaatgacaaaactagttaagtcatattatctcaatcaactccaaaactcaatgttgccaacangtttttctacttaaaagcaaacaaaaagctangcctcataatttagtaattaccatgtttctggggttcngttctcaaatgccacagaaagatacctgangaaaggnngcaaagcacctagtctcatcagtcttcttcaaanctttaaggntgctttcncaatctcactataaatatttagnttcctatctganaganttcnncncttntgtgggtgggggtgggctggggggggtggnntttgctcnngnntcnnactagggnngtttgancaagccacctctgggnnggcggggctgcnacactagataaganctcattcctatcncttccaagagaccaagntnatctcantntgaattttngtggccaatatgttattgttcttagcgatactttggtttctaatggcaagnatgttgaaaaatttatcattnagtgnatttcataacacatagaaataaatgattctattaaaatataaaaacatccatttacttgtcctatttccagtgactttaaatatcaaatctattatanaaagacaaaattatttgc

SEQ ID NO: 681156 - DNA, 214 bp, Homo sapiens
cgagaataagtaccacatgacgcagatacagagataacgagtacttgaatatgatatgagggtggatgatttccttcgtcgcacacagctgttgtcaggtggccggagaagtagaccgcggtgaaagagaccggaacgagagcgagaccgccctagagatagcagacgagacagagagcgagatagaggctgtgatagagaaagagaaagagag

SEQ ID NO: 681157 - DNA, 999 bp, Homo sapiens
  misc_feature (262)..(262): n is a, c, g, or t
  misc_feature (321)..(322): n is a, c, g, or t
  misc_feature (347)..(347): n is a, c, g, or t
  misc_feature (355)..(355): n is a, c, g, or t
  misc_feature (408)..(409): n is a, c, g, or t
  misc_feature (420)..(421): n is a, c, g, or t
  misc_feature (440)..(440): n is a, c, g, or t
gagaagaacgagattgctccgcatcagctggaacgccagaacaaggaagcttagggtcaagctgcacgagatggagggcactgtccacgtccaagtacaagggcctccatcaccgtcctcgaaggccaagattgcacagctggaggagcagctggacggacgaggaccgaaggatgcgccaggcagactgcatgacaggtgcgtcggaccgagaagaagctgcaggatgtgctgctgcaggtggatgacgagcggaggaacnccgagcagtacaaggaccaggccgacaaggcatctacccgcctgaagcagctcaagcgnnagctggaggaggccgaagaggaggnccagcggncaacgcctcccgccggaactgcagcgcgagctggaggacgccactgagacgcnngatgccatganncgcgaagtcagctccctanagaacaagctcaggacgcggggaccatagacgtaatgtcgtgccccggcgaatggaccggaaaggcgcggggatggctccggaggaaacaggtagataggaaagaggcatggggcatgaggccaacacatgacgacctaaaccctctatctcctgaagcctgagatggatggcacagaacgactgcacagctcccgaaacacaagaaccaagcaggaaagaacatactaacccaggcagacctatgagaacagatcgagaaaactcgcccacacagggagcaacaaacacgaagaaccaagaacaagaagccagacacgggagaaacaacagggaaaccaaaacaagagtgaggccacatgcgacgagaacaccgccacgaggaccaggggaaacaacacaaacacagcacaggacaggggaaagagagaacacgacccgaggaaacacatgggaacaatcaaaaagagaaaaaaggagaaaaacggagaaaaaacgaagagacacagcagagagaaagaagaaagaaaacaccagagacaaacaacacagagaaaaca

SEQ ID NO: 681158 - DNA, 551 bp, Homo sapiens
  misc_feature (129)..(129): n is a, c, g, or t
gaatccgaagttggaccccggggggcgaagggtgccggtccgggtcccgtcagcccctccaacgggagaatcagcgcccttacggcgaaggcggcatgcgttccttcggacgattgcattttgtgttgnttaagggcctcccccaggggccggcgggcccccacccttccgggggccaaaggaatttcgtgctttttgggtttccccccacgcgcctccccggattttaaggaaaacaaaacccatcggcgggccctggggcctttattgccttcaaacttggggttaggttaagcccctcgggagaaaaggggggctcccctttgcccccccactagtcccccaaaactttaggggggggggttcccctcggggggttttttttttttaaaaacccccctttttaaaaaagggcccggttggggcttttccaattttttagggaaatgctttggtttgtttttttccatgatccccccccgaaaaaattgtttttccaaagttttgggggggcggttttttgttttttaaccaaaaattttgatggggga

SEQ ID NO: 681159 - DNA, 515 bp, Homo sapiens
tagagatggtgcatttaaccaagatctgactgtgcacatttaactaccatcaatgaagaggagcaagaatgcagcgtggttgctgaccacataatagtttccttcttgacactgtataacacgtaggaatactgttcacattccaaactacctatgacaatgtgatgtcacacaataaaaaggtgagaggaatctcatgagagactatcctgcatgtagggatactagtgaactcatagccagacggcattttatagggcttgggacaagagatctatactctaaactaacgcattggtgttcaggcttgccatcagaagcttatgctgaccatggcaaaacgacctatccactgtttatcatagggtctattgatatctgtgctggctctgtgcacaacgccaaacattgctacaatggttattgtccgcaagagtcctaggtatatcaagtttatcatcaccagactgtaccttactgatgagtgcctggctaacagctaccttgaaatggtc

SEQ ID NO: 681160 - DNA, 345 bp, Homo sapiens
  misc_feature (173)..(173): n is a, c, g, or t
aatttggttccccttggggttccttttttggtttgaggggccttctttgccgggttttggaaccggaaaatttcccttcccccccccacggggcccggggtaaattcccctccccccgggggaaaaaccaccccttgttttgggggggttaaggggggttttggttttccggnggtttggttttttggtttttttttttcccccgccccttttcccctttttttggagggaaagggaggaaatggggacaaggagggggggggggggttttttttttttttttagcccccttcccgggggggggaatttttttttaaaaggggccagaaaaaaggtggtttttga

SEQ ID NO: 681161 - DNA, 94 bp, Homo sapiens
taaagcctttttaacctgggaccccccctatgggttaataaggtttttaaaaaaaagttaaaattttgtttataaaggttaatatttttattga

SEQ ID NO: 681162 - DNA, 190 bp, Homo sapiens
  misc_feature (15)..(15): n is a, c, g, or t
  misc_feature (56)..(56): n is a, c, g, or t
  misc_feature (84)..(85): n is a, c, g, or t
  misc_feature (106)..(106): n is a, c, g, or t
  misc_feature (141)..(141): n is a, c, g, or t
ggggcagccacatgntaaacagacaaggtgagggtcagaggcggtactcggggganagagatgagggcagggaccactctgcanngacgcgcccaggcgcacagcnatgccccctcctagtccttctcttctccgtggctnatgatgtgcaccacgttcttgtagtccaagttgccagtcacgtcagggg

SEQ ID NO: 681163 - DNA, 144 bp, Homo sapiens
  misc_feature (53)..(53): n is a, c, g, or t
tgtctggtgatctagagatccagagacagaggacagtggtcgaaatattgggngacggaaggtgtttgtaatatgcctatggtgggtgattaatgcttgtacattacgtttcacttttaattaattggggtaagggtttattaa

SEQ ID NO: 681164 - DNA, 140 bp, Homo sapiens
cagggtttttttggggcaagcaaggggtggggcccggggtcccctgttttttttgtaagaaggggggggggggggggtgtttttttttccttttggggttttttttttttgggaacccaatagaagattttttgccctta

SEQ ID NO: 681165 - DNA, 135 bp, Homo sapiens
gcaacgatgggaaggagagaagggaaggaggtgaatgagaaagacaggaagaaaattgaaagcatgtgcctggctatgatgacaaagccagaggtgatcatgtcagcagcaggagaggctcataagtggagcctc

SEQ ID NO: 681166 - DNA, 427 bp, Homo sapiens
tacatacaggattggcagtgagagcgtcagagggtggcagaagtatctcacactaaccaggtaaagactacacaagattaataccatccagcatcgaggatatagctgtggatttaacaaaccatgcttactgctaactacaggagttgatgtaaagcccagtccatcttaaagatatgactgcttgaatcagcgatccagataaaaaggacaatatgcacaacctcacactcacaatcctgtaggaaccaagaccagtgaactgatatgacatcagaagacttcaaaattgcggctcctttaggatcccccaacagtgtatctgcactctacttcaaacgtgcctcttcctcagaagtcagagtcacctacacaaggtctgagatgccattctgtcccaaaatgcaaggaacactaaggaagacat

SEQ ID NO: 681167 - DNA, 489 bp, Homo sapiens
gccgggcgcgggtggctcacgcctgtaatcccagctctcagggaggctaagaggcgggaggatagcttgagcccaggagtttcgagacctgcctgggcaatatagcgagaccccgtttctccagaaacaaaaaaaaaaaaaaaaaaaaaaaaaaatttgttgggcggccttgggcccttggaaaaagtttttagaacccatttggttgtggggggggggcccacggaggtaatggtggacacgtgggccacaaggtgtggttcccaaagggaaatcgggcgccggggacatgaggggcggggagtttcccacccaaagtaaaaaaaagccgccgggggggggaaaaccagagcaggtgttctgagacacaattcccacggatggaggcggtctcagggagggcaaatcagccgggctctctactcaacacaggggggtcaagagggaggagctccgaatattcatattcaacgacccggccttgggggc

SEQ ID NO: 681168 - DNA, 727 bp, Homo sapiens
  misc_feature (507)..(507): n is a, c, g, or t
  misc_feature (517)..(517): n is a, c, g, or t
  misc_feature (544)..(544): n is a, c, g, or t
  misc_feature (549)..(549): n is a, c, g, or t
  misc_feature (553)..(553): n is a, c, g, or t
  misc_feature (562)..(562): n is a, c, g, or t
  misc_feature (564)..(564): n is a, c, g, or t
  misc_feature (569)..(569): n is a, c, g, or t
  misc_feature (577)..(577): n is a, c, g, or t
  misc_feature (612)..(612): n is a, c, g, or t
  misc_feature (655)..(655): n is a, c, g, or t
  misc_feature (701)..(701): n is a, c, g, or t
gaatgcccctcaccttgggtcttttgctgtgcctacctatgtatgtctggattgtgctgtgaaacgacgtgaatctaagtgacgatctctgaggattattagtataaagatagacaagtgatagcaccttctaatacttcagatgctttagttggtaatacagacagggtaacctgtaaactatcatcacagagttactgtgactagcaggttcatacacttgtaaccaacatttcacacaagagaaggaagacaattactgtgaaatgaaagcctctgtactcgtaccagtggtactttttagttttacccacgacgaatgttgttatttttagcaaatagaactcaatgcagtgcattggttattaccctgtgtaccttgtccctcattttgctgtgacaccctgaaaaagctgaccacaaatgcagtattatcttgacatacctctgtcctcctcagtgctttttaatgaaatttcacctgccccttgtgttcctgctttgganagttttggcncttaagcatttggcattcttctattgnatggnatgnaattatagnanattgnaggatggnctgaaatgtccacacactttctatgcatacaaatntggtgaattcccaaagtatgctttggaattggtcatagtcttncgtatcatgagtgtgtatcccagaagatacagaatgcggtcatttnacctgaaattatttgagaacactggg

SEQ ID NO: 681169 - DNA, 744 bp, Homo sapiens
  misc_feature (354)..(354): n is a, c, g, or t
caagagcaagtacatcaaagatgtagaaggtaacaatgtatgcaacagctagatataaacttattccaaggtctttaaggagcctagagaaaagaaagatttctcacagacgtgtatgtcgttatctgtttcgtatttcaagttaggaacttgccagtgattgatgttttgaaaagccgattctaaagataataggagttaggaatataaataaagtgtttgctagtgcctgactgaagttcaggcttagaggcttatcgctaagtgataaacttcaccagcattccacgaaaaagctggtatagcttttcttgtctgacttatgtcgtggttgcaccccttcagcaatatggncaagacacaggttatgctagaacgtctggatcaacgaaccatcgtgtcttgcacgtagtcacacaatgttgtttgctgtgtgttgaatggtgaaggaatactgttcggtattacgagaacagaagattggtgactgtacatttatatgcaattttacttttcaagacaaatataaggtatgttagccagagaagtattctaataaatgcgaaacaacagctggagctgctgtacatcaaggacagattacctggaaaacatagtgttccttatgtgtgattgagagccattcagaaggagacttcctttgtgttcagcctatacttttccatatggtataccttgaagtagaaattagcacaccgattggtattttgctacctttgataa

SEQ ID NO: 681170 - DNA, 351 bp, Homo sapiens
  misc_feature (8)..(8): n is a, c, g, or t
  misc_feature (44)..(44): n is a, c, g, or t
  misc_feature (50)..(51): n is a, c, g, or t
  misc_feature (56)..(56): n is a, c, g, or t
  misc_feature (96)..(96): n is a, c, g, or t
  misc_feature (100)..(100): n is a, c, g, or t
  misc_feature (117)..(117): n is a, c, g, or t
  misc_feature (131)..(131): n is a, c, g, or t
  misc_feature (173)..(173): n is a, c, g, or t
  misc_feature (183)..(183): n is a, c, g, or t
  misc_feature (187)..(187): n is a, c, g, or t
  misc_feature (189)..(190): n is a, c, g, or t
  misc_feature (196)..(196): n is a, c, g, or t
  misc_feature (199)..(200): n is a, c, g, or t
  misc_feature (314)..(314): n is a, c, g, or t
  misc_feature (336)..(336): n is a, c, g, or t
  misc_feature (349)..(349): n is a, c, g, or t
ttttggtncaacaccctgacttgactgcgcacggcccaatcctnatggannaactncagcatgcccagcctccatcctgcagccagaatccctggnagtntatttcctgccaggctncagggtttttcccncctaaggctacattggaaaatatgagggtttattttttgttncaggtttttncttntnnatattnttnntttcctgtcacaaaggcaggaggatttttccacttactcatatcgaggccagatttttaaagccagctaaggcagcaccagctgtgcgggatttaaagcctatagctcagctgnaaaaaaaggtggggggcagggnagggaagataaangg

SEQ ID NO: 681171 - DNA, 258 bp, Homo sapiens
ggtctgaccagcttggtcaattcccaatatccatctaatggttcatgctgcaaatcactttcgcagcttccaaaggttcgtcacgtggtacttcacggacgggcgtaatcattggttgttccgctgtatcacgccatcatcggcgctttctaaggcgccaacattgacactcattatcgtccatcgcacggcgcacattaatcaacccgctcagccgacgttagttctttgctgctgcatagtctgcgtgtgcaagct

SEQ ID NO: 681172 - DNA, 1996 bp, Homo sapiens
gatatacaccaaatggccggattattccggttctgagccttggtgcctcaggggtccactggatgttccgataggagtgggtgacagccgtcagttagtgttctcgtcggtgagttctcgagtaggtgcgctagtccgggagtccagggaggtcgtcggcctcggtggacggatcgccaggtggccgtgatcggccagtgaatgcatcagcagggagcgcatgacgtgcgcgaggggcatagcgtgtaagatgagaaatagtcgcctggtacagcgcacagggttcggcttgcgcagacgtatgtcgtcagagtaggagccgtgcagacgattccatgtatctcccctgtgtccatgcagtaatctatgtaactcttctacgttgctgcttgtaccctattatatttcaatgtggtcctttcgacggagggacttcgatagtgcaggtataaccctgatgcacattgagagaggaggaccttacgtaccttgcgataagtgcgaattgcccatatggtttctttagggagaaggaggacctttgactagcaaccccacgactaggcggagagaaaaagaagagaagaaccccccccggtgtttgggccgacagagggacgcgtacagtgaggagaacactagaagtggcggtcttccgacagagagagggaatttacaatagtttacagcacttaaattacaggggcgagcagcaacgtggaacttaacatttggtggaccttacctgaggtagtgagcttactgtgaggagaggaaggtttaccattaggctcggtcattcccctacataaggtggcaaggtgctttgcgcctcacagacgcagagaccgactacccgcgggttgaagcgatgggccccatgtaaccatttccccttttgtgcacgccaacacagtctttccttacacaaaataacaggatatccaccacaagattacgctaggccagcaggaatgggatctaaggtaaggggggagaatgaacgacccattaggagattgacagtgggcaacaagggccacgccacctagacaaacattaggttgtccaccattttaggcgacacgtggttttggaagcgtttgaccaccacgcttagcctgggcactatactggggttggacacttcggtagttaaccttgcccctgagaattaacagccctaaggaaaatacaggcgaataggcttttagtatacttaaggagcacctttctgagtaggtaacgctgtacaaaacactggaagtgagctccttaaaaggaagaagccatggcgatcaactaggaagtacgtatcgtaggggtaaatcaagaatataagtttggcataacatagaccataactaggcccacagctatgagcatcgcaattttgtcgagtcaccttgggtagccacagcgaaatttaggccaaagggggcaggagccgtttatacaaatggcacaatatatgttcaaagaaccccttatggaggggtaaccactaggacaccccccatgtgagaccatatttagaacccgtagagatctagtatgagattcaccacagagtatcccccctaatagaggagagatacacagggaacccgacattgttatgagaagcccccccccggaagaaaccgaacgaaacgagaaacaaggacacagcagaggcaccacacacacagggtcatatctacagccacagctagcgcaactacgctttgaacaaaacaaacaaacaacagacaaacacatacacacaattaaaagaaaaaaacaaaacacccccacatagtgtgaagacgaaaacagaatccattgatacaaccaataaagcatgactctctcacaatacacaatgccaataacaatacatatcaacacaataaacaaataaacacataatacataatacagtaataaacacaatacatcaaaagaaacataaagaaaaaagaagaaagtaaacagaaaatacaattcaaacaat

SEQ ID NO: 681173 - DNA, 412 bp, Homo sapiens
aatggcgacatttcaaatgcgagatagtagtatggtcgtggtctggagtttcagtcgagtagtatgaatgcggtaatagttacggataactatcaatagttaaattaagaatggttatgttagggttgtacggtagcaactgctcattattcatctctatgtgggataattgagagagtatgctgaagattatgctgtagctgcggtttggtttcaatccagcctcaactgcctgctcatgatgagataagatggcacgaaagtgcacgctcatacgtaaaagtataactatatagctggattaggtgtctcatgcgcatgatgctcccagctactcgggatgctcaggcatgacacatcgctggattctgggatgcaccggttgcactgagttgaaatggtcgccaatccg

SEQ ID NO: 681174 - DNA, 538 bp, Homo sapiens
  misc_feature (88)..(88): n is a, c, g, or t
  misc_feature (177)..(177): n is a, c, g, or t
taagtctgggggctgactcagactctgaggtatactgagtatgagcacagcccatgtgggcttccaactctggtcttctctgatgctnggccaggtgtctgtctgactgctgtctggagcgcccatatgagttgacggagctcctgaagaatagctgtgccactgcgctgagactgngtgaggtgtggtctttgaagcaacaatggctggtgcctccaatgggctggctcccagacctccttacataagcaaagcttctgggagccctggttataggaaatcctcaccccacacacctggaggtgtcccccaagacgcaagttgccagccccagctgaaagaggcccctgagagtgaacctgcaagcccacatggggactgcccttttcctggccagggatgcagggtagaagccctgccctgagcagtgtcttttatcctccgctggtcctccagtcacctttaacctctgctgatcctccgggcatgctgtcaggctgagcaaaactctctcctcagtgctcagtggttacagacc

SEQ ID NO: 681175 - DNA, 1396 bp, Homo sapiens
  misc_feature (44)..(44): n is a, c, g, or t
  misc_feature (46)..(46): n is a, c, g, or t
  misc_feature (113)..(113): n is a, c, g, or t
  misc_feature (116)..(116): n is a, c, g, or t
  misc_feature (124)..(124): n is a, c, g, or t
  misc_feature (155)..(155): n is a, c, g, or t
  misc_feature (200)..(202): n is a, c, g, or t
  misc_feature (237)..(237): n is a, c, g, or t
  misc_feature (317)..(317): n is a, c, g, or t
  misc_feature (359)..(359): n is a, c, g, or t
  misc_feature (502)..(502): n is a, c, g, or t
atcagaggatcccggtgttcctttgtctggggtaatcgatacanangatcttttgaatcctgaatccataaattacactttttttttttcaaattcacaaaattcacaggggngcngacggtantaaccactatggggaaacatcccgtaaaccngcctgtggccatgccaatggagtgactgaacgggtgacatctgtnnnagcatgcttggtgtggctggtagaatgccaccgtngtgcatacacttggtacatcaggggtgaagggagggttttctagattatggggggagggtaaaatggggattttttggtngttcctttttggatggggtgtgggggtatagtactcagcttntgccctaaaataacatgtataaaaacccctgaagtatggtgtgggtgtgtacgtgtgagtgtgtgttggtatacgtcgggcaataaaagcttggtcttcgggaacttagtgaatccttttctctttttcctccagaagtattngttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcgacatgcattggtagaatcgtgtgatggtcttttgtgatacttaatttttacatatcccagtctctgtatgtatctgcatagacaaagaaaaaacaaactcctgctcttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccaaa

SEQ ID NO: 681176 - DNA, 1182 bp, Homo sapiens
  misc_feature (44)..(44): n is a, c, g, or t
  misc_feature (46)..(46): n is a, c, g, or t
  misc_feature (113)..(113): n is a, c, g, or t
  misc_feature (116)..(116): n is a, c, g, or t
  misc_feature (124)..(124): n is a, c, g, or t
  misc_feature (155)..(155): n is a, c, g, or t
  misc_feature (200)..(202): n is a, c, g, or t
  misc_feature (237)..(237): n is a, c, g, or t
  misc_feature (317)..(317): n is a, c, g, or t
  misc_feature (359)..(359): n is a, c, g, or t
  misc_feature (502)..(502): n is a, c, g, or t
atcagaggatcccggtgttcctttgtctggggtaatcgatacanangatcttttgaatcctgaatccataaattacactttttttttttcaaattcacaaaattcacaggggngcngacggtantaaccactatggggaaacatcccgtaaaccngcctgtggccatgccaatggagtgactgaacgggtgacatctgtnnnagcatgcttggtgtggctggtagaatgccaccgtngtgcatacacttggtacatcaggggtgaagggagggttttctagattatggggggagggtaaaatggggattttttggtngttcctttttggatggggtgtgggggtatagtactcagcttntgccctaaaataacatgtataaaaacccctgaagtatggtgtgggtgtgtacgtgtgagtgtgtgttggtatacgtcgggcaataaaagcttggtcttcgggaacttagtgaatccttttctctttttcctccagaagtattngttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcgacatgcattggtagaatcgtgtgatggtcttttgtgatacttaatttttacatatcccagtctctgtatgtatctgcatagacaaaggaaacacattgtaatgttttgagttaagatggagagttttcagaagtaaagtatatgtagacaacggaat

SEQ ID NO: 681177 - DNA, 420 bp, Homo sapiens
taatcacgcatatagccccctcaaagctcacacctgggtctgtaccacatcagcgatacttgaacaaagggctggggacccaggtttgaggaatcaacgtctccatacctagaaaggccacagtccacagtgcaactccaagtgtgctccatagactgacagcccacatatattttttaaaaaataggcttaatttttagagcagttttgggttcatagtaaaattgagcagaaggtacaaaagtttcccacatacctgctacccccacacatacacagcttctctcatcgagatcccacaccagaatggtgcgtaggttacaatggctgaacctacattaacacatcattatcacccaaagtccatagtttacactagggttcacagttcatgtggtacattctatgggttgggacaaa

SEQ ID NO: 681178 - DNA, 509 bp, Homo sapiens
tgaccgtgactaagctagcactggccgtcctagtgcatccaattttctatcatgagcatagatccttttatggggagaatgtaaaatcagaaattcactcaagaaaaacactcttcttcctgggctatctttcttctcctagccccagagcagcccaagccacagccatgctgcttcatcttactttgtgtagcccggagaccttgggcagatactccacagagtatgtcttgttcttgtcactgtcaggggtcacttgtgcctaggagggaaggtgggcaacagttagaaaaggcgccgggtgtgagtaaggagcatgctgtgtcagcagggcttctgcaggagctgccaggtcggaaacactgaaggtgctggcgagctcctgtccctcttgcacaacgcccctagagagaaactgcttgaagtcacagaaacaaaaccatgcagcacagaggcataacagagtcaggactctccagtgtccagtgtcaggctggcactctctaagg

SEQ ID NO: 681179 - DNA, 320 bp, Homo sapiens
gcaccgtatattccacaggtgaatgagtatatattagataacagaaaagtgctttggaaaaaaaaaaaaatgacaacaggagtacatacagtgacccaagaagagtgtaccaggaggagcagaccctgaaagctagttagaagctatggaaatcgctatgctttgtgttgtcacaggagtaaaaataggaataccctgtatacaacaaactattgatgggataaattaactaacccttgatcccctttcgcagggcgtttatacagacttctatcatcacaccagctaatctaggttcctcagaacgtttaacctgttac

SEQ ID NO: 681180 - DNA, 1062 bp, Homo sapiens
tgcggccgccaactttttacaccccagggattttctacatttctctccattttatttctctctttaaacatctctactggggaaggtcgaatacaattgtctccatttgacaatattttatgcttgactctctgaaagtcagaaaattataggtgatcccttttcacttctcaaccttccttctcttgcttagaagacttgacattgccgatgcttgttgccagcttctgttactttgtaactatacaaggaagacacccaagagaatgaggagtcaaaaccccattcacttttgctgaagcttggtttaacaagatttacttctagggcagagcagctgagagagattaaaagtaggtagtaggcattcattctaaactgcagacattatgcaaggcatcagccttattttgggctttattataagtgaagggtcttattttgtattacttcctaaagacctaccatttctgtaatatggaataatagtatgtggggtaaaaagtccaaaaactattgtcctttgattttagtttcaaatttaagatgctgatcacttcactaaaactgtaaatcagtagattgatacgcttattgattgcctagaattttattcaattttacccaaatgtattttatgagtcttttattttggcagtatgtattaggaaaaatgcttgttgatttactaagagctgaataataatttattccatgattgattcttaataaaccccattttattgcttttgaaggtgatgcagttataatcctatgctttgtcattctttgtttgcaaatgcacattaattgacaggacaagcacacacccatgactattatctactctgagaaaatggctaaatattaggaagagagtgagttttaaatgatctcgttcacatgcatacagatatgcccatctttggcttttttctttaggagaatatgcattagcttttttaaaagaggcaacgtaatagtctagtacactagattggagaattctggtcctcagatgggggaattttggtcctcctgtaaatccctagataatgtaag

SEQ ID NO: 681181 - DNA, 121 bp, Homo sapiens
ttttttttttggggggtccccccctttgggggttcccccccccccccggggggttttttgggggggggggggggcccccgttttttcccccccgggtttaagcccccctccccccttttta

SEQ ID NO: 681182 - DNA, 106 bp, Homo sapiens
gaatggcccttcctgtatctaaatatctgtgaaaatgagagtacttcctgcatacctctgttgcagattcaactgttttcaggccccaggaaggtaaggtgcgcag

SEQ ID NO: 681183 - DNA, 362 bp, Homo sapiens
gctcgacggcgaaaagcttgctcaccgcaacttctccgcaacgcgcatgacagcgctacgggcacgcgggttggccttgagttcggcttcggaagcgaactgcgctttgccatggattttgattttcggcacaaaggcttcgtaacgtaccggcagttagcgcggcaggttgtcggattcgcccttgaccagacgacgcatgaacaatttgacgatgcggtcttccagggagtggaagctgatcaccaccaggcgaccgccacttccaaggcttccagggcggcttcgaggccggcttccagatcgcccaactcgttgttgacgtgaatgcgcaggccctggaacgcacgggtgtcgacgcg

SEQ ID NO: 681184 - DNA, 321 bp, Homo sapiens
gagctctctctgtggggggcggattatccaccagtaatacccttgggacggggcacacaaggtgttggccctcctacgctctctgtcaccttcccaagaaagggtcaagatgaaacagtgtgcgtatatggtcatggcgcagagttaagtagagctgcgtgtgtattagcaacctatagcctcgcagcagcgtacagacgtgtgtgtactgtgttccatcaaatcttcggtttagaaacaagtggcaaattccagggcggctagtaaacacagggagggaagacagacacaatggaacagcaacaacagaaaacccaagaa

SEQ ID NO: 681185 - DNA, 597 bp, Homo sapiens
catttataaaaatcttaccttatagtcaaactgattaagaaatatatttgtctataaggttttattaagaattgggtttgacatcaataatgcacccgtgcaacagtgacatttggcttatttggtataaaagtcatatgggaagtattggccaaatatgaaatggtatttggttttctttgggctgtatttgtataaatgtgttactggtatgtgttccaaaattataagaaactcctataatgctgatatgacttagtgtatgttattaataattataattgttatgtgaaattattatatgccacaagagtaaccaaatttccttatcaattgtggctttaatagcggctgtcctaaaactttttgccatccataaacaatgttggcttgttttaaccctctttaaaaggtggttttataaccaactataggacttcacaggtgctcttaaatgcaggttttctgataactttggagattgtgacatcagaataagaagaaaaaactttcagaaactcaaagagctgagcctgaaatggttcatgagtatcaaaacagaagtaactgcatggactctgacattatctaattgac

SEQ ID NO: 681186 - DNA, 105 bp, Homo sapiens
agcttactaatgctatttccattttaactggagggcatcttaatagatggaaacgactttgggttggcatcatcaagggtggatccaaagcagttgcctggagga

SEQ ID NO: 681187 - DNA, 198 bp, Homo sapiens
caagtagtataggtgacagcatacaggttctgtatttggattaaataatagcgagtgacattggcagagcacagtccctcatcttatggactgtagcaaacatgatggaattttacttggtgcgcagaagcccatacaacgtcgcttcatctggcaaacctgcttctcaactccggcttccgagtgacactccaccgg

SEQ ID NO: 681188 - DNA, 141 bp, Homo sapiens
cggggactcgtgctgcctgttgggggtggctcagccccaggccccctccagtcaaagcagcagtccccgtggctcggggagggcgctgcggggagctgatcgggcgcgcctggaccgcagagatgggaacgcggaatgagc

SEQ ID NO: 681189 - DNA, 219 bp, Homo sapiens
attctctgtgttgaacgaggtggatgcagcacatgtgtgctcgaccacacaaggttgatgggcgtgtagtgaaaccaaagagcgctgtttctagagaggattctgtaaagcctggatgcccatctaacagatgaagcaaagttattagtaaggtggtcattcaaagccagcatccagcaagaatatcatttgcagagcactactttgcaaaagtcatgg

SEQ ID NO: 681190 - DNA, 190 bp, Homo sapiens
gccgtctctagaggttcccccactccagcctgggccagagtgagactctgttctccccatataatgatggaatcacatggacatccctctgctgtagctccgacgggcggctcgagccagaggatcagcgtgcttttgtgtactgtctggaatactggcctcctcctgctacaggcacctgctgtagccc

SEQ ID NO: 681191 - DNA, 1039 bp, Homo sapiens
tctgggcagggccggtgcgggtcgaggggcgcccgaggggtccgggccgatgcggtggcgcgcagggcgggcagcatccactcgggccgcatcgccgcggtgcacatagtgcctgctgagcgtgctcatccgggccgctgcctgtccgtgttggacccgcgccagaggttgcgacgagccgtcgtgtgcacacggaatccgtggagaacccagagcagctgttgccccccatcgatgtcctctggatcaaaggggcccagggaggtgactacttctactcctttgggggctgccatccgctacgcggtctaccagcaactgcagcgagagacatccccggcaagcttgtccagtccactctctcagacctaagggtgtacctgggagcattccagaccagacttgcagtagcagcctccttggcacctgctgccagcttcaagagcccagaagacacacctggcctccagcaggctgggccatgcacgaagggatagcaggggtgcattctctattgcaccttggcgagagggtctgacctctgggaacccctctcaaccagttacaagggccttggactcactgtacagtgtgggagccccagttcccaactctgtgacaatagggatcatgggccttaacccttgaaagcattaccgagaagggagaacaagaagatggggcttgaacgagccagttgctgccgggtcaaaatttcccacggaccaagcgatccctctgcatttaggtctatgttaacctcttaatttggactacatttaagggtttgcaagggcaaacgtgagaaaccgttgaattggcagcaggggtttaaaccatcagacaaaagactgtgttttccacataagcgatggattcttgggagaatgctgtgtgtaatgagagaataggtagcaaagaagtcacgagaacggtgacacggcgaacagacttatggcagaccattgaggacgaaatacaaagagagcacatgaaatcactgggtaccagaaaatgttcgtcagctaacacagaaaaa

SEQ ID NO: 681192 - DNA, 1123 bp, Homo sapiens
tggcactctcccgagctgcgctagtgcgggcgccacggctgcccggcgaaggaaaccgaaaccgagtccgggcccgtccctccgcggccccatcctgccctggtgcaccctggggtcgcgctctgccagtgccgctggagcccagagctgcgcgcacgaaccgtgcgccgtggagggcgtgggcgtggcgccgaagggtccctgggtcttcgacgcctctgcgggcgggttcctccctccttgccagttggatccctgggcgggtgcgggcccggccccggcccgtgagctggcgcacagacattgggcctgctgctgcttctacacggggggcacgtttgtccctgctcctgctggtgaccagctgtccccgctgcttggtggccccgggtcattccacggaaggcttgtagcacccaggagttatcgagcaagcacacaattggtcgtacggacctggctacgtgacggcatttggacgtcctgggcacacgcccccctctgcctgttgctctacttcaggttctatctccttcacctgtcacccatttccgcagaaggagaaatccttcaagcaggtggaaggacgccccctcgtgagttggacgcaacgtgtggcggcccaatcacgaccgcttacggggcgcaacctcgggagacgcgagacggcacacagttattcccaagttgggaagcatacattggcaacaacgaagatattcctgtggcctgctaaaagccaaaacgaaggggcccattagtttgttacgtctgagagacccggaggacccagatccataggatggcgaggcacccgcgcttaagaagattctgacctttagcattcacgagcgcatttaacactagttcgcattgatattagaacctggtcagctagaaggttggatccccagagagtgcggctttaccttcagggggaagcgatcattcgcaaggacccaggtgtcggaaaaggcccctattcaggcagaaaaggcatcctattggatgcaccttcaccgacgggtatgcgacgcaccttggcatctgtggaggctacgcagcaatggcaacttatggtgcccctataatccactgtgtttgcagtggccgcacaagtccc

SEQ ID NO: 681193 - DNA, 1138 bp, Homo sapiens
ccgtgacggcctcccatagcctgccctccgttcacctcttcaccgtcacttctcgtgactgccccaaaggtcccccgaccgccgtctcctagtcgccgcagtcagcacatcctgttcgccgctcagatcgatcttctctcttgagtacgtccgccattgatcgatccgtctgagtcatcctcagcatggtgcgccatagactaccatctcatggacgtcagagtgcgcgtcaatgatagcgcgcgcgagtagtctaagcactagagatgcctctacctggccgtcgctaacagtatatattcctggtcctattgtctttactatctttagatcccgcgggatgcatgtaggcctatctagaaagtagatcatctctggcgcgaaaataccgttgtactttcgacccccaactcgttccatgcagcgcagtacgagcgcacaacagtggccttgcacggaaaaaacctagtagtgggataggccctcggcgaagaaagcgccagaccgcagggggttgcgccactgtacactcttttcccgtattcagttggcataactctaaggaagaaacgcaatgactgggtgcattgcaacttggggccacgagccggggcctgccaagtggcccaatgagcagtgcttgcgcatttacccatattagtgcacagatatacacatgcttgaactccccgatccgaactgtactgtggagacctgggtcaacaacagcttgtgacccaccgttgtatccaacaaaaatttgaaagcccccaacttgatagctagcttgtaaccttttcatttccggatgaccacccgagttccacccttgtacactggcagtcgatgggctgcaccacaggctcaatccatacaggaaatttgggggctgaaccctacggttggaacccaaactttggcgcccaaagactgcgcggaggccggccccggaacactttctctgggcttttgcgccggggaactattccttctttttggaaccaacggcatcaaccccttggggaagacccacgtgcattacattgaacacaggctaaaaggccttcgcgggctaaattttttcccccattaagccggggaggggttgactttcccttgggttcaccccacatgggag

SEQ ID NO: 681194 - DNA, 397 bp, Homo sapiens
caatttacagcgtacgagggttctcctttctttacattcttgccagcattcattattgcctgtcttttgggtgaaagtcattttaactgggatgagataatatctcattgtagttttgatctgcatttctctgatgattgattaatgatgctgggcattttttcatatacctgttggccatttttatgtcttcttttgagaaatgtctattcagatcttttgcccattttaaaatcagattttttctcttgagttttttgagctccttatacattctgggtattaatccttgtcagataggtagtttgccaatattttctcccattctgtgggttgtctctttatttatttatttattttctttgagatagagtctcgctgtctcgcccaggctgga

SEQ ID NO: 681195 - DNA, 886 bp, Homo sapiens
gaataaaggtttgtcacagcagagcaaaagccacttcctcccattaccttacggagtaaccatactgattgaatccccagggacatccatcattgcaatacctcagacttccttccttatcttgcacaccagctctactcatacagctaaaatagtaaaaggctgccataaatggacattaggtatcccaacataaccatctggagtgtgtccagttgtatcttcataggaccaacacaccatcacgcagcatgagtatttatatgaagtagcaattcatccgtggactcggctgtcttgctgactgaactcccacaacatatgatagtaactgctgaccactactacttgcatcaaaccctgaacctgtccgcctactcagctgcacgactggcacatccctaacctgaccctactcaacgggcacactctcgaaatggacacataactaaacaccggaaccactactagcctatccgactatctacatcgctccgcggacctgctggcactacactgtacccagaattaacaacagccccaaccacctacgctcaggccagacatcagctacgcactagaacctcacaccccctgcacctccctgcacaacactccctgccccataccacgcacaccaaaaccgacctccacgagccacaaccaagcggcacatctcacacacaaaaatgcacacctaacgccaccacaacaaccacccttgatatacccagaccaagaatgcacacttagccgttcgaatggccaagccgacaacagaacgcgcagacaaaaacagggcgcgggccgctccaacaacacacacaccccagacgcacccccaacacaaacacgccacacacccacatcacaccacacaacccgc

SEQ ID NO: 681196 - DNA, 252 bp, Homo sapiens
atggtgacctgcccacagtcacctgtccatgccccgaccctgccaactgaggacaggctggcgcctccacccaccctcctgcctcacccatgcggagagcaccgtggcggagcgacagcgcatgcaggaacgggggtctcctctcatgcccgtcctagccggggtgcctatggggacgggcgacgttgatgtgtgtggtctcagaggctatgcttccttaggttacaaaacaaaacagggagaggaaacgca

SEQ ID NO: 681197 - DNA, 191 bp, Homo sapiens
attcttatgtaagatgctgactttcttaacaatttcctcatattctctatcatgagactggtaggtggctgagtgtaatccattttgttaacaccggacgatttagttgtttcacaccctggtgtttaagcacagaagggcatgctctcgcggtctgcccattcttggagatatcagctatacaaattcac

SEQ ID NO: 681198 - DNA, 696 bp, Homo sapiens
ggtatatctcctaatgctatccctcccccctccccccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaacccttgtttgtggaactagtttgtggaagtcggtgtggcaattcctcagggatctagaactagaaatatcatttgactcagccatcccattactgggtatacacccaaaggatataaatcatgctgctataaagacacatgcacacgtatgtttattgtggcactattcacagtagcaaagacttgggaccaagccaaatgtccaacaatgatagactggattaagaaaatgtggcacatatacaccatggaatactatgcagccataaaaaatgatgagttcatgtcctttgtagggacatggatgaagctggaaaccattattctcagcacactatcgcaaggacaaaaaaccagacacccgcatgttcttcctcataggtgcgaattgaaccgatgagaacccattggccaccaggatgggggaacattactacaaccgtggacaagttctgcttatttaaggaagctgcggggatagggtactacacctttt

SEQ ID NO: 681199 - DNA, 109 bp, Homo sapiens
acaggcagcgtcttctccaccacccatacacctagaagaccacccatacagctagaacaccacccatacacctagaacaccacccatcacctagaacaccacccgatca

SEQ ID NO: 681200 - DNA, 802 bp, Homo sapiens
ggcgatgagcccaagagcgagcgcgcatgctacgatagctcgagctctggctccgccgctgcgaccccacctcggcgtcgccgtctgcgcctgcgagatcctgccccgtgcctccccgatgagcgagccccgtgccgccgctatcaccagccggtctaaccgctcggaccaagccgccagctctgaggttctgcctgatgccgaagagcacgaaggacggacggcagggcggttgaagtagaagttgcgggcgatggcccgattccaggctactctatcgaaacttactagtccattcgccgggacggctccgaacgcgagggcgaagtgcctgtctggagtgatcctcacctactgtactcccgcgtctcacatattacgacccttattgagtccagcctctttggccccagggtctttagtcgctcggtgcttgccgcggtctcgtacccgaccggttccgtagggagccccccggagttggttgccccgctgggccctcgcgtagagaccagccaggcacccggcttgctctcctgccttcttttttgcgcaacgccgctccccctggtgataccgaatagagctgcaagtacgtaggtgttcaaggttttctcatccattcagggcgtcctttgggcagccattgtccgatagtgggctcactgtcacgatatgtgtcctatggattttattacttcgaaaatgagaccgagggaaggatgttgttcttagatacatactgtcgtcatcaacgatgtgacctctgaaatttcttgcacagtggtttagattgcctgac

SEQ ID NO: 681201 - DNA, 184 bp, Homo sapiens
  misc_feature (49)..(49): n is a, c, g, or t
  misc_feature (68)..(68): n is a, c, g, or t
  misc_feature (111)..(111): n is a, c, g, or t
  misc_feature (129)..(129): n is a, c, g, or t
  misc_feature (149)..(149): n is a, c, g, or t
  misc_feature (178)..(178): n is a, c, g, or t
atttctacacagcaggcgcaggggagagtttcatcatccccatgatatntgggaatattcctgtttancttcttagagtagttaagaatgtattcagctactatgtactanactgtgaaccgtgtttanaggaaaactccatatttcantcctcttcttgcgcccatccctctctccnctaact

SEQ ID NO: 681202 - DNA, 523 bp, Homo sapiens
  misc_feature (50)..(50): n is a, c, g, or t
actcctgtggcggtgtacaaaagtggagttttgttttggaagtttttgtntctgatttctgggtttcttagttactagccgataatacagaaaaaggtctgaccaggggctttattttcccccaaatttattaatacctaaactagattaatgtaaaagtacaagtcctaaatcttggtactcctgaaggcttgtagttcttctgaagatatatatagatagatagattaacttctgaacatattaccactcaccatctctaccttggagaagcgttagaaccctgctccaggggtctggtgaggagcgggtggctgggggttctctacacagaatttggtttcgtctggctgcttggttgggttttctctctctcctctgctccccaggtttgctctctggtgcttaggagcagccatggcagcctccacatgcagacctcaaccccttgtgtgtgtggcatttgcaaccagtgaccaaccacatctgcaaaacacgcaagaagatacgcaagaagtaaccg

SEQ ID NO: 681203 - DNA, 160 bp, Homo sapiens
agatccccccatggcagccgaacttagtgcggacacccgatcggcatagcttttctacagcccagaactcctgggctcaagcgagcctcccacctcagcctcccgagtagctgggactacaggcacgcgccaccgcgcccggcagccattgggccggctg

SEQ ID NO: 681204 - DNA, 299 bp, Homo sapiens
ggaatcgagctcggtccctgatcatcgtgtcgttacctaacctactgtgttgctgtcaatgatggtgtaacaccaattgtctttaaagcatgatccaggcaatattaatctaaatattcctctaactttgtgatcccagaaacactaattagacctacacttcaggtttccctgttggcgtgacctgagctatactgtacagaattgtgggagaggccatttggtaagccattgttctgaataatttggaggggtgaaatcctaaggtggtggagttgctgcgtggacacgaatgttca

SEQ ID NO: 681205 - DNA, 610 bp, Homo sapiens
  misc_feature (510)..(510): n is a, c, g, or t
  misc_feature (522)..(522): n is a, c, g, or t
  misc_feature (537)..(537): n is a, c, g, or t
ccccatatggaatccacataaaaattattagaataaatgatcagcaaagttgcaaggtacaagagcaacacacaaaaatcagttgtactgctatacactagccaaaaaacaatatgaaagtaaatgaagagaagaatttcatttacaatagcaccaaaaataataaaataattagaaacaaatttaatttaaaaggcacaaggccgggaagggtggctcacacctgttaatcccagaactttaggaggccaaggtgggtggattgcttgagctcaggaattcaagtccagctggggcaacatggcaaaacctagtctttacaaaaaaggcaaaaaattagccaggcatggtgtgcacctgtaccaggtatgcacctgtactcccagctactcggtaggctgaggtgggagaatcacctgagcccagtaagttgaggctgcagtgaaccaagatcgcaccactgcactctagcattgaagacatagcgggaccctgtctcaacaacaacanaaaaggcacaancacaagacttgtatnctgaaaactacaaaacattgctggagtcaattcatgatgacctaaatttttaataacctaaataaacaaaaag

SEQ ID NO: 681206 - DNA, 246 bp, Homo sapiens
agtatgtagactcagggaacaaggttgggtaggacaggaaggcaggtacgaggtagctaggaaagattacgttggctcacagagcagggaagagctggaaggctgacgaataccctccccctgcacgcctcagcttttcctactctgctcagctacggcgggcaactggccgacgcacctgcctctaacagcccactgcctacactaacgcacttgcacctgctgacgcaagcgacactaaaccac

SEQ ID NO: 681207 - DNA, 847 bp, Homo sapiens
  misc_feature (390)..(390): n is a, c, g, or t
taggactgtgaagaaacatggaggccgcgaagtatgacttcgaaattgtactccctgctgtcccgctaggacctccatcttcgtccttcagccatccatcgtgggcgtcatgttcttcgaagcgcgccttcgatcaaggcgcggaggctatctacgagcacagtcaccgaggggaagctgtggaaaacacgtcaagcacaagtatgagaacaagtagttccttggaggtccccatccaggccagaaggaccgcaggtccaggccagcatgctgtgagccgcatgaagttggagccgtcagcttgtagaggatgatgtctcagagggtacctcgttgcactggaccggcaaccaatgtgcagcgtgtttcggctaacgagacaacggggcnttttacgtctagcaaaaacctagacttcctgtgtgaccctttcgttgcttggtagttttctggaaatggtgactcgttctatgctcaaggcagtgctacacgggacaatacatactggtgaaattggcccacttggagagacagataatacacaaataccagagaggagaaaaagaaacggggtggcccggggggccccctaaggtaatttggggcgcgcgtgagggaagaggaatacataggggcgcggattggttgtgaccggtggcgcggccgcgcggagccattcgagagctggttctcctctggacaccccaaggttgtactgcggcgggtccgacagagcggggaggaaaaatgccgagcggggggacaccccactccacagaacgagagggagcaccgaggagaatactggccgaacaaaccgggaggcaaacccggccataaagggccc

SEQ ID NO: 681208 - DNA, 132 bp, Homo sapiens
  misc_feature (36)..(36): n is a, c, g, or t
cgcaatctcatcactggctctcctctctgagctagntggttgaattttttaatgcttaagattgtttttctcttttcacagcaacattttctggaatttttttctgcacagcttttccaaaataaaaacttt

SEQ ID NO: 681209 - DNA, 641 bp, Homo sapiens
  misc_feature (606)..(606): n is a, c, g, or t
  misc_feature (641)..(641): n is a, c, g, or t
aggagttcaagacagcctggcaaacatggcgaaaccccatctctactaaaaatacaaaaattagccgggcgtggtggcatgtgcctgtggtcccagctacttgggaggctgaggcaggagaatcgcttggacccgggaggcagaggttgcagtgagctgagatcgccccactgcactccagcctgggtaacagagcaagactctgtctcaaataataataataataataaataataataataataataataataataaaagggctctggtcagccgggcgcggtggctcacgcctgtaatcccagcactttgggaggccgaggtgagcggatcacgaggtcgggggttccagaccagcctggccaacatggtgaaaccccgtctctactaaaaatacaaaaattggctgagcatggtggcgtgagccatgtctctggccaaaaacatgacttcttcaagccagtttgatgggcgtgatgtgggggagtctcaggttaaatgtcacatatctggggctcgaagatgggaagagtgtgtcacaggtctggaaaccacagtaccttcatcagagctcatagtagggtctgcagagacctctcacatgtnctggccaggtcgcaatggcttacgcctggtttccn

SEQ ID NO: 681210 - DNA, 420 bp, Homo sapiens
  misc_feature (43)..(43): n is a, c, g, or t
aacattctgatctgttattccaggactgttttctttccaatgnactgttgtggtagaataaccccaaaagctcaagctaaaatgcatcatcagtcctagtcggcagttcctttaagaatgggctggggggggggttggagctgatatggaaaagctgcaccttcctgcagaagatcaactgacctgctatcccaccccaaatttcagcctgaggtatatttcagtgaaggcaggtagctgtgcttctcagagcagagaagcagttttaagagcaaaaaggtagaggaaatctagaaaagaaccgtcttgatacagatttatcccatggtgtgaagggagggcaaagaacccagtggcacttcgcttatccagcaatttctgtcactgtggtgaccaacttctgcccgttccatagggtct

SEQ ID NO: 681211 - DNA, 899 bp, Homo sapiens
ccttaatcaaaacatttacccaaataaagtataggcgatagaaattgaaatcctggcgcaatagatatagtaccgcaagggaaagatgataaattataaccaagcatagatatagcaaggactaagcccgtataccttctgcgtaatgaattaactagaaatagctttgcaaggagagccagagctaagagccccggaaaccgagacgagctagctaagaacagctaagaagagcgacacccgtctatgtagcaaaatagtgggaagatttataggtagaggcgacgaaaccataccgaggctggtgatagctggttgtccaatgatagaatcgttagttcaactttaatatttgcccacgagaagcgctctaaatccccttgtacatttaactgttagtccaaagaggaacagctcttgggacagtaggaaaaaaccttgtagagagagtacaaagaatttaacacccatagtagggcctaaaagccagtcaccaattaagaaagcgttcaagcttcaaggaaccactagctagaagaatcccaaacatataagctgaatgtcctcacacccagttggaccaatctatcaccctatagaagaagtaatgttagtataaagtgacgtgaaaacattctccttcggcataaagcctgcgtcagattaaaacactgaactgacattaagaggccaatatctacatcaaaaaaaaagaacaaaaaaaaacaacaaaaaaaaaggcgggggaaagtaacccagggccagagtaccgtccccttttggaaagggccaaggggggttaaaaaagcggggggtaaacggcggcggaaccgcgggtgggaacccctggggaaggccccccgaataggcaagaaatggatgagggggggattagaact

SEQ ID NO: 681212 - DNA, 311 bp, Homo sapiens
gaaattaatagcaagacaccacagatcagacataaacactacaaaccaaaactcctgggctcaagcgatcctcccacctcagcctcccgagtagctagggactacaggcgcgtgccaccacgcccggctaattttagtatttttagtagagacagggtttcaccaatataggtcaggctgatcttgaactcctgacctcgtgatctgcccgcctatggcctcccaaagtactgggataacaggcgtgagccaccgtgcccaaccatgaaatatttttacttaaaaatagggaataagctcgcaggggatcc

SEQ ID NO: 681213 - DNA, 837 bp, Homo sapiens
caggtgctcgaacacacagtaagtccccttggcaggagagagcccagtcaccatccaaggtcccaggtattagacaccgggcctgtctgacttgggtcggtgggtcttcctataacagcagtgaagatggcagcagctgacgaggcttcttgtggttaagcactgggctgtgggtccgacctctcttctgaggctgcttcaagtcggcctgccaagggtcctcgccaacaggagctcggtcgatgtccagatatgaattcgtttcatcaccgcctcatggatctttgtccacgcatggcaatagcacactgtcatcccgtccttttcacttaggccgattctgtatgagaggtgaaaagcagacatgttggaagagggctgtgaggaggacatgagggaacagcttattattaacacagtgagatttaccggctgtgcagttcctacgtcgagtccttgggaaatgaacttcagcgacagattagagggtctcttttcggatagcatggccaaacattacggagcacctggtccacctcctatgtcctcttactggtcccttgggaatagtacttttcaaatctttacgtgtgcctaaggcatcccctaaggagctttcctaaaaactcatattccttggagcccatccccgagaagatctgattcaggggtctgggtggggagaggcagaattgtcaggtttggaaaggctcccaaagggatggagaatgcgaattggtccaggaaggtgggtgttggggtggccctggcttgtggggtgtcaacaattgaacgctttctaggacgtggtggatgggttgcagtgtggcaaatggg

SEQ ID NO: 681214 - DNA, 293 bp, Homo sapiens
cagatggactgaactcagataatagatacggcgcagtgtgtgaatcggctttcggcgccgggattctcacagagatattcacggctcccactccatctccagccaaccggctctcctcgccctccagcagcttgcggtaggtggcgatctcgtatgtccatgggccatgcttcactgctctatgagattcctgtgtactacacgctagctgcctgtgcacatatccatgcttggaccgcgtgcagggctggattccagactcctcactgctatggaacgagcaatccttgagc

SEQ ID NO: 681215 - DNA, 680 bp, Homo sapiens
  misc_feature (204)..(204): n is a, c, g, or t
ctcggtttccccccgcgtccaagttttgcggctcgcacctctcccgggagccatatgaatgttctctccatgctctgagccctaggattcatctttcttttcaccgtaggggcctgactggcacttggtattagccaactcctcccctagacctcggtgctacccgacccgttctacgttgttagctcacttcccctatgtccntatccataggagctgtatttgccctcataggaggcttcattccctgatttcccctattctccggcgtacccccttgacccaacctacgcccaaatcccttgtccctatcgatattcatcggcgtaaatctaactttcttccccccacactttctcggcctatccggatgccccgacgttactcggactaccccgatgcataccccaccctggacatcctatcatctgtaggctcacattcatttctctcacacgccgtaatattaatgattttcatgatttgagaagccttcgcttcgaagcgaaaagtcctaatagtagaaggaccctccataaacctggagtgactatatggatgcccccccccctaccacacattcgaagaacccgtatacataaatttagaccaaaaaggaaggaatcgaacccccccaagctggtttcaagcccaccccctggcctccatgactttttcca

SEQ ID NO: 681216 - DNA, 823 bp, Homo sapiens
tacgtctttcaagtgatgtcttgctgctggaaacacagaaaaatgacatcccgtcttcctatatggcttatttcctcatctccttcatgccagtgctttgggcaacacgaactaggaaagtattcctgctctagatgaggcttcattcttaaagcattgctttgaagagaccgcggtttcaaaaaagcaatagacaatgtgctggagcctgacaaaattcctgggttactaggtgtctttcagaagctgattgcatccaaagcaaatgaccaccaaggttttgatcttctaaacagtataatagagcacatgcctcctgaatcagttgaccaatataggaaacaaatcttcattctgctattccagagacttcagaattccaaaaaaccaagtttatcaagagtgttttagtctttattaatttgtatgcataaaatatggggcactagcactacaagaaatatttgatggtatacaacaaaaatgttggaatggtttgggaaaaattattattcctggaaattcagaaggtatcctggaactgtaggagacaaagatcctgtgccggttggataacaagattactaacagaagtgtcccccaatgatggacactgagtataccaaactgtggactccattataccggccttgatggcttttgagtacccgaagatgatacattctgatgggacatttatgcttgagaatagctgggttaaaggggtcaagtggtttgcgtgaaaaaagctgccggggcagggggtacccaattcggcgctcagggacgcgccggggccccgggcccggggagccttccggca

SEQ ID NO: 681217 - DNA, 441 bp, Homo sapiens
  misc_feature (47)..(47): n is a, c, g, or t
  misc_feature (71)..(71): n is a, c, g, or t
  misc_feature (80)..(80): n is a, c, g, or t
  misc_feature (371)..(371): n is a, c, g, or t
gcagttcctgggggacggtccagcgggggacacagggcctcccctcntgggggcaagcctgccaccatccntacttgccntatctacactcccaatgtggtaatgcccttggaccaccacccacctcctgtccccagtgtccgtcaaccagccctgcctactggggggtggccctgaaacccgagggcccccagggtgctctgcgatctagacgccctcttccaaggggtgccacccaacaaaagcatctacgacgtttgggtcagccaccctcgggacctggcggcccctggccaaggcttggctgctctcctggtgcagctgtgaggtcttaagacaggggccgctcctccctcccgctcccaccccancttgttgacagggagcaagggaggcggctgtctgcgacacagcagctcgaaaaccaggcagagcttgttg

SEQ ID NO: 681218 - DNA, 780 bp, Homo sapiens
ggaggcaggcgcttggaagttgtaaacaccgactttctgagtaagggaggagcactttttttccaaaaaggaaagaacgtctctactgggtttttttcctcctgatattcagcattagagtagaaaagaaactatgtttggccacattagccgtggttagcaggtgctgcagccttggccactgtttatatatttttaaagggcagaaatgcctgcaacggtgaagactttggaccaggcaaaaagctgggaagttatcaattccaaaccagatgaaagacccaggctcagccaactgtatcgcacgaactcatggatgaatctccacgcatatttcttcaagacactgtctcttctttaaacagcagagcccctgcgcacactcttgtctcctggccctgtagtgtgtgcaccatttttacgatcttggcacgttacattcctggggttatacctcagctatctacctgtcactgtgtgccatttcttgtgtcccatttgttttcatgttactggactcttggcccccccccaatttctacagcgacaaattaaggtcagttcctgcttgaaacttggcattctcgaccatcggccgcaatatcattcattccgacaggaaccgtgcagagctcttgaaggcggcatacgaccaaatgtcaccaagatcgcacgtgctttgcatttccgcttcttgtcctaggattagcctccggttgcgcccacgagtattgggtctgccaacgtccgcagatctgggtggtagggccttccctttaa

SEQ ID NO: 681219 - DNA, 871 bp, Homo sapiens
  misc_feature (733)..(735): n is a, c, g, or t
  misc_feature (741)..(741): n is a, c, g, or t
  misc_feature (744)..(744): n is a, c, g, or t
  misc_feature (748)..(748): n is a, c, g, or t
  misc_feature (771)..(771): n is a, c, g, or t
  misc_feature (856)..(856): n is a, c, g, or t
  misc_feature (864)..(864): n is a, c, g, or t
gccctctgtgtcttttttttctttgttttttatcttcttggtccgtctttttttgtcttatggcccccttgtgtttgtttttgagtccttttcttcttattgttttccgttcctttgtcttattcctctgttcttcacccttctattacatgccaacttctgtcagttgccgtttcctcctatcagtagggcacctttggcacaaatgttgtcctccaggtcccagtggactctacagagtgcttgacctcaacacactggattccaggtggactggaccacagagcaggccaagacacgggtactgtataactccaccagggtttggagaatagaaatgaaagccacgtcatattactctagaataaatggtgttttggaaattttaaaattatcatcgaaggtggtgaaactatttcaggccccaatgaaaggaaatcgccagttggggatgaaatcaccacgagcctgtgttttatgatatggttggatgtcccctgatgaaattttaaaggagtttcacgttttaaaagtggcgcactgattctaacatatgagaattctttaggcccagaaactgtccttggctcacgaggtgttgggaattaaagcacgagagaagccacttcgtgatgcttagaacccaggatggtcaatgtacacccaagacccactcgagacggccacttcttgtttaccaaacaccttacccagaaagcactttgtaggggannnttagtnagntctnctcatttcattatgtttcttccnaggaaacaggagagactgaattaataattctctctttcctcttaagcacttttaaaataataaagtacatcttgaaatttggggnggcatctntgattta

SEQ ID NO: 681220 - DNA, 887 bp, Homo sapiens
  misc_feature (73)..(73): n is a, c, g, or t
  misc_feature (83)..(83): n is a, c, g, or t
  misc_feature (293)..(293): n is a, c, g, or t
  misc_feature (295)..(296): n is a, c, g, or t
  misc_feature (319)..(319): n is a, c, g, or t
  misc_feature (321)..(322): n is a, c, g, or t
  misc_feature (351)..(351): n is a, c, g, or t
  misc_feature (513)..(513): n is a, c, g, or t
  misc_feature (516)..(516): n is a, c, g, or t
  misc_feature (532)..(532): n is a, c, g, or t
  misc_feature (561)..(561): n is a, c, g, or t
  misc_feature (565)..(565): n is a, c, g, or t
  misc_feature (585)..(585): n is a, c, g, or t
  misc_feature (656)..(656): n is a, c, g, or t
  misc_feature (680)..(680): n is a, c, g, or t
  misc_feature (688)..(688): n is a, c, g, or t
  misc_feature (727)..(727): n is a, c, g, or t
  misc_feature (771)..(771): n is a, c, g, or t
  misc_feature (791)..(791): n is a, c, g, or t
  misc_feature (863)..(863): n is a, c, g, or t
aatgtacatatttaaacacgtctatgtgttcacacatgacttaatggttagatgacatttccaattttaagtnataccaaggngctcacacttccctccctgggcctgttgagggctgctggggcttgagggggtggtgggcgccgagcaaggcactgtataaataaatgcaaaggccaagagctcgggggaaatgttagtgtacacctctgatcagaaatgtggcaagatccacacgaaaaagtgccaagtttttttcccaagcccctcagccaaagcagggagcagggtananntcctctgaggctgagggagcatngnnccgaaggaccccactttccttcacatttnactggctttggaacagtccccagggctcagctgaaaagggggtagttctttgggaacgagattcatttagtgcaattttctcttagtgcagagccagccctgggattggtgttatgcttttctggggtcactggtctgttcccctaggagccagccagtganagngagaacctctccaggnagctgggcttagaggaaaaagccagaaantgantcctgttcaagttcctgaantgatacactggtctcagaacctcatcttcccaggaggtagggctagtttttttttttaataaaaattttgntttggtttttaggctctgagaggnaatgaccnaggagggaggcccatccccacttggcagtggggtcacantggctgttgaggggccacagaagtcagcttctctgcacatatcnacatgatgcaggtctgcttnctagaggatagaggggccaggggcctgctacgtgcacaggaatggctggatggaggcaccgactgggtcagnagctgtcagcaggtggatcatgtc

SEQ ID NO: 681221 - DNA, 950 bp, Homo sapiens
gccgacctttcgggtttcacgagatgggagagctgggtggacttgtagcttcagctggttgcttgggcatgaacttgctgcagctcacctctttttgtagcaggggctcactaatggtacagcgctgaggcaggcgtcacatgacgacttttgacacactggcgtgcaggtgcttgcgtggcgcctgggcggcttgcacgaacgccacagccgggcaagctgggcgtggctggagcggctctggactttgcgagtgaaggtgcgggcaggcggctcgaggcccctgagctctggccctgggctaccttctcccgccagcagcatgccccgtggcgccaggctgctcatgaagtcgcaggccttgctggggcaaggcgctgggcttggcaagctggacggaccaggtgacgcacgctgctcaccagcgccctggccaccaggcgaggacgctgcacggacacgcccgcacgccttcgcgcactcgcgcccacgccccgccagccggccacctggcttaacgggctctggcaacccccggaaccccgagacgctcgcgggaccacccgcacgcgccgctcccgcgccagcggactcccctggcacacaagaaccccccgcgcggcactgccgcctgcgccgacaagccgacccgcgctccaacccaaccgccccgcggccccaaaggcccccgcccccactccccgcccctccgccccaggaccgccaccccgcccccccccacgcccccccgccacccccccacccggctaccgcgcaacctccccccgcacaaccccccgcaccccgcacccccccccaccccccccgccccccccagacacacccaccccccccacccccaacccgcccgccccaccccacaccccccaaccctcccccacgcccccccaccccccccaccacccacccacccccccaccccccccact

SEQ ID NO: 681222 - DNA, 1111 bp, Homo sapiens
cttattgtttatttaagctacagccaaaaatatttttttttcttattctaaactgagccctatagcaagtgaagggaccagatttcctaattaaaggaagttaggtacttttcttgtattttttaccatatcactgtaaagaagaggggaaacccagccagctactttttttcatcactttttattcataacttcagatttgtaaaactaatttccaaaatataagctgttttcattagccagttctataatatcttcctgtgatttatgtagaaaatgaacacaccccttttccatttaagaccctgctactgtgtgaagagatgatacttacaaggagtgtcattacctgtgagctgactgaatgttggtaggtgctccattacaatccaggaaagtctgtgttactgatatttgtgtggaaatctttatttcacttcaatttaaccattagatggtaaaattaagatgctacttgttggtaaaaattggtggactggtttcaatgggtaaatgtgttgtggcaaattaatgtgttggaatattgctctttgtgaatttgtgcttaagtcaatgaatgtgtagtatctccttctgacaagcattccctattgggattttaaagctatgtgcacagaatattagtctcttctacatgttttatttttctatttataattcccttttttgttgttatattttatacacagaatagatcttttttctaacacatatttgaactgaataacagacttaaagaaagcctttgttcacattgctatttacttttgtgtttgggggaaaatacgagggattgattttaaataaaaaacattccatctttcatttaatatcaatatcaaaagaagaagacaaacatctatctttctcatctatatttaagtacctttttgtaatgtagtatcaaagttttttaggtaatgcaaaattttacaaatcatttgtggaatgaatggtaaaactaatctgatgaaatggaaaattattctgcaatattgtaattcatagtttgacttttcataagcaaataaatccctaggatgtaatcaggacttcaaatgtgtaattaaatttttttaaaaaaaatcta

SEQ ID NO: 681223 - DNA, 951 bp, Homo sapiens
tctctgttattaatacataaatgaaagtaacagaatttctactgtgtatgtttcacagagtagagagaaaagagtgaggcatattctttaatgtgaaaataccagtaaaatctgactcctgttatataataatgaaaatacattgcataatgatgtaacatacaacatattacaggaggagaaaaggtaatataataaaaagataccaaatatggagtgtatacaaataatacttgaacagaatatctaaaatgatacataactgtagaggtaacaatgaataagataaaaataaacatgacacaaacaaagacaatataagatattatataagaaataagaaacaaaagcaaagatcactcatatctatgataaatttccttgttaccaatgttaataaatcagtatgttgacctctaaaaagacagatgctaggacaaacaaagaggattcaaatgcacgtcaagtatgagtactcccatgatcaaattaaaactgacttggaacggataataaatgttggcaaaggactagggcatcaagaacacccagatggtcagattaggaagagattaacaataagataccatccacacaggaaaacaaacacaaaggataaaccaaagtaatgcatacacccaacacgaaaagaggacgcaacagacaaagcaactgaaaaacaagcaagagcaaaaaaaaagcaaaagacgaagaaaacgaacgcacagcaacaaacacgaaggacaagagcaacacaagcaagaaacgaacaaaacaacagaagacagagcaacgatagacacagcaggaagcagacaaagaccagcacagcagaaacagccaagaacaagacaacacaacacacaccaaacaagacaacaataagccgaaagaaacaagaacaacaacagaacaagagaagaagaaacacaaacaaacacgaagaacacc

SEQ ID NO: 681224 - DNA, 106 bp, Homo sapiens
tgatgggacaccagcaatgattgcctcagcagtgaccaccccaacaaggaggccagcagcaacaatggtccacccagctcctcagggaaagccacaaggaggctca

SEQ ID NO: 681225 - DNA, 361 bp, Homo sapiens
gcgttcatagcgagtcgctatttgattccttcgatgatatggctctgtccatatcattgttaaagcatcaattcaccaccgcgttggattgtcacccactacaatatggaacgtgaccgggggttaaaccgtcctgatacaggttaattttaccctattgatcatgtgttgtgcccatggtaatcctgctcactacgaaagagaaccgcaagttcagacatttggtgtatgtgcttggctgaggagccaatggggcgaagctaccatctgtgggattatgactgaacgcctctaagtcagaatcccgcccaggcggaacgatacggcagcgccgcggagcctcggttggcccttatccgag

SEQ ID NO: 681226 - DNA, 93 bp, Homo sapiens
  misc_feature (22)..(22): n is a, c, g, or t
gctcatggcgtggtttattacnattccatctcacaaggcgggtgggcgggtggcagcggcacacgaaatccaagccccttctgtcgtcttctc

SEQ ID NO: 681227 - DNA, 1044 bp, Homo sapiens
agcgggagttacttcgctcggagcgggtgaggggacgcgtgggcgggagcggggctggctcagacgctcgggccccatgaccacgttgttcactgtgtccctttctcctagcgaatgtggcagatgtcatatccaccaacattacatcctgtgggttgtcttaccggtgactcgagcttggacgggagacatgtgactgacttgccgtcggatacacgcgcgcgcctacattaccagattccgtagttagtgaccatgggacgtgtcgtggacactgtgtgatgccatgagcggagcgcaggtgcccacctcactagactgagtaggtttgcgcctctggacgtcaaacaccatgacagcccgaccattgcgacaatagccctcgattttactggacacctggccgtgggcctcctgaaccaaagaattcgaatccgcatttccgtagtcgagagtccgattgggaactttagcgacctagatcggcaccgggcggtaagacgtgcttggtagtggcatgtagcgtctcgtgcttcatgggacatctaggggcgtcactggctcccaatggctagtgcctgttacacgcttgtgctgagaaggacgcaggagcgccttggtgcatgccagcgaggattgaccagtctgctgaagaagtccagtacagaataacgactcactggcttcccattcgtgaggaagccataatgccgctccaccgctattgcgcatggctagttcatttcgcacgtgttactcattcgagcgtgagagcgaattaagtacgccgggagtcgcctttatcaagccctcttcatacccaatggtgcacctcaatatgctgccataacctcacaagtggtgtggctcgcagcatgggggcccaaggtagaattgagcggggacatcgttgggccgtaaatacgttacttgatagatcccatccgtaggcatatccccatttgtggcctttgacaaaaacaggtggggaaaggtatggcccattcccacctgtgcatggccggggtcccctgatttggatcg

SEQ ID NO: 681228 - DNA, 420 bp, Homo sapiens
atcgcaaagatggtgcgggatgccctggacgcccaccaacagtccatccccgctgtcctggagatcccccccaaggggcccccatatgacgccgccaaggtctccctcctgggcagggccaggggcatgttccctgccgaagacctgcgctagggggctcctcatagccctcagcccttcccttgtttccaggcctctccccagggttgccctcagccttttttactttttgagcctttgatttccaattccctgctccttccccctcccttaagagggtaggtgaggcgcttttaggttgctggggctttgctggttaaggaacaggaagcctggccctctccctcccctaccttttccctgggctgttacccagggtcattgttgatgttaaattaaagtcatatttttgcttttcca

SEQ ID NO: 681229 - DNA, 175 bp, Homo sapiens
agagagtgatcgagagcttcgtggagaccctaatgcggggtggtgggcctgcgcagtcccgaggaaatggctcggtgagacccctagggttgctgcgccagatcatcagggaccaccgctggagcaacgcggtgagctgatggcgctgatccgcagagagggcaggatggataga

SEQ ID NO: 681230 - DNA, 470 bp, Homo sapiens
  misc_feature (1)..(1): n is a, c, g, or t
nttggaacatctttaattcactaggttaagcttactttatatttcaagcatattcaactgcttttctctccttgaaaatgtgtacattaggacagggaagaagaactgcttaccttgagcaccagggttccctcttgggcctggaggggccctcaataaacctgaaagagataatcttggcatgttaataattggtcaatttcattacattatatgtctatgagaaaagtttagtacacaccgaaaacatgttaaagataatcagttctatcagagaaaaatctttagagcagcaaaggattacactgttactaatgattctatccaaaataaaactaacggatcaaagataatgagcaagttgtacccgtttctcccttttctccggctggaccaggaattccatcacgtccttggtcacctcttatacccattggtccaggagatcctggaaatcctggaagacctga

SEQ ID NO: 681231 - DNA, 666 bp, Homo sapiens
cctgagattggtgtggtctggtacaaaggcttatacgctatcgcagtttagttctcccgtatgctgtatgtatattgcccgttattagcatgatgtaggtagatcggagatctccaatgcgaagaaaatgcacgccaaagcagatcacatgctttgcgcaatttggaaacgagattcgcgcgtggattatagcgattaaggcaagatcacatgtagcatcggatggacgaagatttccaggaacactgactcaactacgattttttgtactcagtcatgacagtcaacgttcttgatcaatcagggagaccgatgtgctatcaatttacttcggcatacgtattgtcctcttgaaatggcggccacatggcattgtagtctccatacggagaatattactttaatactagccacctactggataccgctagtccctttggctcgggtcgactttcgaagaacgattgggtctcatctaggacggttatgcgtactggatcacatatgtggtatggcactgttgcatcattgtatccatccattgaagagcatcagcaacttttattgccgagagttggtcgaatagattgctcgttcgagtcgaatgtagggtattgcccttggcaatgaggggtccgccctgtgcgctcaaatcttcgtggcata

SEQ ID NO: 681232 - DNA, 345 bp, Homo sapiens
atagtagatgcttattgaggtgtgtcctgtgtcctaagcacagttctgagtattcgtctcttacctcatttaatgatgattcctctctccattggttcgactagatgatgagcactgagggccagaatggttcagtagtgaacccaaggccacacagctgttaagtggcatgagaaagaaagaaactttcattttaagcctcttagatttttgtggattgtttgttactgcagcacgaaccagcccatcctcactgataagagccccagtgtgcggagtggattcctgagccagttaaaaggttgctacagcagtggaggcctggttggagggtggtgacaagcc

SEQ ID NO: 681233 - DNA, 303 bp, Homo sapiens
  misc_feature (157)..(157): n is a, c, g, or t
tgagagaccgtgttgatgggagtggagggctgcaccaagtgtataaagtacctgctcttcgccttcaatttcgtggtctggctggctggaggcgtgatcctgggtgtggccctgtggttccgcagtgacccggcagacaacaaacctcctgtatctnggagctggcagacaagccggggccaaaaaccttctaatgtgggctatctaacttcctcaatcgctggtgggccctggtcaaggattgctccggtgggcttcctggggctggctacgggggccaatccaagggaatccccgggtgcc

SEQ ID NO: 681234 - DNA, 212 bp, Homo sapiens
  misc_feature (160)..(160): n is a, c, g, or t
tccgaacttccggtgagccaggagttagaggtccagtgagcgagatcgtgccactgctttggcagccctgggtgacagagcaagactgtgtctcaaaataaagacaggaacaaaggtatcgatactcttaagtataggttaaattcccacaaaaatctgnttttaaaaaatctttttttttttttttttttttttttttttttttttttttt

SEQ ID NO: 681235 - DNA, 258 bp, Homo sapiens
cgagttgatcacttcacactcagtgagtatgagaccaatctgctacaagacaatgagatcacatctctactagaaatagaaaaattagccaggtctcgtggattggaacagccctcgcggcattttgggaggctgaggtgggtggatcacctgatgtctgtcaggagtttgaaaccagcctggccaacatggtaaaaccccatctctactaaaaatacaaaaattagttgggcatggtggcgggtgcctgtaatccta

SEQ ID NO: 681236 - DNA, 853 bp, Homo sapiens
ctgatgtgggtggtgtcacgcattgcagttaaagctgaacttgtacgggcgtgtagttgacacatgttaatactgtcttatactctcgtagtctcgaatacgctttggatacaaggtaggacttgaagtgtgtatttccttggagagagaagacaagacttgtggtatttaccatcatactaggtacaaagtcttaaatgtgcaccaagaggtagtaggatcaagttattagttgtgatgttctgtaaatagaacgataaagtaccttatttgatatggcatcgaatgtgagttaagcatggcttgatttctgtataatttatctctaaatcaaatgggcagagttgtgaatactatggatgatcggatgtaagtcgtttgagtgagtaagaaaatgatatctatccaagcagcagtctcagcctgcatctagaaacatagtcctaactgcttctatccgtgagagctgtacgtgtcggtccttgccgcatccgatgttgaaatgcgtcgaaagcatcctatcgataaacacgggtctatggtcatattagtttagggagttagaatctatgcgatctgtaatgcatatcgaacaaggaacatccattggggtataagagatagacccaagcttcggacctgggacccctaaggacatatcacttagcaatttatttagtgtaatgagacgactttgctctggattgtgattcttgtccccaaagggcacccaagtgtgtaccaagtgggcttcgtggagcctccttgggattacaatccggggctagatttttcaatgtccatttgggaataaccgtcttcgctagaaacttgaggggaagcgaacaattca

SEQ ID NO: 681237 - DNA, 350 bp, Homo sapiens
  misc_feature (32)..(32): n is a, c, g, or t
  misc_feature (83)..(83): n is a, c, g, or t
  misc_feature (89)..(89): n is a, c, g, or t
  misc_feature (103)..(103): n is a, c, g, or t
  misc_feature (140)..(141): n is a, c, g, or t
  misc_feature (153)..(153): n is a, c, g, or t
  misc_feature (158)..(158): n is a, c, g, or t
  misc_feature (161)..(161): n is a, c, g, or t
  misc_feature (192)..(192): n is a, c, g, or t
  misc_feature (350)..(350): n is a, c, g, or t
tcatcattcaaaataaaacaaaataaaaaaanattaaggcgaagattaaaaaaattttgcattacataatttacacgaaagcnatgctntcacctcccctgtntggacttgggagaagactgggccattctccttacacnnaattggggtggnttttnggntggcaatggacttcctgtaacaacgcatctnatatttggaatgactattaaaaaaacaacaatttgcaatcaaagtcctcggccacattgttaactttgggggatgctcgctccaaccgactgctgttaccttcaccgttccagtttttaaatcctgagttaagctaaagaaaaaaaaaaaccaaaagn

SEQ ID NO: 681238 - DNA, 194 bp, Homo sapiens
tggggactaaaaattctgtaaagagtgattctttttttttttggagagggagtttggttttttggccaaagttggggggttttaggggggttagcgatggaggtggaattggggctgggggtaaaagagtttgagggggggggggttggggaaaactttaatggggtgggaggctgaatattttatgagggaga

SEQ ID NO: 681239 - DNA, 1135 bp, Homo sapiens
  misc_feature (801)..(801): n is a, c, g, or t
atttcaggattaagctggttttctatttaagattcagttaaacacaaactatactattgtttctttgaaacgggtgtagcccctcttgtgccaacaagccactactacaaatgtgtggcgccctttaacagttacaggtggggattattgtaccactcattctcacacaagagctataccatcaccacccgaggtacctcaagaggctctctcctatatcaccactaccaacatccacatattcttacattctctattacaccactacaacatccactatcttgtgctatatacacgtgcctatattgtgacaacacagtgttatatccctcttttatttacacatatctcttacacatatacaagacagatattcgtgcacatatctgtgttacacctcagaggtatagctcctatgagcacaccacaattatctctcgcgcatgtgttgctgtcttctattgcgccaaatatacacccatcattttcacacacacaatgttctcttcttatacatgtgtgttgtgtgtgcaacacccatatttctgtgtccaaatatgtgttgctccaaatatatatgcacaaatcttccgccgtgtgtaacacagagtcgtacccttgtgtgtgcggggcaccaacatcttcccctatatactgagttttgtaccatcatacatgtggtgtggaacatcttctccatgtgccagcacaaccaatgtgcccacgtcttcttaacaaaagagactcatattacgcggcgggggaaatcattatttttatacgcgactgttgtggaaaccncccccaaaagtgataatcctctaagaataagcgccgttgaaacacatgttcttaagttagataacccagaagcgcgattatgttgttgtaaccgaagagaatgctagccactctctatgttgggggaccccacgagaatcacaaatatacatttatgttgtattagacccatattagaggcaattttgtaaagatcgagactaaagcatctctcttgccgcaaaaaaaccactacacgggcattacaacgcgacaattagtactacacaggtggggcacattcacaacaggctgggctggcggtccccttaactgtaacacaaatactaagccc

SEQ ID NO: 681240 - DNA, 364 bp, Homo sapiens
gacagcgggatatgagtgaggcaggttgagctcgctaatcgagggggactgtctcatatggtgtccgaagaaatggtgagacgatctcacagagggactaggctcgaggagggctggagtatgagacattccccctacccctgtgaattagaaaacgtggccaaaatattttttaagaaaatggttaccctgtagttctttaactggacctatgtagacaacatcttacacactggagaaggatgatactatgtgaatctagtaagtctacaggacaatacttctctctttaggctgtcttcttcctctccagggtgatgacaactccgtgagggtggagattatatgtctctcatcatttaag

SEQ ID NO: 681241 - DNA, 164 bp, Homo sapiens
  misc_feature (3)..(3): n is a, c, g, or t
  misc_feature (52)..(52): n is a, c, g, or t
  misc_feature (114)..(114): n is a, c, g, or t
  misc_feature (133)..(133): n is a, c, g, or t
gancttatcacctttcatgatcacgccctcataatcattttccttatctgcntcctagtcctgtatgcccttttcctaacactcacaacaaaactaactaatactcatctcagnacgctcaggtagcgttgantatctgcccggcatcatcctagtcctctcgg

SEQ ID NO: 681242 - DNA, 712 bp, Homo sapiens
ggccctttaattggctaaatctggtagctctttagagagagaagcaaattcacatttgggggtttggacctcccagtaacatgctaggggattcctatgtactctccttgatgccaaaagatggatgttctaaaaccgttttggcccctcaccagttggatgttccctgtccctttgagcctgggtttcctcattttttagggggacatgggaattcctatctcacaggattgtcacaaggatgaaatggagtaaatgtaacggcatatcgtacggggtctgagacaaagcagacacccaacacatgtttgctgctgagtgaaattcctcaccctaagaatgacgctttgttctttcactgaacctgtcaggacccgtccaggctgagaccaggggagcgtgtcattcccacagtggcaggcaacattatggtggcttcaggggctttagggggagcgagcggggaacacaggagctgggctcctggtgaaccatccaaataacagttcaaaggagaatgaggggcctgggtttctgttttttggggttggaaaccacgagcacaagagacttctttttcatttgggcttggccaccatttttaaaaaaaaggcaactggtggcaagaacaaagggagggttttatagcaccacaaaggttttttgggggtttaaaaaaaccgggacaatttaagcacttttccccttgggg

SEQ ID NO: 681243 - DNA, 392 bp, Homo sapiens
cgttccatctgggctgtagaaacccattgcaggtttgtgcatgccagccctgctgttgccgtgagaccacggacaccaaagaggtttgcaggggtacacgtgtcctttccggacaccaaagaggtttgcaggggtacacgtgtcctttcccgggaggcttcagccacatcagtgctgatgtgcctcaaggcacatgagtgccttgagggcaggggcagtggctggatggtgcctactgtaggcctggagctctcttctggcctggtatacagaaggcactcagagagctcatatgggaagtactgggtaggaatttgggcagatggtgcttctagaatattggtggccttgagtggaaagtcttgtggtagtaaaagtaactgaaaatgaaa

SEQ ID NO: 681244 - DNA, 578 bp, Homo sapiens
  misc_feature (337)..(337): n is a, c, g, or t
  misc_feature (375)..(375): n is a, c, g, or t
  misc_feature (385)..(385): n is a, c, g, or t
  misc_feature (500)..(500): n is a, c, g, or t
  misc_feature (536)..(536): n is a, c, g, or t
  misc_feature (549)..(549): n is a, c, g, or t
  misc_feature (573)..(573): n is a, c, g, or t
  misc_feature (575)..(575): n is a, c, g, or t
ctcacgaatcctctcctcttgttcccccctcccccctggcacgggaccggatccactccctacactgccatactgctgttcctccacgcccctccccttgtccctggccacacccggtacctttggggcactgggggccttatcactgggatgcttgtgtatatcgaccccctagccttctctctccccttcccgtcctccccccgaatcaccttcctaggacaccccgaggctgcttgcccagggtcctgttccctgctaactccagagaagcatcccagggctttgtgacagtctctaattcccttcccttctcgttaagaatcatattgtatantagctttcagaccatacagtattcattgggttactccnattattatcnagtagctggaattgtgaaggtcggagtagttagatctttagcttttattccttatttttttgtattactctccatgtgtataaattattgatcatgttgctggcttttataactntaagcgaaggaggagcactgcctcagcctttgcacntggtaatgaagcnctgtttttaaataaaagagagaancncca

SEQ ID NO: 681245 - DNA, 228 bp, Homo sapiens
ctggccggcattctgacctctgatgccatctttttgtatcttgggagtcagtgtgctacccaggttcctgccaagcttggcaacattaagcatgatgttgtactcactgtgtctactgtgttgtatggagctggtccaagcaagcctcagcagactatctaagtgtacttaagatgccttcctcaacagaaaatgtttcagagacgtggcgagaaggtccaggtatgt

SEQ ID NO: 681246 - DNA, 395 bp, Homo sapiens
catacaggatcccctacatggcttgttatacaggatcaccaattatggatttaacacacttccgagtctgataatagtagacacaaaaagataaagaatctctctagacattttcccccatggttccactctcccgctacacacactctccaatggactgctactgatccaagtctatgtcagtttcttggcttcgttgttgagtgtatccactactttgctcgtgttctgaattcgtttccagagctgtcttcgtttgtttctctactgcgggttcatcgaaaattatcaggacaccctccccctggtccaaaatcccatgcaaatttcttgtttcgaatcatctgtgatcctttcctttccacttcggtcttatcgagttcgatccgactaga

SEQ ID NO: 681247 - DNA, 108 bp, Homo sapiens
catgagctggtccttacaattcacgatcacagccaccactcaccctccttaatcatctacttctacctacgcctattttacaccaaccccgtgatcgtggggttgtaa

SEQ ID NO: 681248 - DNA, 642 bp, Homo sapiens
  misc_feature (401)..(401): n is a, c, g, or t
  misc_feature (439)..(439): n is a, c, g, or t
  misc_feature (449)..(449): n is a, c, g, or t
  misc_feature (564)..(564): n is a, c, g, or t
  misc_feature (600)..(600): n is a, c, g, or t
  misc_feature (613)..(613): n is a, c, g, or t
  misc_feature (637)..(637): n is a, c, g, or t
  misc_feature (639)..(639): n is a, c, g, or t
ctcacgaatcctctcctcttgttcccccctcccccctggcacgggaccggatccactccctacactgccatactgctgttcctccacgcccctccccttgtccctggccacacccggtacctttggggcactgggggccttatcactgggatgcttgtgtatatcgaccccctagccttctctctccccttcccgtcctccccccgaatcaccttcctaggacaccccgaggctgcttgcccagggtcctgtttccctgctaactccagagaagcatcccagggctttgtgacagtctctaattccctgggatgtttccctgctaactccagagaagcatcccagggctttgtgacagtctctaattcccttcccttctcgttaagaatcatattgtatantagctttcagaccatacagtattcattgggttactccnattattatcnagtagctggaattgtgaaggtcggagtagttagatctttagcttttattccttatttttttgtattactctccatgtgtataaattattgatcatgttgctggcttttataactntaagcgaaggaggagcactgcctcagcctttgcacntggtaatgaagcnctgtttttaaataaaagagagaancncca

SEQ ID NO: 681249 - DNA, 238 bp, Homo sapiens
  misc_feature (47)..(47): n is a, c, g, or t
  misc_feature (78)..(79): n is a, c, g, or t
  misc_feature (91)..(92): n is a, c, g, or t
  misc_feature (98)..(98): n is a, c, g, or t
  misc_feature (106)..(107): n is a, c, g, or t
  misc_feature (110)..(111): n is a, c, g, or t
  misc_feature (116)..(116): n is a, c, g, or t
gggggccccccccccccttttttttccccccttaaaaaccccggggncgttcccccccccgggttttttccttgggcnnggggggggttcnntttttnccccgggnnccnnttttnccctttggcctttttgggggcccctttaaaccagttttttccaaaaaaccgggtggggccgggccgggatttcccgggtttttttccccccccgggccccggggggggggggtttttcccca

SEQ ID NO: 681250 - DNA, 212 bp, Homo sapiens
  misc_feature (47)..(47): n is a, c, g, or t
  misc_feature (78)..(79): n is a, c, g, or t
  misc_feature (91)..(92): n is a, c, g, or t
  misc_feature (98)..(98): n is a, c, g, or t
  misc_feature (106)..(107): n is a, c, g, or t
  misc_feature (110)..(111): n is a, c, g, or t
  misc_feature (116)..(116): n is a, c, g, or t
gggggccccccccccccttttttttccccccttaaaaaccccggggncgttcccccccccgggttttttccttgggcnnggggggggttcnntttttnccccgggnnccnnttttnccctttggcctttttcaaaagtttttttggttcccctttttgggggggcccccggggggccggtccgggttttccgggttgccccccggggcccca

SEQ ID NO: 681251 - DNA, 242 bp, Homo sapiens
gtctcgcagtgtccataaagcagcatgtccatcagtcccagtcgtgttgtacaccagcgtgggtactcccttgaggctcagcggggcttgcctggcgaaagcggtgacgatctgccgctgaatcttctccagatcgcaactcctgcactggtctctctgccctcctccacctggtactggcagttggagagacatcagtggagtcaggtcccgctcccacttcataactgctgacatgcagt

SEQ ID NO: 681252 - DNA, 499 bp, Homo sapiens
cacaccagctcggggttgcacaccagctcggggttgcacaccagctcggggttgcacaccagctcggggttgcacaccagctcggggttgcacaccagctcggggttgcacaccagctcggggttgcacaccagctcggggttgcacaccagctcggggttgcacaccagtctcggggtttgcacaccagctcggggttgggtaatgtaaaagtctggatcaattttctatttctgagctaaaatcctgcaaatcctgccaggtgatgggaataaataggatgcgcatcactcagaggttaccttttgggaaagtaagaccaagggagctaaccaaagccaagcaccacgcacccaaatcctggctagcatgactatagctaccagtaatctgggtgtgtcacaagacatcattttctctccctttttggaggaggactcaattacacagcttcaccttagcattcagcttaatgataaggagtccatgcaaccccgag

SEQ ID NO: 681253 - DNA, 581 bp, Homo sapiens
tgagatggagtttcactcttgttgcccaggctggaggtgcaatggtgcgatctcgggtcactgcaacctccatttcctgggttcgagcggttctcctgcctcagcctctcgagtggctgggattacaggtatgtgccaccacgcctagctaatttttgtattgttagtattatttatattattagcagacagagtttcatcatgttgcccaggctggtcttgagctcctgtcagctgttatacttctatgtgttcagtgcttttgggaggggtcagagtggtagcactgcttttcagacacacttttgtgagtgtgatgcttcaggacctccacgttgtcccatttttatttgtggcgcctttatgggctgtagcactctcactgggactgtgtcattcatttggttagttaacaaacacttattggacaactgttgggagctaaccttgccacttgatccaaattgaattagacatgggcttgatctttaatatgctttcagctttggtggaaataaagaagcctaaagacccggctctgttgtttcctgttatctccactttggggcccttgtggccgt

SEQ ID NO: 681254 - DNA, 86 bp, Homo sapiens
  misc_feature (14)..(14): n is a, c, g, or t
tctggacttcgganttgggggtggtcagacaccacaggagctgtcaacctctgcggatgggcaaataaattggtggaggacggaga

SEQ ID NO: 681255 - DNA, 1284 bp, Homo sapiens
  misc_feature (1105)..(1105): n is a, c, g, or t
tggctggtccataagtttattatctatttctgaaaaaatcataaaaaatggcggggttttagctctcctcagcaagcccgctctcctgtgaagcctctgtgaaggaaagctgtgccttctttttggagcatacccgactccttctctcgtgagcaagggcacatttggggcacggttccacctcttcttttaaacttctctttccttggggcctctcttttctcaataaagcgtggattctcctcctcgtatatatagccagccatgtgagcctttctctttattacattctctcctctccatctcagtgtctcgtgggagttatacgccgtgtgtctctttatagtgtatattgtgagagaaaaccgtgtttctctgtgtgtataaggcattcttctcatctctttcttctccattataaggatggcggcatgtgttaatcctgtgcaaccattcctgtgcgccccagtgattggtgccttccagatggttacctctctgtggctttttaaattccccttgggcatttacagaaactctaatacaccgggggggaactcgtgtgtggggctcacgtggtggaggggaattagaacagaggcctctcacatcccaaagaggctctcccttttcaggggcccaccaaaaaaacttcttaagtgtggcccacgtggtgggataagtcctctgtgagcaaagaggccgtgatatctcccaaatatacgccagtgcttgaaacggcccccgtgtgctttgacccattcaaaggtgctctcccaccatttggttattcattcaaccgagttccaccccccaacttgtggccctctcaataggactccttggtcccattgccaaaacccctatttggaaaaaagcccgtggcggggcgccatgcacacactagggccccaggctaacaacttattcgcttgccacgcaaaaactttgggtccaggggcccaaccctttcacaccccataattttgggccaactcccggggttgccacaaacgctggggcagcactcaattcaatatttccccccctttaatagcggcggcgttaacgccactccttgaccgcacgtgaatactctccgtcntcgggccgcccggacactaattacacccgggagaggggggaagccgccataaacactctacaatcctggtctaccaccacgcgctcgccgcgcagattaataccagaggtgacccacctcagcatgctttcaaaaatacaccggcattccctaaacgaaggccgtcacttatcagcatc

SEQ ID NO: 681256 - DNA, 119 bp, Homo sapiens
tgaagtggccgagtgcgtctcctgatgtggcttccttccagcctctaccagccgtgggggcctcctccaaggagcagtgtggttagatgtcctcttgtgcccactactactacgtgcag

SEQ ID NO: 681257 - DNA, 689 bp, Homo sapiens
ggacatgatgcatacagaacggaaggtggacgtgtatggctttgtgagccggatccgggcgcagcgctgccagatggtgcaaaccgatatgcaggtatgtctgcatatacctagagcccttctggagcattatctctatggagatacagaactggaagtgacctctctagaaacccacctggcagaacatttacaacaaaatcccatgcggaccagcaacgatggattagaggaggagtttacacgcaagcttaaccgtcaatcaacaattccaggaatgacaacgtatgcgtgcactggaacgaccttccaggcaacatgtacgaagaaccgtgtcttacagatcattccatactgaatacaacagagtgatcattccagcttacagcggggcgaacgagaatacatgactatgtgaacgcactccttgattgactggctaccggcagaaggactcctatatcgccagccagggccctcttctccactacaagttgaggacttctggcgaatgatctgggagtggaaatcctgctctatcgtgatgctaacagaactggaggagagaggccaggagaagtgtgcccagtactggccactctgatggactggtgtcctatggagatattagcagtggaactgactgacaggaggaggaatgtgagagctacaccgtccgagaccttcct

SEQ ID NO: 681258 - DNA, 82 bp, Homo sapiens
ggaggggaccgcagcatccagccctctaaggccgggcagcggtcgcgttggggcagagcgcagcgcaagcaggctcagtgta

SEQ ID NO: 681259 - DNA, 158 bp, Homo sapiens
cgctaaaaagggtcagtatggtcaagatgacagtgtcagtaaatctggcaagacagtgatgtaaagaatgttcatagatttaacgaattatctaacaatattttaaaaactataaagctgcaacacatgatttttacaccttagttactcagaaaact

SEQ ID NO: 681260 - DNA, 398 bp, Homo sapiens
gaaccgggtaacctttaatgaccttctaatcctctttatctggtctcataacaggggcgtgtttcgacaacatgcacccaggactgacgttgcgcataggatgtgagacgtcggagacagacacattgcagccatgctgtgcaacgcttatacatattctcataagcagcgtaccatttaacatcacgttaaactagcgaatgaagcaactgagtttgcagagacttcagatgctgatgacggagctgaagattgtctcaaatgactgtgcacactatatcgggactagctatgcacaggtgcaagtctccttgcctatggtgagaggagttgactgtggcgcagccctagaacctgagagacttgaatgctcatagcgcacagatatacccctgcct

SEQ ID NO: 681261 - DNA, 417 bp, Homo sapiens
ccttcggctggaagccgcctttggcttccttcttttgaggtttgggatccgatggattctggctactcaccttgcaaggtctattgtgggacctcatttggatcatgtctcatatggagctcaaactgggcttgagctcctggcctcaagggatcctcccacctcaacctcttgagtagctgggactacagctgcaagccatactgcctggctagttatctttaattaatgacatttgttaaagtaacacaagcatcctataaacatttgcctgttgaaactttctgataatgagaatgaagcaaagatgggagtctctgtctcattgaaaatactcagggataatataataaaaacagaaaagcaatggtgcagtaaaagaattattagaagcctaataaaagtattgggacctcc

SEQ ID NO: 681262 - DNA, 335 bp, Homo sapiens
agacgtacctaattattatggatgatataaaacttaactcacgaaagatgaggccaggtgcagtggctcatgcctgtaatcctagcactttgggaggtcaaggcgcgtggatcacctgaggtcaggagttcaagaccagcctagccaacatggtgaaaccctgtctctactaaaaatacaaaaattagccaggcatggtggtgcacgtctgtaatcccagctacttgggaagctgagggagaaaaagcacttgaacccaggagatggaggtttcaggggagccgagattgtgccactgcactccagcccaggtaaccagagcaagactctgtctt

SEQ ID NO: 681263 - DNA, 1463 bp, Homo sapiens
  misc_feature (336)..(336): n is a, c, g, or t
  misc_feature (925)..(925): n is a, c, g, or t
gcatcccggtggggagaagggccaggcagagaaaagtagtcagaaacagagcaacaggtgaggctgaggcaggagattgagctgacactcaagccaaggaagggggaattaggaaacaattagaaaaaaagtaaagacagtgaaaaagtcagagacagctgcctgcacctacacacacattcagagacagagtcccagagggtggcatacacagagggagaaggggagggaacaggtgtggagaggagctgcggaagcagagaaatctcaagtcagagattcagggacacttggtccccgtggcgagccatggaagcagaaaggaggcgccaggcngagaagccaaagaaggggcgagtcggcagcagcctgttgcctgagagacacccggccactgggaccccgaccaccacggtggactcgagtgctccaccctgcagaaggctccctggtgcaggaggggggagatcaaggttctccccgcaaggaggacagaggggccgcccgcactcccggcgccgccaccgcaccaccttcagcccagtgcagttggaacagctggagtcagcctttgggaggaaccagtaccccgacatctgggcccgagagagtcttgcccgggacactggcctcagtgaggcccgaatccaggtctggttccagaaccgcagagctaagcaacggaagcaagagcgctcactgcttcagcctctggcccatctgtctcctgccgccttttccagcttcttgccagagtccactgcttgcccctattcttacgcagcaccaccaccaccagtgacctgcttccctcacccctacagccatgccctcccttcccagccctccacaggaggcgcctttgctttgtcacaccagtctgaggactggtaccctaccttgcacccagcccctgccggccatntgccctgccccccaccccctcccatgctccccctcagccttgagccatccaagtcctggaactgaggtcaaacaagtaccaccaaggtgatccccagcctgcggccctcgtgaaaagacaagaaaatggggtggcttcctttccatctatgggtgaagcagatgcatggtgagggtcagctcaccgattagaaatttaaaaatgggagatcatggtgaattctcactggggtgattagtggaggaagtctggggaggtgagctactggaagagacagggcaagatgcctcggtggagctgcctgctgaagggtgatattgatgaagacagttgctggtgagtggagatgattgaagggctaggaggtgagggccttcattaattgagatcacgattgaagaagatcccagctctttctggctgatttcagtaaggcttctgacttaagagtctacctatacatcccttccccattgcccaccccgccatctcaatcagtcactgacttttgtttattctgtcctagaatacctttttt

SEQ ID NO: 681264 - DNA, 840 bp, Homo sapiens
  misc_feature (33)..(33): n is a, c, g, or t
  misc_feature (73)..(73): n is a, c, g, or t
  misc_feature (116)..(116): n is a, c, g, or t
  misc_feature (132)..(132): n is a, c, g, or t
  misc_feature (150)..(150): n is a, c, g, or t
  misc_feature (168)..(168): n is a, c, g, or t
  misc_feature (185)..(186): n is a, c, g, or t
  misc_feature (206)..(206): n is a, c, g, or t
  misc_feature (210)..(210): n is a, c, g, or t
  misc_feature (232)..(232): n is a, c, g, or t
  misc_feature (277)..(277): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (292)..(292): n is a, c, g, or t
  misc_feature (295)..(297): n is a, c, g, or t
  misc_feature (299)..(299): n is a, c, g, or t
  misc_feature (301)..(301): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (323)..(323): n is a, c, g, or t
  misc_feature (331)..(331): n is a, c, g, or t
  misc_feature (333)..(333): n is a, c, g, or t
  misc_feature (350)..(350): n is a, c, g, or t
  misc_feature (364)..(364): n is a, c, g, or t
  misc_feature (381)..(381): n is a, c, g, or t
  misc_feature (390)..(390): n is a, c, g, or t
  misc_feature (392)..(392): n is a, c, g, or t
  misc_feature (430)..(431): n is a, c, g, or t
  misc_feature (567)..(567): n is a, c, g, or t
  misc_feature (628)..(628): n is a, c, g, or t
  misc_feature (692)..(692): n is a, c, g, or t
  misc_feature (797)..(797): n is a, c, g, or t
atttataaattagataaacaaaagaaacgattncaacatcacttttgttatgagaaaagaggcaatggaattnaacataagcaaagaaaactctacctggaggaaagaaatcgatnagcgaggaaacaactnggggctgctgccagactnaagggcgtgggggggggngcctcctagaggatttnnaaagcaaacccatccctgcnagancaggaagcagccgttctacctnccagagaaacagacctcagccctaatgatcactcaaatccgagtnaattnctntnttttnaannngntnatacatagtntnccctnccttncccagttntnttggcgacagggcggtnacaggacatatgtnttctttaccagctgctncttgttatntncggagctccagatggtgcgcagggcacgctcctggttnntccgtgccacccggattaggtagaccatggaggctcccaggaagaggattaacaccatcacgaacagccccgccagaaccaccacctttgagccaaggggctggggaggattcttctgctggtggtagcagcgganatgcaggcctcctcagagcggtactgttcttattgccccggcagcctccatagatgaagtnattgcaggagttcctctccacgtcaaagtaccagcgtgggaaggatgcacggcaaggcccagtnactgcgttggcggtgcagtattcttcatagttgaacatatcgctggagtggtcttcagaatcctgccttctgggagcacttgggacagaggaatccgctgcattnctgctggtggccaggtcacccgtggcattctctgtgacagttg

SEQ ID NO: 681265 - DNA, 195 bp, Homo sapiens
agagtttccccccgtcacggatacctcaatgtacttgtcccccgaattgctagcggtggggttggtgcactgcctcctggaccagctgtacgccttcaccacatgtgcgcgagcatgggccatagggatcccatttggcccaggaaccatccacctctgaggaagagcctgttatattccttggtggatccaggc

SEQ ID NO: 681266 - DNA, 1292 bp, Homo sapiens
ggacgcgtggtgtcgacccacgcggtcggtcagcagaggcctcgattcgggcgcccagtggtcctgccggctggtctcacctcgccatggttcgtctgcactctgctagatgcgtcctctgtgggcgtgcttgcatgacgcagctttgtcgcgatccagaacgcactcgcacatgcaatgcagagaaaaaacgagtagcctgaataaacaagtcgagtgctagttctttgtgccagcgcaggacgatgaatacttggtgacgtgacttgtcacatgacgttcagcatgaagatcggaagtgcacttccttggcggtgaagagcgaatttccttagactacctggaagcaggaggagacacactggctcagccatgtcacgaaattcactaggcgaacactcgcaacactaagggtctctcggagtaccatgactagagagggacatcctacagtaagaacagagcaccattctggcatcctgttgacagaaaggcttggtcagctagtacgaagttgaaggcctgatgacgcgcttgtgtccctgcagccgagtccatgcatcggcccgggcttatgggggtcaaggcaggattagctacaaggaggtttctggataccactcatgcgacgccctggcccaggtcatgcattcttactccagatgtggtcatcatgctttcgcaacaaatggtcacccgttgagacaacgctgttgagaccagaagaactgagttgtgcaacaggcagggcaacaagacaagactgcatgtcgtctgtggtccccaggatcggctgagcagccctggatgactgatccccatcatcttcggggaacctggaaggcaatactacaggaagcgagctatatccaacacacggggggcaagaacgcaacccataagggcaccagcccaagacggaacccgggacacacatttcccacaaaaactcccgaaggtcccacacaggagggccagaggaggacaacctacacccggggagtacaccaaccgggggcacccccgggacgagagtgcacaacagccacacaacaaacggcgcagaaaccaaacgagtagcgcgctaacccacccacaaacaggtcgggcccaccgtcgggcaacacaccgcaatggagcgcaacaccaggagctacccacagcagctggcaacgcaagaacgagcaacaaagaagcaataagacagacaagacagatacacgaagaagagacaccacacacgcgacggacaaccaacgcacacactacacctagaacccagcacgacaaag

SEQ ID NO: 681267 - DNA, 115 bp, Homo sapiens
cacatgggagcaaacgacacagggcacaaaggactaacccaggccaaggctccagtctccaggcatgtgtgcccctccttttcagagagtcccacagacagccagatgcatgtac

SEQ ID NO: 681268 - DNA, 329 bp, Homo sapiens
aaaatttttttccttttcgttttgtttactcttttcaagtcttttttaaactactagatacggggtttcgccatcgttcttcaatctcctggtgctcaatgccatctgcccactgtggtctcccaaatatgcatggatttacaggcgtgagctaccgcgcatggactggaacattttctttacatacactggtcttttctccccttctgatcatcagacaatgggatacatttttagaaatcaggtttaagcactactttcagataagcattgcatagttacaacagttacctcaaaatagaagtatgaagagcaagtgagaaatctgg

SEQ ID NO: 681269 - DNA, 367 bp, Homo sapiens
acgcgtaccttgtattgtccagttcacagtagagtagggtagaaggaaagcattctctgcttccatggcttcctgagaaagcccacctgggctgggcgcggtggctcacgcctgtaatcccagcactttgggaggccaaggtgggcggatcacaaggtcaggagttcgagaccaacctagccaacatggtgaaaccccgtctctactaaaaataagaaattagccgggtgtggtggcacgcacctgtagtcccagctacttgggagcctgaggcaggagaatcgcttgaacctggggagtggaggttgagtgagccgggaccgtgccattgtactccagcctgggtgacagagcgagattccgtctc

SEQ ID NO: 681270 - DNA, 963 bp, Homo sapiens
  misc_feature (1)..(3): n is a, c, g, or t
  misc_feature (837)..(837): n is a, c, g, or t
  misc_feature (852)..(852): n is a, c, g, or t
  misc_feature (865)..(865): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaacgggctgccccactgcaagactactggcccacgagatccaaaagtcttcgaccctgagaggagagggagtcggggttgganccgacaaaagtccgngggccacggatancacggccggtgaggctgggcctgatggcgagcgccacctctggagaaggcggggcaggaccgaagacacaggaatggacggcagctgggacacccgga

SEQ ID NO: 681271 - DNA, 107 bp, Homo sapiens
gcgcttgagaatcacttgacatctgggagacggacgttgcagtgagccaagatcacaccagcccaccacactccagacctaggcagcagagctagactccatctcat

SEQ ID NO: 681272 - DNA, 808 bp, Homo sapiens
  misc_feature (1)..(3): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgatttgaggctggagtgcaatggtgcaatcttggtcacgaactcaacctccggaattaagcgattcttctgctcagctcccagtagctggatcacaagcatggcatcaaccggtaattttcattctagtaagacgggtctccaggtgacagtggttcaatctgacccaggatcgcggttcacccaaggggtgacgggggccggccggcagccattaaggggggggcccggggctggagtggggcccggaag

SEQ ID NO: 681273 - DNA, 120 bp, Homo sapiens
gctgggccccccaagagtggtggctggcccaaggcgggagagggggcggtggaaagtcaggctctggagagagtgggcagctcttcgtggaccagcaatgaatacgaagattcccgtcga

SEQ ID NO: 681274 - DNA, 94 bp, Homo sapiens
aactgaaagagattgagcccccacacgagcaattcacaaaggtctgttctatttggtaacccaatacgttcttataaaatccaacccatgcata

SEQ ID NO: 681275 - DNA, 840 bp, Homo sapiens
gaggggtgggaggatcatcagcccggcagtggccctgtggccagcaggtgcactcaagaagctaaggccaggccatctgagcacaaagattgcgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaagcatccaaaaaaaaaacaaaaaaaaaaaaaactttgggggcccgctggggccctggaaaaagttttttaaaaccttcgtttgggggcgggggcccacatgggttaggggacctcggggcccagaggtggcaccgaagaaaatccggggcacagaacaaagtgctgggtttcccccatataaaaaacgcccggggggaaaccgaggttttcggaaacactcccgaagggagtcggaggacatacggggtatctaacacagagtcccagaggatccgaatcaatac

SEQ ID NO: 681276 - DNA, 1354 bp, Homo sapiens
  misc_feature (1)..(3): n is a, c, g, or t
  misc_feature (1079)..(1079): n is a, c, g, or t
  misc_feature (1290)..(1290): n is a, c, g, or t
  misc_feature (1344)..(1344): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 681277 - DNA, 1339 bp, Homo sapiens
  misc_feature (1)..(3): n is a, c, g, or t
  misc_feature (1339)..(1339): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaacacagtgggtggggaccgcacgcggcgcccccgaaaaaagctttaaagcacactcgttggggcgcggcgaccacagagcggtaacgcaacacggggccacaacggtgtcacaaggaagaccgtgggcccagacaccagtctctggcgtttcccccaaaaaaaagcgccggggggaaccgcggttctgaacaactccagatggcgcccgcgaccgcaacggcgcatcaccgcggcgccacggcgcgaattatacgcgccgcgtggacn

SEQ ID NO: 681278 - DNA, 145 bp, Homo sapiens
ggacagacccctgttgcaagaagcacgaacacaccatcaacttgtaggcggccaaggcccttgttgcctgacgaggcccggagcttcttcttgctgcttgcaacaaaggattcgggaggcttatgttcttcttaggggaattgga

SEQ ID NO: 681279 - DNA, 399 bp, Homo sapiens
  misc_feature (43)..(43): n is a, c, g, or t
  misc_feature (85)..(85): n is a, c, g, or t
  misc_feature (94)..(94): n is a, c, g, or t
  misc_feature (114)..(115): n is a, c, g, or t
  misc_feature (119)..(119): n is a, c, g, or t
  misc_feature (148)..(148): n is a, c, g, or t
cctcggtgtccgagtaccagcagtaccaggacgccacggcganggaagagggcgagatgtacgaagacgacgaggaggagtcagnggcccaggnccaaagtgaagctgctcgcnntggnagtgagaggcaggtggcggccggggcaangccagcagtgtctaaacccccggagccatcttgctgccgacaccctgctttcccctcgccctagggtcccttgccgccctcctgcagtatttatggcctcgtcctccccacctaggccacgtgtgagctgctcctgtctctgtcttattgcaagctccaaggcctgacgttttacggttttgttttttaacctgggttttgtggtttatattttcgggggatacttaataaatctatttgcttgtcaagat

SEQ ID NO: 681280 - DNA, 337 bp, Homo sapiens
ggatagccaatcccaggagctgaaattgtggcaataatcaatagtttaccaaccaaaaagagtccaggaccagatggattcacagccgaattctatcagaggtgcaaggaggaactggtaccattccttctgaaactattccaatcaatagaaaaagagagaatcctccctaactcattttatgatgctggcctcatagaatgagttaggtaagttaggtaggagtccttctctgcagttttttggaataattttattaggagtgataccagctcttatttgtacatctggtagaattcagctgtgaatccacctggtcctgggattgggctatcaa

SEQ ID NO: 681281 - DNA, 1412 bp, Homo sapiens
  misc_feature (1)..(3): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaaaaaaacacaaaacaaccacaaacctacacaacacacacacacacacgaagacaaaaaatatctgtggcgggacgccacggtccgccaagaagagagttttcacaaaccaacgacgtgagcgggagccggcgcacacgtagacgattgaacaatcaacctacgaaaaactggttgcccaaagcacatagaaccggctgacacaacaagggggtggtggggctccccacaaaaaaaaaagaacggcgggggacaccgacggtctgttcgaacacccacaaggatgcgtcgcgacctacgggacctacacaacgaggccaccaacggggcggtctaac

SEQ ID NO: 681282 - DNA, 211 bp, Homo sapiens
cacgaaccccaaagtataagaacactcaacagatgccactgaagaacaacgatcatcatacgctagaagctcgtgacacaaacattaacccgtgcctaactggcgaagcagtacactctcggcacttccccctctctaacaacacaactacatcctcccttcttgactgacccacaaagctctggcacaaactcaacgctcacgaggcttc

SEQ ID NO: 681283 - DNA, 218 bp, Homo sapiens
aacacaactttgagagggacagaactgaattcactaacattgaagaacagtaaaggcctatcatctttggatccttcagtatctcagcagttatgagcagaactatgcatctacccatggctctatctttacatcaattaggagtcctggctgttctatttgtaatacccattttgaattgtgttagcttatcttctctattgctaccatcctagtcc

SEQ ID NO: 681284 - DNA, 956 bp, Homo sapiens
  misc_feature (956)..(956): n is a, c, g, or t
gaccggaagtagagtcacggagaggtaggatccggaagtggggctgcctctttaaataacaaaaatctgaggtatacgaagtggagagacaaataagcagaatccacctggtgctgaacccagtataactcatttctacaagtatcttggggagaaaacactggaatcgggtttggtataacacttactgatggtcattcaagcatgactgggacagtttctgaatcagagatttcccaagaagctgatgacatggcagtggaaaaaccgggaacatatgtgggtcgacactgagaaaagcatggttgtcaggagcaggaccagcggatgtatacacggtataattcctctaaagagtcttgtcattgacctttctggaggacaaacacgtgaagggagtgtctcatttcagaagtgtggttccttcaacctagagaaagtttgaaaacccagctgaaaagtcattcagagacactgatgggttatgggttgggcacaccatggcagatcaatcaggccaaacactgaggcacctgcagaaagacaacactgaagggcttctgagacgatgggcatggttgtcagggacgcatttcgaacaaatgttgtgagtgctaaggaagctggcgaagaggtctcatagcgcggataacctgcggtgaatgacacgcacccacacttcccactttgcctatcactcttaatcggttcagaaccagcaaggcctcaacagaagggacctgcatctcgcgaagtagtgacgcgaccacgccagtgacaccgtggtcgaacgtgaacacatgctcctagggggctagccgggacaacgacacctatacactgagcccgatcccatcaaccacaccatcagaccgtggaacacgcgcggagccaacaaacgacatcaggacaaactcaaaaacgaacataacgtaatattagttattataaatagn

SEQ ID NO: 681285 - DNA, 1463 bp, Homo sapiens
  misc_feature (1188)..(1188): n is a, c, g, or t
  misc_feature (1399)..(1399): n is a, c, g, or t
  misc_feature (1453)..(1453): n is a, c, g, or t
gtctgtggaactcggggactggggtcttggggtttcccccttcttgatggggaaactgaggcccagacagggccgcagaaaacagcggactgggatgtcctcccgcaacacacacgcagacatctaaaaatcttactatttagtgaaaaatatttttaatcgtaattacgatttaacagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 681286 - DNA, 117 bp, Homo sapiens
ttgaaaagtatgttggggagaattctctgcgtgaggggaaaacattcagcaggagctgatcgcattataaaaagctgattgtagccccacagcatattcctgatagttgtttctttg

SEQ ID NO: 681287 - DNA, 1053 bp, Homo sapiens
  misc_feature (1)..(3): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttcgtggaataaccatcactgaagacagtcatggagacc

SEQ ID NO: 681288 - DNA, 1577 bp, Homo sapiens
  misc_feature (1)..(3): n is a, c, g, or t
  misc_feature (1302)..(1302): n is a, c, g, or t
  misc_feature (1513)..(1513): n is a, c, g, or t
  misc_feature (1567)..(1567): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtatgtccttcatctctctgacctctgagaaagagaagcagcgatcctttctggctcgcctctgcattggttgctgagggtctgctgagagcccagggtctgctctcttgggccagctccactcctgcacccccgtctcatccagggcctgccctgccctgtcctcagtgctgtgctagcaggaccgcccgtccaccctgtctgtcgggagggctgtcagagggcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 681289 - DNA, 1300 bp, Homo sapiens
  misc_feature (1)..(3): n is a, c, g, or t
  misc_feature (1025)..(1025): n is a, c, g, or t
  misc_feature (1236)..(1236): n is a, c, g, or t
  misc_feature (1290)..(1290): n is a, c, g, or t
nnnaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccgaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaacacaacaaaaaaaaaaaaaatntttgggcggccttggccctgaaaaagttttttaaccctttgcgttgggcgcggggcccccgttggttagtggactgtggccaagagcgtgtcccaggggaaatccgggccaacagacgaaggtgcttggatttcttccccagattatataagagccgcgggggacaacgcatgtgttttctgaacaatctccagagtgaagtcgggagggncaaaagggagcctcattaccaggggtgcccacagaaactagaataaattctcgnggtgtgtggt

SEQ ID NO: 681290 - DNA, 214 bp, Homo sapiens
aaaggagagcaagatgagacaagacagaagacaaggcagtccaaccgatggaaatgaatcaaggaatatctcacatatggaaagctcacacggcgagcaacagggtcacattactcatacatcagccagcagaaaaaatttcgagagcttatcctacacagcaatccacactcaaggaaattctgtggacccggagacccccccgatacagcga

SEQ ID NO: 681291 - DNA, 412 bp, Homo sapiens
tgactctgaggatcgctaaagtgacgcgataggctggataagaaaatgtggtacatatatgccatggaatactatgcagccataaaaagaaatgagatcacgtcctttgcagggacatggatgaagctggaagccgttatcctcagcaaagtaacgcaggaacaaaagtaaataccacatgttctcacttgcaagtgggagatgaacaatgagaacacgtggactgttgagggggcagggggagggaaagcatcaggataaatagctaatgcatgcggggcttaatacccaggtaatgggttgataggtgcagcaaaccaacatggcacaggcttacctatgtaacaaacctgcaggtcctgaccattgtatcgcgtcagatagggggtaccgaaactcgaaatacgaaatc

SEQ ID NO: 681292 - DNA, 129 bp, Homo sapiens
tctcctcctcgatcagaaagacaaatttagtccctttctagtacaggataggctgagtcttcactggtattcaaagacacacttagtaacccgcccagagaaaagaaatggtgccggggtccatctcca

SEQ ID NO: 681293 - DNA, 306 bp, Homo sapiens
  misc_feature (159)..(159): n is a, c, g, or t
tcaggagtggttgaggacacagggccccagcccagccttttgcaccccccagcccggccatttgggccccaagccccctttggaggtttttttttggcctccactccctccccaaaggttttggcacagaacttcattttgaaagggtttttttcattntccaaacctcccccagctttcctccagcccttcccaggggtcagccctgctgtcctgagggtttcctgggccaaaaaaaggagatgggggtgggagggactgagttgatgttgggtttttcattcaataaattggtgattttttcca

SEQ ID NO: 681294 - DNA, 258 bp, Homo sapiens
gatacggcggaaatggcaaacgaactagaattagaagtagtgcctgggccgggcacagtggctcacgcttgtaatcccaacacttcgggaagtggaggcgggtggatcacctgaggtcccgagttcgagaccagcctgcccaacatggtgaaaccctatctctactaaaaatacaaaaaattagctgcgcatggtgggagatgcctgtaatcccagctactcgggagggtgagccaggagaatcacttgaacctggga

SEQ ID NO: 681295 - DNA, 169 bp, Homo sapiens
gcattatgtcagatcctctatagagtgcaaaaagctctcatgtttcccccatcatacatatgcgaagaccattcttgtatgttgagaatatactttaaaattacatcaacaagtggcctttattagaggatccacaattgttccacggatatggccctcctggtttcaa

SEQ ID NO: 681296 - DNA, 693 bp, Homo sapiens
  misc_feature (9)..(9): n is a, c, g, or t
ccacgcgtncgtgcctgtgacgcgcggggcgtgtcggtcctgcctgtaacggcggcggcggctgctgttccagacacctgcggcggcggggcgaccccgggggggcgcggagatgtggccctgtgtagcggcgctgttgctgggctcggcggtgctgcggatcagctcagctactatttaataaacacaaaatcgtgtagaattcacgttttgtaatgacactgtcgtcattccatgctttgttactaatatggaggcacaaaacactactgaagtatacgtaaagtgccaaatttaaaggaagagatatttacaccctttgatggagctctaaacaagtccactgtccccatgacttaagtagtgcaaaaattgcaagtctcacaattactaaaaggagatgcctctttgaagatggactaagagtgatgctgtctcacacacaggaaactacaccttgtgaagtaacagaatttaacccagagaaggtgaaaccgatcatcgagctaaaaatatcggtgtgtttcatgggttttcctccaaaatgaaaatattcttaattgttattttcccaatttttggctataactcctgttcttggggaccacttgggtaattagaaccacttaaataatagatccggtggtatggatgagaaaacaattgctttaacttgttgctggacctagtgat

SEQ ID NO: 681297 - DNA, 209 bp, Homo sapiens
atttgcgaccgcgtcgacgggaaccttgcgctttgcctctcgccgggtatcacccggctgccgatgatcgggatcatcgacgtcggcaaggggagtgctggtttgatatctctgctacgcaacgctcttcccgaggaaaagcggcatttggcgatgagcttgcgtctgcgtatgacgccggagttcgccatcaaccctttggtcgacgc

SEQ ID NO: 681298 - DNA, 188 bp, Homo sapiens
ctagaggatcccccgctccactcggaaatcactcccaggaattggaggcttcagtgctgcagtagggaggggactaaaaacaaagtctgtatattgtgcagtaagacctccgggttctcatcccccatcctgtgtgctctcgtggtgactagcccgtctcctctctccagtgtttacgctgggtacct

SEQ ID NO: 681299 - DNA, 137 bp, Homo sapiens
tacagttatggctgggtcatgacattgtgacccacacatgtgcagctccagttacacagagactgggtctggcacatggagacacgtggaggatggtgcagttcaatgcatgatttcagtggatcaagtaaaaggtt

SEQ ID NO: 681300 - DNA, 394 bp, Homo sapiens
atgaacgtagtccgaggatatacaatctggagttatgcaagagagatcagggctgcagatataaatctggagagatacaacacgcatgtaggtagtatataacgtcacaagacagaatgatatcacagagggagtgattatgaatagaagtgagaagctgtctaggactctgacattaagaagttggaaatatgacgaacccgcacaaggaacactggagccagctagggaaataggaaaaacgaaaaacagggatactgtcctggaagacaaaggaaggatctgctataggaccactactgctaaaaggtcagtgagagctgacaattgaccttggcatatagctcataggacggtcactggatgtctaacgggagaatctacatagggaggg

SEQ ID NO: 681301 - DNA, 245 bp, Homo sapiens
tactcctcatactgcaggttggtgatagtgaagttgagggtgaatggcaccaggagagggccaggggctgtgtggccagggagggaggctggagtcccagaggtttccaggtgcactgcagaggtcccaggaatactggtggttggcacagagctccgatgggtgaagccattgacatagagactgtccctgtccagggtgtaggggcccagctctgtaacgctgttggtcagctggctcaggtt

SEQ ID NO: 681302 - DNA, 1537 bp, Homo sapiens
  misc_feature (523)..(523): n is a, c, g, or t
ggtaaagtcgctggagactaaaaaggcttcggaactccaggaactcagacatccatgagctagcgaccattgcaccaccctggaattgaatttcttctacttgcatatagcgtcttataatttacatctcttgtcaagcatgtgtacgcatgatgtagcctaccagagacaacctcgtctgtactcttagatgaagggattcaggtatttattgtaccgaacatgacctgtggggctattatgcaagcatttccttaggtcattacttttcacttcaaacacaaaaagtatgactacatggcagcgtaacaacgtgcatctctgtgacacgcaaatcgttaacaatctacagtttgatacaatccaattataccattcaatgcaatggtcatagacctagcttggcaataaaaagcaattacgcgaaattacgaacttacatttatccccttgtactggaagattcactccgaaagagattttcaaacttaatggaataaggcacccgctcctcgtgctaaanctttctcggaaggcttgccctagtgctatcaatatcgtctatagcaaaccgaaatttctatagacacccactccattgtactaagcacatacgaaatatttatcacaaacaattacttgcaactcactaacgattattagacagcgataaatatgtggctcaggcgtaacatttcaatattcatactttccaaaatacgttattaattccacaatacggaatttagtgtatgagacccacgttgtagcaacgtggattgagacacgtggttaagacccccaaagatctctggaaaaggtcaaccgacggataggcacctcgtgtaaagcgccttgtagggctacacattgcaacaatctggagttcgccaaaaatacgccgagtttggagattaattccactcttggggggaaacaccggaaatctcgggtcaaaagaaccattttggagccaatttaaaaaggggtgtatggtgtaaagattaaagaaaggtaggggggaaattaattttattttcacgtttaaaaataacctctatgcggaaagttttaagttaacaatgacaatattaagctttaaagatctatacctggttgaaccatccggactcgggtgattcttggggagaatactgcggaaaggggcgggatggtggtaatgcccgtaaacgagattgacctttggaatagggccccttgttggagtttgtccatttttccaaggcacaataacatatctggcacttataggaaagttcactggaacgccggcgtcttgtgggacgagtcgttgtgtctggccctcaacagtggcgcgacccactggataacgtcttgcgactgtgtgcgaacaatcgtaggcaaagcaatttccctctttggaattaacgccccccgaaagtattggtgccgaccacaaaaaacgcgtgtctttaagacgtcggtcactctgtgcaagcaacatcggccgcagagtgttagatcaccagcctctgtggtgcacgaactaagtacc

SEQ ID NO: 681303 - DNA, 585 bp, Homo sapiens
  misc_feature (536)..(536): n is a, c, g, or t
cacttgcgagcataaaacaaaagtactctcaaaggtgctaatagcaaactcaatagcaacatctattggtaagggcatggaatgaccaagctcactctttgtctactaaccgcatgacttttatatgtagggatagcaaagggcatactatgtctgtgggcagatgattttttaaataacaatgtttctttgaactaatattaaattaacaagatcagtgtagtccaaatgtgtgaagaacaatcaatatactttatcatggtttctatttgaaaaaacaaatcttgctatgctttaaattttggagctttcataattgtttaatgcattttaagtgtgaggcttataaatattatgggcttcttctatactacgtgatttctgagtttaaatgtcatacacaaatactaagacactttgcatttttaaaaattaagaatcatttgtgaagtccactacgaggtacttcaaaagcccagtaatggtggtcagataccatgtagatggatacagatcgttgactcttttgaagttgnttttttcttatattttatattaccattaaccaataaaatctggcagaaa

SEQ ID NO: 681304 - DNA, 395 bp, Homo sapiens
  misc_feature (251)..(251): n is a, c, g, or t
  misc_feature (254)..(254): n is a, c, g, or t
  misc_feature (361)..(361): n is a, c, g, or t
attctagaggcagaggcgggcggatcacgaggtcaggagatcgagaccacggtgaaaccctgtctctactaaaaatacaaaaaattagccgggcgtggtggcgggcgcctgtagtcccagttacttggagaggctgaggcaggagaacggcgtgaactccggaggcggagcttgcagtgagccgagatcgcgccactgcactccagcctgggtgacagagactctgtctcaaaaaaaaaaaaaaaaaaaanganctttcattactaatggaggaggagaatgtaaatttgtcagtttatttctgactagggatattttctttccttttagaaaagaagaaaaaaaaaaaaccttactgtcntacagagcggtactagcgtcgtgctgtataaaat

SEQ ID NO: 681305 - DNA, 384 bp, Homo sapiens
aacctggaggctcctgacgcctttgactccagggtgggcgattccgatgctgacccgtcctcctgggctccccccccccgctccccaagtgtcacacaggccctttggacccatcctggttttttaagaaggggacttgccctcaagattcctgttccagggccccggccgtttcggggagaacccacttgggccccgggggcagccggagacccccccgagcccctcctcccagtatttccatccccgcatggttttagggggggcctcttttccgtttttgaggaatttttgttttggggcttgtccttcctttgcagctgttttgaatggaggtttccctttttatttatttgccccttaaagtttataattgaatattga

SEQ ID NO: 681306 - DNA, 81 bp, Homo sapiens
cggggtaagattgtcgaccacgcgctcgctcacctaggtccccattacatttgtacccgtaagcgctacgcgcacctgagc

SEQ ID NO: 681307 - DNA, 930 bp, Homo sapiens
  misc_feature (285)..(285): n is a, c, g, or t
ggaggctgaggcaggagaatcacttgaacttgggaggcagaggttgcagtgagccaagatcacaccactgcactccagcctgggcaacagagtgagactctgtcaaaaaaaaaaaagggggggtttgaattgggtgtccccttaaaactatattttcacacaaaaggattgattacattaggaagcagagtgttaaaaaaacggacaaaattatacgcaaaattagcataaaggtccaggcatatataagggaaggttatatttcagtggtgattttgtccccantcttatttcaaaaggtgtaggagatggttaagcctgacttaaaagcggcaaaaacacaggctctatgctggaccgggtccaataatggggccataccccttagatttaaaggacacaactaggttgaaagggtaaagggtgagatcattgcaatatagggagaggcgggagtacctaatatttaatgtcagacagttttaacggcaaagaacttattactagagagagggacattacttgtattgtgaccaaagaggcgcaattacttgagaaaacagattactttttaaagatattctaacaggagaccccaaaaaatacaggaaggcaaaagttgacaggaatttacacggagagtgcctattcaccaagtagtactgggagaatttcactttcccactttcaatattcaatcggattattcgcatattggaggacattgcaggatattaaagacttcatccggcaatagggagttgacgcactccctttggaccgttttgcaaactccgggcgtaatcgcgtctcacactgtctccatttggacaccattgtttatagccggacgatccgcgttcacattatgcgcaggcgcgtatacacctggcacggcgactcccagaccggcgagcaccacaaacgggg

SEQ ID NO: 681308 - DNA, 295 bp, Homo sapiens
caggctatttgcggtgctttccttgccaaggccgtatctctgtgtttgcaacaaaagtccaaatgggacacaggttccttccgccacacaagactgcaatcaaatgtggcttgtggcctaatgtggtccacggattcatgcgttttttttttttttttctttttttgaaacggagttccactctcatcgcccaggctcgattgcagtgccgtgatctcagcacactgaaacctccgccttccgatttcaaaagattctcatcgtttagcctcccgagtagctggaataacaggtg

SEQ ID NO: 681309 - DNA, 396 bp, Homo sapiens
ccggggggccccccccatttatttgggtttgcccccccctttgggccccccggcttttccctttttgcttccggctcgttttttgggggggattgggggggggaaaccattttcccccgggaacccgttttgcctggtttcggattttttacccccccccttaggggatttggccccccgggcccaaaatttggcccaaggggggtgggggggggggccccccccctttccccccttttttttggttttcaccccttggggtcccccccccccatttttttttgtttacccccggggttttttttaggtgggcccctttttttttggttttgttttcccccctccccccccccttcccttttttaaaattttaaaatttttttccgggttttttta

SEQ ID NO: 681310 - DNA, 153 bp, Homo sapiens
aaccctacacatggatagaggtacgtcaaagggagacaggagccagtggccaaagctgaaaactttcagcaacaaaataaataaataattttttggtatttttgtcttatttagggccacacctacagcatatggaggttcccaggctagggg

SEQ ID NO: 681311 - DNA, 104 bp, Homo sapiens
aggatctgagcagcgtggactaatacctgtctacagataccagcctgtagatccccgtggatgtagacattgccccactgtaaggctgtggctcaccaggcaag

SEQ ID NO: 681312 - DNA, 691 bp, Homo sapiens
  misc_feature (1)..(1): n is a, c, g, or t
ngcacaagaaaatttgtcattggggaaaggccaacttggtggccaccttccccagttcaaaggtttcctcgcaaggccactatgacccgtgccagaatccacagaggaaagtcttgttccattgctttctggcgctcaccccccacccaatgcacagtcaagccttttgttcttctaagcactttcccaccaatgtgtggtaagcagttgtgtcagttggttcccattaagcccttgggttgggaagggccaagcatggggagtcaaggttgaaaccaaaagcctggttgtgattagatggattgcagcatgcttgatttttttcattgaactggtcattccgcaagaggggtgttagaactgacctggcttcttggcaagtgttcagctgagactacttattggccctgagcacagcccaaacacctgcttagtcctgaaaccctgacctgagttgtggagatggaggagacctggaggaaatactcattccattggagaggccttgtctcttctgccttggaagctgccccagttagatgaggagacagaattacgtactcaagagagtaatttgcaagaagcacagctgtgatttcattttccaggcatccttagcctatgtctctagacagtggtcccctcaagggcagtactgagttaatactcttttaccttgcctaacatggca

SEQ ID NO: 681313 - DNA, 203 bp, Homo sapiens
  misc_feature (21)..(21): n is a, c, g, or t
  misc_feature (33)..(33): n is a, c, g, or t
  misc_feature (69)..(69): n is a, c, g, or t
  misc_feature (139)..(139): n is a, c, g, or t
  misc_feature (179)..(179): n is a, c, g, or t
caaagtgtaactaccggtggnatggttcaaagnaaaagatgaggagaaggattaggggcccagattcantaggggtgaatccagagagcagtgtggaaaaaaaaaaccaaaaacccactggaccagtgtataaccactntaagagtctctattaaaattactgattcagaaagaccgtngtgtgaaattcttctttcctgtag

SEQ ID NO: 681314 - DNA, 433 bp, Homo sapiens
aggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtatttgctgctgaaatctgcatatttgggaggcatttcccaccaccgattcacagcccatttgatagtgtgggtagttaggggacttcgtgggagtgggtgttcagacgtccccggggggctttaaatctcttccatatttaggtccattcatttgttaactatggggctttatttggcagggctttcttaaaggggcgttttaactgtgtggagtgggaccaggtgtttcactttttttaaatccaaaa

SEQ ID NO: 681315 - DNA, 169 bp, Homo sapiens
tgggaaggacatcatttaaactctctaggcctccatttccttatatgtacagtggggatgctaatgattctacctatctcatagaattgtgtgagaactaaatccatgaaaaccagtggcacactatttggcaggaacccttaatagctattatattacaacccaacaa

SEQ ID NO: 681316 - DNA, 305 bp, Homo sapiens
tttttttttttccccccctccgggggaaaaacccgggcaaaatttcccttaagggggttagggggcccttttccccaatttccttttgggggggcccttttatttgggggggggggaaaaaaaaggcacccccaaaaaccgcccggggggtttagttttgggttttttaacccggggaaaaaagggccccccccctttggttagggaaaaccctttttttttaggcccccccccccccctttttttaggggtaaatttggggggggggggggcccccttaagaaaaaggggggggggggggcccc

SEQ ID NO: 681317 - DNA, 143 bp, Homo sapiens
  misc_feature (127)..(127): n is a, c, g, or t
ctaaaagtctggaaaacttattgagggaataattgaggaaaacttccctggccttgctagagatctagacatccaaatacaaaaagctcaaagaacacctggaaaactcattgcataaaagagggtnaccgagctcgaaattc

SEQ ID NO: 681318 - DNA, 223 bp, Homo sapiens
taaagtgcggagtttaaaaccggttggttttaaaacaaatctataaaactccttcattgtcagcaaaccaaaaagtccctgcctcaatgaaagttcaaaaaccccctgttacttaaacacgattccgcaaccgttctggttaattttttttggtcattggttacccgaaatggcgtagaaattggttttccggaaggtaaaataaaccaggtatctacttttt

SEQ ID NO: 681319 - DNA, 425 bp, Homo sapiens
gaagaagagaaagaagaaaagttggaagatagtagagggtggtttatgaggtttagggaaagaagccttctccataacataaaagtccaagatgaaacagcaagtgctgatgtagaagctgcaataagttatcaagaaaatctaaaataattgataaacatggttacactaaacaacacatttcaatatagacaaaaaagccttctgttgaaagaagatgtcatctaggactttcgtagctaaagagaatctatgcctggcttcaaaggttcaaaactaggctaattcttttattagggctaatgcagctggtgactttaagctaaagccaatgctcaccatttaagaaaatcctaaggaccttagaatgctaaatctactctgcttgtgttttattggaataatgaagtctgggccagcattct

SEQ ID NO: 681320 - DNA, 125 bp, Homo sapiens
  misc_feature (61)..(61): n is a, c, g, or t
acacaagctacctggttttcacgacaagcacaaataacagagaatgagccagatcacatangaaaaaggctgctataaaaaaaatgcgcgacaggagtaaaagatgctggcgactccacatctca

SEQ ID NO: 681321 - DNA, 119 bp, Homo sapiens
tagaagtagatcatatgtgtggcgattttgttaaatattgtggatgtcttttttctttaactggtcctttgtcgtctcaaaaaagatataaccagccatttgtatggctgaacacaaca

SEQ ID NO: 681322 - DNA, 915 bp, Homo sapiens
  misc_feature (1)..(1): n is a, c, g, or t
ntttcctcatagccacgtatgcttacatattgcgaacgatctcgcgtctttcatccctgctatattgggtcaccccgttcactactttccccgccttttccccaatgtacccctttcccgttactccctctcagccacccttgggaagactctctccacaaaaaaaggggttaataccacccccccagtcctaacagtccctcccttataattacgggtacacaaatttccgtacattaaaagtaaatatttcacacaccacgccgcggaccgcccctgtccacccacaggtcgtgccatttcttgcgcccgacaacactttccacaattaggcgacacttggtgcaccaacctgctgccagaatgggtgggccccacgctttcgtgtaacccagctgggcgcgagacattggtcgtcttactttataaagaggtgttcgccgagaacatgttgccgcccccaccatttgggggtgggaaagcccaccccctgttccggggagaaggagtgacctatatattcacaatgctccccaaactttgtggaggaaatttacaaaggggcgtctccaataatggaggcccaactattgtaggtcactcttcttgtgaaaatagtataccctgcagacacatttcttgcgggcctgcaaaatctttatacacattatagtcccgcgttttgttacaacaaaattctttgctatatatgggatctgttgatatataacatattggatctttgtaaaaatttctttaacgccccaccgccccggactaaccccccctgtcttcttcccattttggtttaaaaccccaatctacttctctggctagcgaccactatatgccacaaagacccccggatccattctcaaccaaaaataaaaaatttcttctccccccaacaaaaca

SEQ ID NO: 681323 - DNA, 224 bp, Homo sapiens
ataacggtaagatacgtgctgtaacggcgtgccacttggctctgggtggccacgatgagaactgtggcatctgcaggatggcatttaacggatgctgcccttactgcaggtgcccaggcgacgattgcccgctggtgtggggcctcactccttgaacttccattcctggcggcacatggtgcagtgttgctgaacctgctgtgcgttgcagccactttgaggat

SEQ ID NO: 681324 - DNA, 896 bp, Homo sapiens
cgatgtgcggagtcacatcttatccgggtgtccgtctgatgataaagatcccgtctgctattactcgtactaaacacattaatagtgatagttcacgagtgccagcgctagcatgactcgaggcgtctctaataccaattagtcacaaccggcaatcgactcataccaatgtgtgacaatgtgctgaaaatctggttcgcactaatactatggtgagagatcgtggtgctcggtacgtgatcagggaagaccatactggaaggtactccggttgcagtagggtgaaagacaacacagtgaagcatcgcatgcagtgtccactcgggatgtcatatcgcaatcgaaggagtatctttgagggcttctaggtgaccttgcggaccactgtgtgtgactgactcctagggccctagaatgcttggctatcttaggcaatgggagtgatgcctgcaccatcatgcatgcattatcattatgtcggaactggagggtggattacaaactaaaatctttagcttgtggctcattccataactccttagttggatcatgttgcccaagaatcaaatacacttttccatttaattgaatccagggaccggcatggttccacacggaggtaccagaatattcagcactataagaaaattagttcacactgttgtgcccttaatgggtcggggagcatgtggtgggctaagcgtgcattggtgagcaacagtcctcgctttgcaacggttaattggaggactcctgtctgatgaacatctttggacgtaggttaaagagcttgaccgtagccataaaaagaatgtggaccaagataagtataggcccgcgacaatccttcctatccggaactaatccctgacagggactcctggggggccacctcc

SEQ ID NO: 681325 - DNA, 317 bp, Homo sapiens
aggttatgtagactcaatcctaactatatgaataatcacatgaaatgtaaatagtctgaatatcctaagttaaaaaacagagattgggctggcttagtggctcacgcctgtaatcccagcactttgggaggcagagatgatatttttatttttgctttttttcagctcttaactccaatggatgcatatttttgtcaagacccaaatcataacttctaaagagatgaaaatataatcactaagggtgaacaaaacagtggcatgagatgacactggcaaattagaccttgcagaaggcaaagatcagtgaacttgaa

SEQ ID NO: 681326 - DNA, 125 bp, Homo sapiens
aggagataggccaagtctagttcattctagggacatgaaaatgggagttctcgtcgtgtgtgtcatgttgccctgagttcccagtttatgttatgtcgttcgaggtcaaaatgacggtgtccggg

SEQ ID NO: 681327 - DNA, 461 bp, Homo sapiens
ggggggaagacgaaactgaaactttttcaggccagcgccggcacagtggccgacggcggctatagctaacgagtacaagagactaagacgaaacagcctaacaacgcgaacaactgaaagagccaagactacgcacaagcccgaagacgccgactgcacgagaacaatgacaacatgacagagcggcagcagcgggcagacgagaacactgaagccgccaagcgcagtgcgacacgcgattacaacccgctagccgttcacatgaggcactgcagcagaggacaccacgctagcgccagctaccgaacagcacaacagaccaagaactgcaagaaactcctacaccatagaacgacagtgagcgtacgcgctcaaggagcggataagcccctgtcaatgtgcccactccaatgacgacgggagacgaacaccacaacgccagcgacagcctcagccccacc

SEQ ID NO: 681328 - DNA, 522 bp, Homo sapiens
ctcacagcctctcctttacatgccacgttctctaaggagcttttttttttcaaaagaaaccacccattgtggctgctttgagacagattttagggggagtttcatgctctataagcctcagtagtgaccagggtgaagggtctgcttaaataccacaagtgtgcccaatgatgggatcaagatgcaaacccaggcctataatagtgactacttttcttttaattttactttgaccagcgcatcttgagcccattacaatgcgcccagcgaagttctaatcattttataaaatgtttagcccttcgatgatcctaacaatcatatgaattcagtatcactattatcctttattcaacagtcaatgcccagttactgagccttttatacctgagaaaagcgagtcaccgagaagctaagtgacttgtgtaaagtcacgccccagagcccagattagaacccaggaactcttgctctggaacttgggcacatagggtccatgttaagctgctctacactgtagct

SEQ ID NO: 681329 - DNA, 156 bp, Homo sapiens
gttcaagcccaaccagacgcggacctacgaccgcgaggccttcaagaagcgggcggcgtgccttattctttccgagcgagcaggaggacgaggtccttcctggttagtagcaaccggtacccagaccatgtggatttgtcccaggaggaggaattg

SEQ ID NO: 681330 - DNA, 248 bp, Homo sapiens
tggccaggctctctacgcgtgcgggtcccatttaacggaaaaggaagctggaggcacagatgtgtacgtccctgagcagggtcgtgtgtccaaggctcggcggcagtggcttgtgtcccaccagacatagttggattatctggaagtggtgactgccccccaaggtgcacgggggtggcacttgtcttccggccccaccgcacctttgtgtgcccccattgaattcttagtgtccccaacccactcgg

SEQ ID NO: 681331 - DNA, 220 bp, Homo sapiens
gaggattccccatcttgatgccccattgtatgcgcttcagactggcccgcctgagagacactaggggaaatagcttttgtgggctagcagggttggccggtggtgctcagcattctttccagtgtctgtgttcctcctccaaatgtggacaggccatgacagagtctgtatcccaatgtccactatgatccccataaagtttctgttcgattagcttcag

SEQ ID NO: 681332 - DNA, 449 bp, Homo sapiens
ttattactgaacaatatgataaaggaaatatccagttttaattaacttatgcaaggaggagtgttgctgggaactgaatatgccataatcctatatcttgtgaccaaaagcagtctcgatgtatttagagccttgagatgttttctgtacctgacacactttgtacatacttgcagcttctctgttcagaacgttaacttctgttctgtggtcttattaaccgtctcaagtagctgatagtccttcgagcgtgttttgtttttcctgcttgatgtggatgatggtttggcataaacccatcttctgcatttggactctggtcttttgtttttggttggatttccggtgcactgcagtgatgacaagggccgcatgaggaattgtatctgtattgcatttagtcactttggacatgacctgtgactcaataaagatttttttccctgtga

SEQ ID NO: 681333 - DNA, 283 bp, Homo sapiens
gtctgtctgcacaccgtcacatttccacaatcgatatgtaccaaatactgtctcggtgtacctgaatcagattcagtctccttcccttctcccgtccccggtgtgacctcataatccgcaagcctcacaggacagactctccgcggccttcctcttacactaatcctcctcagcacagacccttaatgggcatcgggctggggagacggtgaggtctcacccttcccaccactgcctcagccccaccagtgcctcgaagcccaaccactgcctcgggcgggga

SEQ ID NO: 681334 - DNA, 583 bp, Homo sapiens
cccactagatgaaagcgagaatgtggtgtctgtaagaagtgtatctctagcaattctgataagctgctaagcaaggtcgaaaagttagttataaagcattagtattacgtcgtctgcttatgggtagaacatgtagcccgtgtggctttggaacttaataagcctcctccatgaggatctaagtctgtaaagaggatcatactgaggataaagtgtattctgcagatgaaatttagtgtactgtataactctttcaatgacatcctcaatgtacacggctgagggcatgttaggggatgtcataagtgtggatagttgtgggagaagcatccgctgatgcggtaactctctccataataaggtctctcgataagctatcatcttcatcagtatcgtaataatgaggtagcaaagtggcaagcttagaaccatcgggaatattcttctcgaagatatttgagacgttcaggagagggtcagtcgaaagcttatccagttatacccatgggttatattttagcagattcactgcccagttcattaagctgatgtagcctaagagcagtcctgaggaattcatcat

SEQ ID NO: 681335 - DNA, 230 bp, Homo sapiens
ccactgctcatcaattagcggtgaaagtgtaggtttagacgtccgggaatagcatctgttttcaagcctaatgtggggacagctacatgagtgccacgacgtcttgtgatgtaattattactacgaattgggggcttcaatctgggagtactactacgattgtcaacgtccaggcagtcgcacggtcgcctgagttctagcgaataactgggggaagtatgtagagagtt

SEQ ID NO: 681336 - DNA, 532 bp, Homo sapiens
tggggtccagctctgtgagtctgtagccaacaagttggcagggaaggtgatggggccgtcagcacggtgacattccacatgtcaagcactgccctacaggagtccctggtgcagattctgcagccacagcgtcgtgtcgacatgctccgggacatcatggatgcccagcgtcgccagcgcccttatgtcgtcaccttctgcggcgtaaatggcagtggggacacatctcactcaatcttgccacagatttccttctggtagttcagcagcacatggcttcagtgtcctcattgctgcctgtgataccatttcgtgctggggccgtggagcagctgcgtacacacaaccggcgttggcagtgccctacaccctccagagaagcatggtggccgcaccatggtgcagtttgtttgaaccgggctatggcaacggctgctgctggcattgccatggaagccattgacttatgccgtacgccaggctttgacgtgtgctggtggacacggaggccgaatgcagacaatgcccctct

SEQ ID NO: 681337 - DNA, 551 bp, Homo sapiens
  misc_feature (501)..(501): n is a, c, g, or t
atgatcccctgcctcgatgtcctgcacacccgtcccgagacaccactgcacacccgtcccgagacaccactgcacacccgtcccgtgacaccactgcacacccatcccgagacaccactgcacacccatcccgagacaccactgcacacccatcccgtgacaccactgcacacccatcccgagacaccactcacacccatcccgagacaccactcacacccatcccgagacaccactcacacccgtcccgtgacaccactcacacccgtcccgtgacaccactcacacccgtcccgtgacaccactcacacccgtcccgagacaccactcacacccgtcccgagacaccactgcacacccgtcccgagacaccactcacacccgtcccgagacaccactcacacccgtcccgtgacaccactcacacccgtcccgtgacaccactcacacccgtcccgtgacatcactcacacccgtcccgtgacaccactcacacccgtnccgagacaccactcacacccgtcccgggacaccactcacacccgtcccgt

SEQ ID NO: 681338 - DNA, 291 bp, Homo sapiens
ggccccagtactgctcttgaaaggcggcgacgagggttactgcccaaacattctgcctggttctagatatgcagctgctcacccttggcaggggaaggggcactggggaaagagactagccctctcctcacttggtgatatggagtgaaggagtgaggggtatccctcagcctaggtggctttatttgtctgatccctatcctgcctgcaaccctcactccagtaccctctacaatcccaaaagacttaagaatagcctgggctataggattttcaagaagcaggaactgg

SEQ ID NO: 681339 - DNA, 780 bp, Homo sapiens
  misc_feature (661)..(661): n is a, c, g, or t
ggcgagcgcagcgaagcctgggagagaactgcgcttggctgcgaaggcgcgagggtgcgaagacagggaggcaagcggaccccgaccggacccatggcgcccgtcgccgtctgggccgtgctgggccgttccggactgcgagcgttcttgggcgtgcgggaacacgccttgccgcggccaggcaacatgcaaaatgtcttctgtcaccaagtagctcggacgaccgtgtgtgactccatgtgaggacagtacatacactccagctctggaactgggttcccgagtgcttgaactgtggtcccgctgtagcgtctgagcacggtggaaacgtcaacgctctgcactcgggaagagaaccgcatctgcacctgcaggcccggactggtactgagcgctgacgcaagcagtgaatggtggtgtccggtgctgtgatgcgccgctgcgcaatgtggcggccgggcttcggggtggtcataacatggaactgagaacatcagacgtggtgtggatagccctggtgccccgggtgacgttttccaacaagacttcattcacggtgtattggcatggtcgccgatcagatctgtaacgtggtgggcatgcgctgggaatgcaagcatggatgcagtctgcacgttcacgtccccacccggagtatggncccaggtgcagtacacttaaccagcgtgttcaacgatccaaaaaagcagcaatcagaaccaagatgtccagactcttctgtccatgggccaccccatgaggagatggattgctccttgg

SEQ ID NO: 681340 - DNA, 351 bp, Homo sapiens
ggggcgggggggggggttttggggtttttttaagggggggccaaacccccttttttttttttcggggtttttcgggggtggaaagccccccccgggggcccccgtttcctttttttggtgggttttttggcccaacccccgggggggtttttttttttttggttggaagggggttgcctttccccccggaaagggtttttttttttatttaggggggggtttttttggcgccgcttttcctttttttagaagggggccccccaattttggttttttttttttttgggggacccttgggccccccccccccgttttttggtgggggaaaataaaaggggccccggcccccca

SEQ ID NO: 681341 - DNA, 553 bp, Homo sapiens
  misc_feature (11)..(11): n is a, c, g, or t
  misc_feature (94)..(94): n is a, c, g, or t
  misc_feature (100)..(100): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (156)..(156): n is a, c, g, or t
  misc_feature (189)..(189): n is a, c, g, or t
  misc_feature (196)..(196): n is a, c, g, or t
  misc_feature (198)..(199): n is a, c, g, or t
  misc_feature (203)..(203): n is a, c, g, or t
  misc_feature (222)..(222): n is a, c, g, or t
  misc_feature (224)..(224): n is a, c, g, or t
  misc_feature (238)..(238): n is a, c, g, or t
  misc_feature (241)..(246): n is a, c, g, or t
  misc_feature (251)..(252): n is a, c, g, or t
  misc_feature (254)..(254): n is a, c, g, or t
  misc_feature (259)..(259): n is a, c, g, or t
  misc_feature (261)..(261): n is a, c, g, or t
  misc_feature (269)..(269): n is a, c, g, or t
  misc_feature (276)..(276): n is a, c, g, or t
  misc_feature (278)..(279): n is a, c, g, or t
  misc_feature (286)..(286): n is a, c, g, or t
  misc_feature (292)..(293): n is a, c, g, or t
  misc_feature (305)..(305): n is a, c, g, or t
  misc_feature (307)..(307): n is a, c, g, or t
  misc_feature (312)..(312): n is a, c, g, or t
  misc_feature (317)..(318): n is a, c, g, or t
  misc_feature (320)..(320): n is a, c, g, or t
  misc_feature (335)..(335): n is a, c, g, or t
  misc_feature (352)..(352): n is a, c, g, or t
  misc_feature (357)..(357): n is a, c, g, or t
  misc_feature (366)..(366): n is a, c, g, or t
  misc_feature (371)..(371): n is a, c, g, or t
  misc_feature (389)..(389): n is a, c, g, or t
  misc_feature (394)..(394): n is a, c, g, or t
  misc_feature (400)..(400): n is a, c, g, or t
  misc_feature (403)..(403): n is a, c, g, or t
  misc_feature (414)..(414): n is a, c, g, or t
  misc_feature (431)..(431): n is a, c, g, or t
  misc_feature (443)..(443): n is a, c, g, or t
  misc_feature (462)..(462): n is a, c, g, or t
  misc_feature (471)..(472): n is a, c, g, or t
  misc_feature (488)..(489): n is a, c, g, or t
  misc_feature (551)..(551): n is a, c, g, or t
gaaggctagtnatgctaaacatccactgtttaaacttattcattaacaaaggcacagcagaaataactagaactggaaggaaaatggaaatttnattccncgatnaaanancactttgtataacaaggctaatgtgtttgaaaatctgcatgagcngtggtttgctaagagaaaacaggttaagtttgncacaaancnnagancaagcaataaccatacaananaaggaaaaaaaggnagnnnnnnctcgnngncctancnccaaaccngcaaaancnnaggcgcntccagnngatgtccctgcngngttcncttanncnctgctagtgagactngggctttttttcccacnctagncccccgtcnccgcngcaaaatcctcaaaattnttttnacacanccngaatgtctganatcaaaacatgccaaanatagcacaaaanagaaaaatcacagcatttntttcacttnnttgtatacttgtaaannttccaaatctaattataataccctcaattaagtagtaaattaatagaataaaatcatttttnat

SEQ ID NO: 681342 - DNA, 365 bp, Homo sapiens
aaaaaaaatttggggtttttattttttttcccccccccccaaaagccttgtccttttaaataggagcctttttaaaaaaaaaaaacccggtagggttttaaaataaaaatcaggggcccatttcccctttaaatttgtcccggaaaagttttttaaatccaatgaaagggggccttgcccgaaacttcccctttacttgccccactaggggaggggggacttagggaagtttcccgggtcggaagggctttttttttttttaaaagaacaattttgttgggattttccggatttcctttttccaaggtaaaaaaaaaaaccttttgggaacttgggggggggaaaaattaaagttttccccctga

SEQ ID NO: 681343 - DNA, 86 bp, Homo sapiens
tttgcccatgaggcattttatttgtagatatatgtattacatccctataaaaagaatgccgtgtagtccccttctgtcgtcttctc

SEQ ID NO: 681344 - DNA, 346 bp, Homo sapiens
ctcactcttcaccaggctggagtgcagtggtgcgatcttggctcactgcaacctccacttctctaggttcaagtaattctcctgcctcagcctcctgagtagctgggattacaggcatgaaccaccatgcctggctagcttctgtatttttcgtagagatggggttttgccatgttgtctaggctggtctcaaattcctgacctcaaatgatccacctgcctcagcctctcaaagtgctgggattacaggcatgagccaccacacgcaaactccatgtgcctctttctaatattgctgatattttcatgttggagaaaaagaaaattaaaaggcaaagaagttatg

SEQ ID NO: 681345 - DNA, 375 bp, Homo sapiens
ccccctccccgggtataaaaaaaaattaatacattctcaaggttatattggaaaggtattaaatttatgtctgggatcaccatttaatatttaaaacagaaaataaaattttaaggggaggatggaaacataggcatcaaaaaagatcactaactttcatattttggctaaaaatgagctttgtggccaggcacaggggctcacacctataatctaagcactttgggaggccaagatgggcggatcacttgaagtcaggagtttgaggccagcctgccccacatggggaaaccccgtctctactaaaagtacaaaaaattagctcagaggggtggcctatgcctgtaatcctagctacccggggaggggggggac

SEQ ID NO: 681346 - DNA, 1091 bp, Homo sapiens
tcctcttcttcttaagaacaaaccacaaagggattgtgagggaaggagggggttctctttatactccgtgagcccagacacctcactcggtcccggtctagagctggtttggctgaacactttttttcaaaaagggaaaaagaaagggagttggctgtgagtggtgagaggtgaaagtggacgtaagattttatccaccttcacgagcccagcccgcgcgtgtgcgcccgacggcttccctgtgttctgtgggacactttcttcccctgtgcccagtggaccccctatacttatgtgtgcaacaagggttgagacggggtagaaaaaacatgtgttattatgtgacgcatgtgaccagagacgccggacgcacagggaccatatgtgtgtgcacaagcacaaggcacatgtctctctatacccgcgtgggtctcccaaggcgtgtgggacatatgtgttgtaagaacttttcaaaacaattctcccagcacaattatagctctcctattccttttccctttcgcacaaagaaacacaactctcgggctgtgggtgccaccctgtgagagatgtggacaagtgtgtggagtctcggtgggggatatcaccacatatctctctccgtgggtgtttaccaacgcccgctatgtgatacacccccatataaatggtggggccctgtgtctttcaccccatttttcttcaacttccacagcgaaagaaaccacatggtgggacgcctctattccccctgtggaaaataatctccagcagaggtgtctcttccacgaaattatatgatggcctggtggggggccccaccaggggcgaatgtgggggcaacaccaacttcgttggcctattattctccgattaaatgttctccaccatagtttccagccgttggggtggaaacgtgggccccaggaaatacttattttaagcgcagaaaaaaaagcccgccgagatgaaagggggggaaaaacctactactgaggaattaaaagcgcaggtgttctctccccacagaatttcccttttcgaaggagtatgttggggacaagtgggcccccatgttggtaagtaaaccc

SEQ ID NO: 681347 - DNA, 146 bp, Homo sapiens
gctatgactggaagatgcctcttatagtccagtttagggtccaaggcagacagttccatactgtgatccccaagaaccctcaagggccttatgccaatctttcattttatgccacagtcctctaacaacgcatcagcggtattaca

SEQ ID NO: 681348 - DNA, 195 bp, Homo sapiens
aattaggggaagtatcgacggggagaaagctccccccagatatggtcacacgctcccgagggccgtctcacgacccatcttcatctggcggactcgcgcaatacccccgtgctctaggccctccgcttcccaccagtggatcgtgcggcgcattccccccccatcctcattcatttgatgtgctgcgcttgtacg

SEQ ID NO: 681349 - DNA, 770 bp, Homo sapiens
ccacggtcattctattccctcgcactacggctaggtactgaggcctgggtttctggaagtagtgactgtgttgcgcttgagtgagcccactgattctcccggacccatgttgaagcggcactcaagatgctgcttgcctggaggcccgcctgcgcctgtgagtacctgtaccgcaaggcccgggaggaggcgcagcgctcagcccagtgagagtgaaggagcggctgcggcgctgcgctggaagaaaacctgcctgattcccactgagttacgccgagaggctctggccttacaggggtccctggagtttgatcgattgctggaggtgaagtgtgtgaccagccacgtggatgattgaatacctgatgggcaggagtctgatagatcccaacggttatgatcactacctcccgagaccccagttacccgcctcaagatgtttgcaaatgtgagctgaatgctggtgttcccggtgtcgcgcatgcgaatgaacctgaggtcgacactgaatgtgggcggcactagttgtcagagccttgcaaaagccaacgggctgtaaccgatcttgcctggtcgtatcacagagcatcggggcaacaccctgtggggctcatcgtcaggccccttgccctttggtcctactgcctactttcacgctgtgccgtgttgtcttgcggcttgcatcccagactgggccccatgtcggaggccagcccactcttccacacggctccctccgcctggcagggggtctctgctctcgtcctttc

SEQ ID NO: 681350 - DNA, 459 bp, Homo sapiens
  misc_feature (350)..(351): n is a, c, g, or t
gcccgccaggggagagccccagcctggccagctggagcggatttgggggaaggaggaaaatgggggctcccaacccctctccagcttccctccgccgccctccctgattggctgtgcgtccctggagcccaacttcagtcgctccagactccatttgagccctgagggagtcggagcgccgcgccacggggcgggaggggcggccacgaatccaggggttagcatctctgggcccctggggggaggggcgcggacggggtcggcccccgcagcctctgcgaggcccatctcgctgcctctcgcagcctcggcttctctcagcccccgccctttccttccctcacagcggnngcctccctcctcccgccccccccgccccgcacccgcctgcccgcccgccacctccccccggtttctcattcctgccactagcgcgctcggcggctcattccgcggccg

SEQ ID NO: 681351 - DNA, 168 bp, Homo sapiens
  misc_feature (76)..(76): n is a, c, g, or t
aaaagtggatggggaggggctagcatcgtggagggtctagaaatctgtggcatcgctgaaaccttttgcatcatgntttttgatgttggagtcatgaagtgtacatcccccacccacacaccactacctgtgtacagaccttttaaaacatgtcttctttgtctgatc

SEQ ID NO: 681352 - DNA, 120 bp, Homo sapiens
tttatctatttatcctaaaaagcctcctcctcatgttctctttggggagctccctagccacttctggcttggagctgcccaattcatggatccctgctcaaataaactcttaaatattta

SEQ ID NO: 681353 - DNA, 561 bp, Homo sapiens
ccagcactggagactccattgcacgcagcctgcctcctgtgcgcaacgcctgcctcctgctccccctcatccctcttctgcaccccctcaaccacgcactccctatacccctgtactcctgtactcctgacccctgccctcctgctcccccaaatcctgccctcctgcgccctcctcacccctgccctgatcagctaactctgaggtaagcagaaggacaaaagtactctactcccataacacagtatagaggaggaaggtacacttgtgattatggttgtcattaaggctctggatattttgtggccttacctcccactgctaagatgcttgtaaacacttaaagattctgccacaggattctgttcccatcagaagcctctcacacagctgtagcaggtcactgaacaagatctggaaaactcaaagggccccactctaaaaatggggcttaagatgtctacattgacctctcatgatgccgaaaatgtcttctgtgagtttaacgtatgtcttcaacccaaagtctggtccagtgttgggaatcccagggagaggcca

SEQ ID NO: 681354 - DNA, 615 bp, Homo sapiens
tctaataagaaaatagttggatctctttctcagagtccagctgctaggccacattctgccaatgacttacttcatgttctggagggctctgcaaagataccaacttcgtctgttcatggtatcatccaaaatcgtcagctgctgggtattgtccaagacctcaatcctgtggtgtgtatgggtcgtatcgaactcagaagggcctagctattgtggcagcagagtcccttactttctccttggcatcattaaaactctctgccacgtaatacagcggctgatactccgtgacagtgtaattctgaatggctgtcttctccagctccattgggataagctatgtcttctctgataatcagagctgtaactcaccaaagcatgacagaagcacagctccatatgcctttacggagtctcagtgtctgcagagcgctcactccacagtgactcagtacattgtgtcgagcttagcaatgtattcaccaggtgcatccacaaaggcaagtcccatgtcctggcagaactgggcacagctgcgatctgaatgcaagggcacatgtccccacagctcatgtccgctgtcaggtcgggggtatacatgggcttggatccatg

SEQ ID NO: 681355 - DNA, 203 bp, Homo sapiens
gtgctctagagcgatcccttggttctgtgctggtctcgaattcctaagctcaagagatcctcctgcctcggctcccaaagtgctggaattacaggcatgagccactgtgcccagctaagactatctttgagatatattcaatacttttttttttggagacagagtctggctttggtcatcacaggctggagtgcagttacgca

SEQ ID NO: 681356 - DNA, 355 bp, Homo sapiens
  misc_feature (1)..(1): n is a, c, g, or t
ngaaaaaagtaccaccttgggttccattatccactgggtcttctaaatttccaatgaaggaccagttctctttcccaggtcgcaatagcctatcgctgtgtcattcgctctctaaattctttggcctcctttgatcaccattaagagaatattgtggcttcatcagttagaaaaaaggtccaaagaaagaatataaattaagcttcgaaaggctctcgacctaaaaaaacccacagtcctatataatatatcacaggaaagtgggtacagagctaatgtgtggaggggttataagctctgagggtgttctgccctgtacccatcacatttgtgccgcgtgccgtattcctacagc

SEQ ID NO: 681357 - DNA, 429 bp, Homo sapiens
  misc_feature (2)..(2): n is a, c, g, or t
  misc_feature (102)..(102): n is a, c, g, or t
  misc_feature (112)..(112): n is a, c, g, or t
  misc_feature (120)..(120): n is a, c, g, or t
  misc_feature (135)..(135): n is a, c, g, or t
  misc_feature (142)..(142): n is a, c, g, or t
  misc_feature (164)..(165): n is a, c, g, or t
  misc_feature (175)..(175): n is a, c, g, or t
  misc_feature (190)..(190): n is a, c, g, or t
  misc_feature (192)..(192): n is a, c, g, or t
  misc_feature (233)..(234): n is a, c, g, or t
  misc_feature (252)..(252): n is a, c, g, or t
  misc_feature (258)..(258): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (281)..(281): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (301)..(301): n is a, c, g, or t
  misc_feature (329)..(329): n is a, c, g, or t
  misc_feature (344)..(344): n is a, c, g, or t
  misc_feature (346)..(346): n is a, c, g, or t
  misc_feature (368)..(368): n is a, c, g, or t
  misc_feature (379)..(379): n is a, c, g, or t
anacactaatcattcaaaaaacccttgtgtttaacgaagacagctaaaaacatcacttcaaaaaggcaactttttttttttcttggcatcaatgaatatgcncttcagaaanctacaganaacttttttcacttngtatttnttccacaccattctagccaggnnttcaaaatangagcccttcatatcncnacatgaagcatggcccacggagccttcagccatccagagcnnctgaccatctccttaatntccacncacttcccagtntanccncctcncaactcacnagncccngcgnatttggttatttatcatttccagttctnttatcttggaatgantncaaaggtttctgacaacctttngaaacgtaagngcgcaaaaccagtgttgacaacgtcactgagctaatcgaagaatataccc

SEQ ID NO: 681358 - DNA, 298 bp, Homo sapiens
gagcaaattttccctcccttttccccggagggcccccaacgtttgttgccggttttggacaaaatttccccagtgcccgaaatccagggggcccataagtacatgggggcccacaaaaacataggcaagtttttcctggaactccccccgtgaaggaggatggggcaggacaggaggcgcccccccccgccctttccagagcaaacctggagaaaattcccaataaacaggcccaaaaacccggggcttccccccaacccgtttaaagcttatatgaggaaataaagagtgacctgga

SEQ ID NO: 681359 - DNA, 396 bp, Homo sapiens
tcaagtgacctacccacgtcagcctcacagagtgctgggattacatgcatgagacactgtgcctgacctatatttttcttttgaaacagcatctcgctctgtcacgcagactggagtgcagtggcgtgatgtcagcttgttgcaacttctgcctcctgggctcaagtgatcctcctgcctcggcctcccgcgtagctgggactataggcgcacactaccatgcccacctaactcttttgtatttttagtagaatcaggatttcaccaggttgcccaggctggtcttgaactcctgggctcaagcaatctgcctgcctcggcctcccacagtgctgggattatagatgctgggattgcagatgtgagccactgcacccagcctctgatttcctcgtg

SEQ ID NO: 681360 - DNA, 418 bp, Homo sapiens
  misc_feature (29)..(29): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (197)..(197): n is a, c, g, or t
  misc_feature (215)..(215): n is a, c, g, or t
  misc_feature (312)..(315): n is a, c, g, or t
  misc_feature (317)..(317): n is a, c, g, or t
  misc_feature (319)..(319): n is a, c, g, or t
  misc_feature (324)..(326): n is a, c, g, or t
  misc_feature (328)..(329): n is a, c, g, or t
  misc_feature (369)..(369): n is a, c, g, or t
gctgcgtgattcctgcctggtcacgtgcntgattattgccantngngcgnatntgncgtcattgctgagctcatgcttattgctgctgattgcgtggttcgtgtctgctcagctctttgagtattgcctcctgaggtccctgttcggtcgccacctgccggggaccagccccaactgatccagggtattcgaagganagatggcctaggcgactntttatatgctaatcagagatgtcaagaataatagtatgaggagagctcagtaggaaaattcggtggagaaaagagactgagtagcttggtttatgcnnnngncnaatcnnncnncaagacaagaagtttgccccacttacgtaggccgcagggnccctctcgaatagcggaaaggtgcctcaccctagacaactttctcggag

SEQ ID NO: 681361 - DNA, 162 bp, Homo sapiens
  misc_feature (110)..(111): n is a, c, g, or t
gcagctcccctcctggaatagaatctttctttccatcctgcatggctgagagagccaggcctcctgcttggtctccacaggaggctgtggcagctgtggcacccactgtnncatctccgtactgcccaccttcttaagaggcgagatggagcaggcccatct

SEQ ID NO: 681362 - DNA, 277 bp, Homo sapiens
  misc_feature (6)..(6): n is a, c, g, or t
  misc_feature (12)..(12): n is a, c, g, or t
  misc_feature (239)..(239): n is a, c, g, or t
ggtttnaaattncaacagtattaaagtccagtgacagtgtgattataggcgtatttttgaaaaattttcaaaattactgtatcacagtgatatagtaattcaaagtctgattttaggttcagtttactttgatgtttggtcataagttgaaaggatacttttgatagaaaattttcttgtctgagcattaggacaagtacctaatgcatgtggtgcttaaaagctaggtgatgggttgntaggtgcagaaaaccaccatggtacgtgtatacctatg

SEQ ID NO: 681363 - DNA, 259 bp, Homo sapiens
  misc_feature (81)..(81): n is a, c, g, or t
  misc_feature (146)..(146): n is a, c, g, or t
tctacaggatctcggaaattgtgtggtgttatgctaaagaaggatagaacttggctgatgtgtatagattacagggcgttnaataaaattatgctcaggaacaaataccccctacccaggatagacaatctactagataaattgcngcaagcaaagtatttcaccaagcttgagttgaagtctagatatcaccatgtccaagtcaaagaagaagatacatggtagttgccttcatacaccacacaattcaggagtcctc

SEQ ID NO: 681364 - DNA, 203 bp, Homo sapiens
gattgtccttgggttctttaagaaaacttgagcctctggaggtatttcctgagtattgtcctgaacctggcccaataaactctctgtattaattttgactctatttctttcttaaggtcaacagatatgaccaatatctatacaacttggggccaggctcacacctgtaatgccagtgctttggggagccaaagtgggagcat

SEQ ID NO: 681365 - DNA, 634 bp, Homo sapiens
  misc_feature (12)..(12): n is a, c, g, or t
  misc_feature (51)..(51): n is a, c, g, or t
caacttgggagnacaaccatatgttacgactaaaagcctccaaatactggngaaggctatgaggccaggaacctccacatgatactgagcagacttgatgactacgggaaaaggtgatgcaggtctggactgagaagcagaagtctctagggcagaaacggaatcagtgcctgaagaaaatgatacaggtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctattttgttctcaaa

SEQ ID NO: 681366 - DNA, 128 bp, Homo sapiens
agccctaacccccaccccccctggggggttttttacttgggggccccccttgcccctgcccccaggtaaaaaaaaatttaattgtttttttttttgggcccaaaaaaaacccccgctagtttttccca

SEQ ID NO: 681367 - DNA, 470 bp, Homo sapiens
  misc_feature (12)..(12): n is a, c, g, or t
  misc_feature (51)..(51): n is a, c, g, or t
caacttgggagnacaaccatatgttacgactaaaagcctccaaatactggngaaggctatgaggccaggaacctccacatgatactgagcagacttgatgactacgggaaaaggtgatgcaggtctggactgagaagcagaagtctctagggcagaaacggaatcagtgcctgaagaaaatgatacaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgggttaagaagattcccaaatgactgtaaaattaaatacaagcatgttgaaagtacatttcagtatctttcagtaaaatgcctattttgttctcaaa

SEQ ID NO: 681368 - DNA, 289 bp, Homo sapiens
tgagacacggcagtgcacgcttgacattcctgctagtctgtctctacgagtatcccctcataggttcgcaggggacagcggagcagacaacacacaacactaccgtttgtgcatgctcaagaccgtggatgattttatagcatcctgggcatttcacatccatgacagtacgacttggggctctgcaccaggtcttttcttctcgtgtttcctcttctcctcttctggagagggactaaggagatcctttgtcgagaggtcatgttctcgtgccctgcgaaccctataa

SEQ ID NO: 681369 - DNA, 983 bp, Homo sapiens
  misc_feature (12)..(12): n is a, c, g, or t
  misc_feature (51)..(51): n is a, c, g, or t
caacttgggagnacaaccatatgttacgactaaaagcctccaaatactggngaaggctatgaggccaggaacctccacatgatactgagcagacttgatgactacgggaaaaggtgatgcaggtctggactgagaagcagaagtctctagggcagaaacggaatcagtgcctgaagaaaatgatacaggtattcaaccagctcaaaaagatacatgaattgaatcttagtcaacctatccccttaatcatcgaagaaaagcagatacctgcctctaccacatttgttcaaaagccattcttaaaattactaatggaagaggacagaacctctgacatatgcaagaaatttaggcaacaagaggaccagacagaggccatctggaatgttgatctgtccacttcaagctacccaatagcagagaagacatctatgcattcactctgggcccagctgggtgggtacccagatattcccaggctgcttcagttagaagtgcagtctaccttccgaaaatctcttgcatccctccaatcacgttcttcaggttgaacatcttcatttctgggctactactatgaccactcaagaaagagtatcttctgctctacattactggaaacacaaaggttcaacaaccctggggtaggctgagtcatgaaagggacatcattatgggcccctaacatgatggcaaagtggcacagtctgcctttcccagtctaaacccgaagatgcctcagaaggaagaaataaatgagtataatgaaggaaactaaaaaccagcagacacccctgaagaattagaaggtggttatgattggtaatgaagggaaatcataatgttaccagtagagggttgtgactgcaagttgtccaggttcttggcattttgaacaaagaattgggcaaaatgcccagcaaagcaaataaagaatgaagccaccacaaaaaaacaaatcgggcctccctggcctcatggga

SEQ ID NO: 681370 - DNA, 462 bp, Homo sapiens
  misc_feature (19)..(19): n is a, c, g, or t
  misc_feature (41)..(41): n is a, c, g, or t
  misc_feature (67)..(67): n is a, c, g, or t
aaaatgcctgtggtggggncctaactggaaaaccgggcaantgggggccatcctgaaaaaaacaccnactttgcaagtgaatgcaaaactgctccccttaacttgcctgtgtcccctatcaggcaaagttaactttgccctctcctgaagccctcagtttcctttattcattaaattcaaatatgaaccccaggtatggtggccccacgccctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcaga

SEQ ID NO: 681371 - DNA, 486 bp, Homo sapiens
agcgttctagaggataccggaggtgacgctgcctgtactcccaggcatatgggaggcttaggcggatgaatcacttgaatcaggagtggaggccagcctcgtgaacatggtgaaacactgtctctaataataatacaaaaattcctgaacaccctcaacagccagaagtggtggcaggtgcctgtaatcctagctactcaggaggctgaagcaggagaatcgcttgaacccgggaagcgggggttgcactgagccgagatagtgccactgcactctggcctgggcaacagagtgagattcggtctcaaaaaacaaacaaaacaacaacagcaggcaacaattctcaacttatggtataaggtcaagtattaacctggtatcaaaagtagatcacgatattacaagagaataaaactgtagcaccaggatctcttacaaatgcggacattaaaatcctcaacaaaactctagctaatcaaatctagc

SEQ ID NO: 681372 - DNA, 346 bp, Homo sapiens
cactccagacctgttcccttagcataataccacaccagtcggagaaatacaacttcccaaacttctttgtcaaataaattctataacattttggctcaaaatttatcataaaaaaattcctaccaccaatcgggttggcggcaagctctctcacaataccacccaggtccgcacttctctgactaaatttagcagtggttactactgcggcagtctcaaaaaaaagcgtcaaaggacttcacgcgggtgcatgaaaattttctacctcccccttgtggagatcgttatacatttgtcactcctcatccattcgtacatttcaaagaggtaaatttattgcatctaa

SEQ ID NO: 681373 - DNA, 440 bp, Homo sapiens
  misc_feature (101)..(102): n is a, c, g, or t
  misc_feature (128)..(128): n is a, c, g, or t
  misc_feature (143)..(143): n is a, c, g, or t
  misc_feature (202)..(202): n is a, c, g, or t
  misc_feature (438)..(438): n is a, c, g, or t
ctgaaaaaaacaatcacatcagaattaagtaaggccaaaagacaaagagagagaaatgaaaacaagcccagtattcaaatggggcctaagggggaaaattnnccctgggcttccaggaattacagganagttggggttttganaaggtaaaaaagtgggcccaggtgcggtggctcaagcttgtaatcccagcactttgganacccaaggcaggtggatcacgagctcaagagattgagaccagcctggccaacatggtgaaaccctgtctctactaaaaacacaaaaattagccgggcgtggtgcgggcgcctgtagtcccagctactccagaggctgaggcaggagaatcgcttgaacccgggagggggaggttgcagtgagccgagattgtgtctcagtgctccagcctggcaacagagcgagactctggctctnaa

SEQ ID NO: 681374 - DNA, 863 bp, Homo sapiens
gaaacacctcactttatttccatgtaatcagaaacattagctgcagaaaagcccccagacagagccctggcggagaggcaggcgcttggggctcctacggtggtccctggtgcagctgtccccatcaggccaagtagctgacgcgagaggcgctgccccagccaggaccaccagctctcacagtcagtgcacgcaagcatgtggacatttcctaggccatgctggtgggacactggaacattcgggaaagccaagagagacggaagaaggacgatcgcctcctccaactggcgggtgtgaaggaagccagccaggggtccgggctgtccttggcctgctggcaggcatcactcgatcaggactgcgcacaggctcagccgctccgccggagctccaggtcatctggatgtccagatattaggccccgtctcacacagtagcctgtcagcagggtgccgctgctgagcagtgcacagagggatggcaggtccttggcgacggtagcccctgtgcttagatccacggtgagctctctttcccgtgccgaagggggctgtctacttaccaccagcagggcgctgaggacagcaggccgagctgtgcgtctccatgccgtgttgccctcgacacagcgtggtaggcaaacacgcattgtgccatgatgggcacccacgagccgggagaccttggggggcacactcatggcagagcgtggtggtctccctgctctgtccccgacgacggtaccttcaaattacaggcaagcaggcattgccgggtcccggacgggtccgggtgaaaccgagccccgtctccagcttgatgccgccatgctgaatgcgactcggctgacgcttggccgc

SEQ ID NO: 681375 - DNA, 160 bp, Homo sapiens
tgtacaccatctatgggggaggggaatatacacattgcttttatatttaatactttagctgatgcttttgaaaatgtttatgccacagaattgctaatatattgtaatcacattcctcaggaggactttggtaatgggttttatgcatagatggttacag

SEQ ID NO: 681376 - DNA, 246 bp, Homo sapiens
cccccgggggcccccgggggtttttttttgggggccccaaaaaagggggcccccttttgggggcaaaaaaaaatttttttttttgggggtttttttccccccggggggttttccctttttacccccctttggggttttttttccccccccccttggggggggggggttttaaaaatttttttttcccccccccccgaaatttttttttttttttgggccccgggggggtgaaacccctttttttta

SEQ ID NO: 681377 - DNA, 106 bp, Homo sapiens
atgaaatatctaaaaaattacctgaggtttggatgcatgcacttgtagtaccagctgttgggaaggctgaggcaggaggatcactagagcccaggagattgaggct

SEQ ID NO: 681378 - DNA, 81 bp, Homo sapiens
acctatacactctaacacctataacctgatacagcatgtgctacccttccttcaaatatataaatgtgcatcttttttttt

SEQ ID NO: 681379 - DNA, 657 bp, Homo sapiens
  misc_feature (4)..(4): n is a, c, g, or t
  misc_feature (27)..(27): n is a, c, g, or t
  misc_feature (39)..(39): n is a, c, g, or t
  misc_feature (62)..(62): n is a, c, g, or t
  misc_feature (69)..(70): n is a, c, g, or t
  misc_feature (86)..(87): n is a, c, g, or t
  misc_feature (150)..(150): n is a, c, g, or t
  misc_feature (275)..(275): n is a, c, g, or t
  misc_feature (285)..(285): n is a, c, g, or t
gaangcgggtttccaatcagacgttgnacgcggccagtnatgtaatcgcccctataggccanttggacnnggcctccccgatttcnnggccatgtcactgggacaaaatctgtatgtaagtatagactaactatatcgatacttatttantacaccacacagcagcggcaccatacttatatagccagagcttctcgcattggccacggccttcctccagcttttctcatctgcttcacacagctatgtgagatagctgttttcatagctggganaactgaggcncagagaggtcggcacactggcctgaggtcacacagcaagtctgtagggctgggagccgagggaagggcataggggtccaccggatccagccagggcagagagggggatttcaggtttaggtccagaggagagtgcctcaccacagtctggcagtcattagcagggtgatggtgaggctgagatgggcagggccaggctgaggagcagccccactgcggtactggacatccaggtctgggtggttacagccacttttagtacagcaggagacatcaatgtggttcatgctgaaggcgtcactcaggtgggcatgttggcacattgaggcggttgcacagcctcttaccatatagctttggtttttcctcgtgc

SEQ ID NO: 681380 - DNA, 113 bp, Homo sapiens
ttctacactggggagacgtggaaagagagagagagggagaccgtggggagagggagaagagagggagagggagagggctatttgtagaacattgaaccgggtaccgatgctcg

SEQ ID NO: 681381 - DNA, 373 bp, Homo sapiens
  misc_feature (84)..(84): n is a, c, g, or t
  misc_feature (149)..(149): n is a, c, g, or t
  misc_feature (334)..(334): n is a, c, g, or t
  misc_feature (362)..(362): n is a, c, g, or t
tttctccagtaatggcgatcgtagcgctgtgtgttgcagctatcgggtttattgccgtgcagccagtgttctggacgatgccgnacacaactgctttccggtacgcgctggctgcgggaattggttttgtaaacctgtttggtgcagtnggcgggtttattgcccgatcctgcgcgtgaaagcagaaacgttatttgccagcgatgcggcgggattactgacgctggcagcggtggcggtcatcggttcgctgattattttcactctgcgtgtaaatcgcactgttgcgcagaccgacgtggcacatcattaaataggttaaggaacacgatgnaccgattattaagcaatcctttaaagancgtttacgcaa

SEQ ID NO: 681382 - DNA, 317 bp, Homo sapiens
ctagaggataaacctaggtgcaaagcgaccgtaaacaagagtctggccacgtttcttgtagcgagaatgtgctgcagctgaggcacctcttccaccccgggggagcttgggctctccaaagcccgcaggccagaatggctagtcaccgaaagagcaaaggtgggggcctgcccctctccgggagctctgtcccaggaacatttcacatttccattggccaaggaatgctggtgggggtagctggaggccccagttgggaggtcctgtccagtgaggtggaacaggatcaggggcctgcttacagaagcagtctggcg

SEQ ID NO: 681383 - DNA, 144 bp, Homo sapiens
gcctgatagacgtctagagcattttgagatgtattgatgtgcagttgaggagcaagtagcagcttcgtgtcgtagcattgctcagaacagagaggagagcggcggctccacagctactaacatgaaacagtaatgagcaggagc

SEQ ID NO: 681384 - DNA, 495 bp, Homo sapiens
gctctctccttcccccattgtgtgtggaggttttttttctgcttgttggtaggaggcttggagtaaaagaaagaataataaacatccccaacgagagtgcagcaagccaaccctttatgccaaagcatatacacagaagaatggagggtaatgattgggtggagtgataattaattttttctcttggctgaaagatgattgtgaaaaataaactcagagtcattggcaagtatgtcctatatggttataactttgttttgagtgaatttatcaccaaatacagggtctaggaccagtgtggcaaccttcttaggcggatgcagtcaaccaagagcagggagaaagaaagatttgaaagtggtagtgcgaggctgggcgaggtcgtcacgcctgtaatcccagcactttgggaggccaaggcgggtgaatcacctgagatcaggagttcgagaccagcctggctaacatggtgaaaccctgtctctactaaaaata

SEQ ID NO: 681385 - DNA, 323 bp, Homo sapiens
cccaccgtgtggcgggtttcatttgaagcggatgttacatataaaggttttcacatctttatttcctgtctgaatgtgctgggttattccaaagatatttgcaggtccgctactttggaaagaacatagcttttttatttatttattttttatttttattttttttgagatggattctcactctgtcacccagactggagtgcagcggtgcgatctcggctgactgcaacctctgcctccccaggttcaagtgattctcctgcctcagccttccgagtagctgggactacaagcacgtaccacgacacagtgaccacgacaca

SEQ ID NO: 681386 - DNA, 422 bp, Homo sapiens
acaagatttaggcccctgctttcccctagttccagttacaagatgggggagatccttcgccaacttcatgtgcaagacaggactttcatcctggcctccaaatccaatatcaaaaaggtattggatgggcagaacagaaaatatcatatgataaggaggagacaggaggagttgatggcagcattatcttaaagaccaagagtcatatgataatagattgcttatggagatgacgtgtaaagaatggccttatttcatgtatgagcccaccaggagctaaacagagacacagagaagagaacagaggggagacgcatcactttgattgcagaggagcccacgagaaattatgccagctgcatgacatcagagatcagcctttgtattcaggtcgactgtaggtgcattactgtcacactggg

SEQ ID NO: 681387 - DNA, 85 bp, Homo sapiens
  misc_feature (23)..(23): n is a, c, g, or t
  misc_feature (62)..(62): n is a, c, g, or t
  misc_feature (67)..(67): n is a, c, g, or t
  misc_feature (78)..(78): n is a, c, g, or t
aggccctgggccggccccctggnccaggacatccaggtagacaggaggtgcctgggccaggnctttntgccgggcgtnaaaataa

SEQ ID NO: 681388 - DNA, 552 bp, Homo sapiens
gagagagagagaatcgtacgggagaggcgagtgacctgtctggtaagcatgggctaatgtgaggatcgctgctctgcggttctctggggtccagagcaagcaagtattagatgctcggagaggagagggagatgagtgatgctgggggatcggcgcgcagcaagccatgctctgccggatttgtcatcggtggatcgcacatgccggagcgcaaaacgtccgtaggctgagcaatggatggtgcaggtcgcattggttgaacacccatcttcatggaactacctgctggcgtgggcttctataggagttcgcgtacctctcgtgcaagtctcagggacagagaagatggttggcgacgatgaccgggggccaggcatattgcctccaccgctagagtgacctgaacatctgtggccctgatttggggcatcattcatgaccattctgctcatcatcatgaccagtgttggtcgtccaggcccagcgatcgatcaggaggcatcattgaggccagggagctcgtgccgtgagctgtatgccatgtactctatc

SEQ ID NO: 681389 - DNA, 103 bp, Homo sapiens
ccgaatgaaatatcagggacttaggggcgatgactgtagaacagggtacagtccttgacagaatagactataacgttgaacagtcctgtatcaaaactgaaga

SEQ ID NO: 681390 - DNA, 221 bp, Homo sapiens
  misc_feature (43)..(43): n is a, c, g, or t
  misc_feature (79)..(79): n is a, c, g, or t
  misc_feature (125)..(125): n is a, c, g, or t
gttgggtcgtggcggcgggaggggtggcctcctgcgctggtcncccaggggacctgagaggcgcgacaaacagtcggcngtttggtactcgcgctgcagagctttcaacctccgcgccggctgcnctgttttctcggccaggggagcaaggccacgcggctatcgcagccgagtcggaaccaaccggttgtttggtgaaactaccccagagcctcccgcgg

SEQ ID NO: 681391 - DNA, 305 bp, Homo sapiens
  misc_feature (35)..(35): n is a, c, g, or t
  misc_feature (51)..(51): n is a, c, g, or t
  misc_feature (100)..(101): n is a, c, g, or t
  misc_feature (105)..(105): n is a, c, g, or t
  misc_feature (246)..(246): n is a, c, g, or t
  misc_feature (289)..(289): n is a, c, g, or t
gtttcgaactcctgaactcaggtgatccacctgcnttggcctcccaaagtnctgggattataggcgtaagcaccatgcccggcctgcaactttaatattnntttnttagaggcagggtcttgctcctttgcccaggctggagtgcagtgatgcaatcatagctcactgcgaccttgaactcctgggctcgttaccctcccacctcagcctcccaaagtgctgggatcacaggcatgagccatcgtncccagctggggaagggcagtttatggttggtttattttgtganggcagagtctcactct

SEQ ID NO: 681392 - DNA, 415 bp, Homo sapiens
gaggatgatagtagaagagagagaggagtttcataagtcgagtgaatagtaaaaaatattagtactgctgatcgggagtcccatactcatgtctcagtagtgattagttgctgtcgacatcgtggagatgatctcgctggacttgtagccagggaaagtaaagagtgctgcagagaggttgaaggggagtatgcctcctagtgagataattagtccagagaaacaacagcccttccagaatctcttacaagagtactttacgtctttgaccaaacacctgaaaagggaccacagggagctccagactcctgagagacacaacaggcgcattctacattctaaaggggcgctcagtgaagatagacataaacagtatgaggaattcgctatgtcttaccagaagctgctggcacct

SEQ ID NO: 681393 - DNA, 827 bp, Homo sapiens
  misc_feature (109)..(109): n is a, c, g, or t
  misc_feature (116)..(116): n is a, c, g, or t
  misc_feature (135)..(135): n is a, c, g, or t
  misc_feature (172)..(173): n is a, c, g, or t
  misc_feature (194)..(195): n is a, c, g, or t
  misc_feature (335)..(335): n is a, c, g, or t
  misc_feature (434)..(434): n is a, c, g, or t
  misc_feature (436)..(436): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (453)..(453): n is a, c, g, or t
  misc_feature (455)..(455): n is a, c, g, or t
  misc_feature (457)..(457): n is a, c, g, or t
  misc_feature (459)..(459): n is a, c, g, or t
caaatggacatgtctcttgactggacatcattaaactgaaccggagccagcgaggcggctggggcgggtgccggggcctgcgtgccgtgtgccggctcccagttgcggnccgcggnggtggggcgcagccgccgnagtgaatcgaggcggcggcccatccggaaccggccgnncatcgcccgcggcgccggganngcggcaggaaccgaccggcgccctacagcaggccaaaacaacttcccgacaagtggcagcacgatcttttcgacagtggcttcggcggtggtgccggcgtggagacaggtgggaaaccgtgcgtggtgtccatctggatnttggagtctcagacgccgatattcaggaactctttgctgaatttggaacgctgaagaaggcggctgtgcactatgatcgctctggtcgcagcttaggancncagacgtncncttngancngnangcagatgccctgaatggccatgaagcaggtacaacggcgtcccttctggatggccgccccatgaacattcagctttgtcacgtcacagattgacgcacagcggagggcctgcacagagcgtaaacagagtgtggcatgactagaaaccgtggcgctggaaggtaaagggtgagttggtggagtgcaccccggagaaggcacaccgcggatggcgcccgtggaagaggcaaggaggttgcaggaagaaattcaacaggcaagcaagcttacggcagaggagctggatgcccatgtggacgcctataatgcgaaaatgacacagttaaaaagaacagcaatccagcgtctgacatgaccaggagtatcac

SEQ ID NO: 681394 - DNA, 322 bp, Homo sapiens
gaggatcacgatgtcctgtgagagagttatgatgcgactgtgagtgcgttcgtagtttgagtttgctaggcagaatagtaatgaggatcagatgtctgtgggcgaatatgaaaatgagtgcggcggtaaatcttcagggggtgtggatgagagtgggtgttactacgagggctatgtgggtgattgaagagtatgcaagagcgcgattttaggtgtctgtgtgtcagtacgcagatggcgcttgttataattatgcctcatagggtgatagacaaggaagggagtactctatgtgttgtgccagggggtcgagaatgatgtg

SEQ ID NO: 681395 - DNA, 119 bp, Homo sapiens
  misc_feature (40)..(40): n is a, c, g, or t
ttaggtacagaaaaatcagatccatttactgttacattgngtgcacacttacttgctttattctatttattcctcaccatagcctgtgagatcagtatggttttttccagttagacttt

SEQ ID NO: 681396 - DNA, 260 bp, Homo sapiens
ctagttttttgtttattaattgagatgcagtgttgctctgtcacccaggctggagtgcagtgccagaatcatggctcactgccgtctcaggctgctgtgcttaagcaatcctacctcagcctcccaagtagccgggactacaggcgtgtgccatcatgcctggctattttttttttttttttgggtaaaatcagggtctcactattttgctcaaaattgggtttcttattcttggctctgctgccaacaggctgtgtgta

SEQ ID NO: 681397 - DNA, 126 bp, Homo sapiens
ggtttgggcccccgggccttttcccctttggggggggggtttcgaaaaatgttgcccccccctaagggttaaaagcctttgtccgttctcccctggggggtttgaaaaaataaaaataatttttta

SEQ ID NO: 681398 - DNA, 229 bp, Homo sapiens
cagggcatgtttatatggaaatgtgttaatttttgtcttgtccaaataattcacatgtgtttgtttttgaagttaagccttagaagttacatgtcgagatttgaggaaaagtcctaatcaatacttcagttagcctgagtaactgagtaagtagaggccgccctattatgcttatgcatccagtcattgctttaacatttaagttttggttctctgaaatgctttggct

SEQ ID NO: 681399 - DNA, 84 bp, Homo sapiens
gagagagatgaagggtcttactactgtgcctgtgacaccccccgtcgggggatggggaggggaccatacaccgataaactcact

SEQ ID NO: 681400 - DNA, 409 bp, Homo sapiens; identical to SEQ ID NO: 567613

SEQ ID NO: 681401 - DNA, 348 bp, Homo sapiens
cctgatcttagctcgttccatggataacgacgcgccagcgatcgaccatcacaggaagatgtcaaacgagatacagagaattgtcttctataatggatctaaaaagccaaaggagctagactatccagaaacaatttagaagaagaaaataagaggggcaatcatcagtgtacctgataccaaggcttattatatagctatagtaatcaagacaatatattatcagctggggaacatacacagatcaatgaaatagagtagaacatgcaaacacagatgaacagatatagtccaagtgacttttgagagaggtgcaaaaaaaattcaatggagaaaaaataggcttta

SEQ ID NO: 681402 - DNA, 122 bp, Homo sapiens
  misc_feature (4)..(5): n is a, c, g, or t
taannggacaaccttccgtaacaacacacccgccggccttatgggccggtcaggggcggccctgagggggatttttcttatcacctgggcgggtttaaacccacaaaaggataatttttttg

SEQ ID NO: 681403 - DNA, 238 bp, Homo sapiens
agctggaaagccaataccagaggactgcctgggatctttgatgacaagtacacagagacctggatatggtgcctatgatgcgtataagcatgcagtctcagacccatctattttggatagtatagatatgaatgaagatgaacgggaattactcattaataatattaataggcgcttgaccccacaggctgtcaaaattcgagcagcaccacgattttttccacgaatacaccgggga

SEQ ID NO: 681404 - DNA, 1100 bp, Homo sapiens
agcgaaataggccgagatctgtccatgctgcggtgagaggaacgctgaatcgccgaagagaattggctgcgcttccgttggtttgtgagctagaattagaatggcgactcagtccacgaagcgacgcgaacttgtctcgcagtcgtggagaatcgagactaccttcagaggagtcctcgaacaagagaacatttgcactagacttgaagaggaaatatttcatactgaattcgtcgagctgcctacgttaacctgtcgttcaatataggcagcgtctgcgcaaagatgattatatcctagacagcatccaagcgttctacgtatatcagagtgtgcagcacatgaatgacctcgaagcaaggaaggtaaaatcgccgatacgtacaattatgcgctgagtggtaacatgcctgactggcagatactctcttgacgtacattcacacggtattctgttaacacgtgtactactagtgactaaacccaaagcggagcagatatgctcatcaaagtagcctaccgcttaaccaaaatatacctaggcaggctttgacccatgttaacaatgttgacttgccgctcaaccccaacgtttatatggagaaaaaagctccattcattccagacaatagtgcgttccccgtcgtttggagattagggaggaacgctcggaattcgacccgaaggataagcgtccacaaaataagatcctagttcacccacgtgacgatattacattccaacttaatagggaataacacaaagatgcgttttgaattccccaacggaaaatacccaatttttccgctttcatcacacctttcacaacatcggtgtgtgacctcgcccttacgagaaggaacggttctccttttttaacccttagggtgccataggcaataacgcacaaggcgtggaaaatggattggcaaaacaagagaccaaattctttgggtctatccacgttgttccattcgagaatggtttacccccactttaggagttgggtagcccttaaacagttgagtcggtaggactgctggaatacaatgaaccttccaaaggacgggtttgacactctcggtggatgcgcgcaaaag

SEQ ID NO: 681405 - DNA, 726 bp, Homo sapiens
ccctttttttttgtgtttttttaaccggggcgtcctgagttaattgggggcacacccggacaagggccctgccctaaaaaaaggtgttggcgcctctgtggtggtgaagcgtggtttgtgctgacggcgcaggacccggtggggcaggggaacttgatctcggagtcgtgggaactcgtttgacaggccggccggaggcacttgttgggccgcgatctcttccaccttcatgatctgaatggagtggcgctcggcgctgcggtgccgggcacccattgtctcggaggcaccttgggtgacagccgcctgcggttgtcaggccccggtatcccccggaccattgttgatgggttgccagcccgggagttcatagcgcagccagatcccgaagttactttacacccgcaggggggaactctcgtaaaacgactgtgcccacagtagacatgtctccctgtgaaggatttcttcactctcctgttaacactgaggatacaaagttacccaagaaagcggcaactttggcggacagacctttgattggggcggcaaagtatccgcaattgccggccagaaagcggtgccggttgttgtgggacaattagcgggggggtgttgcgccaagggcaagggaaccccatataacgctttgtaatcctctcgtaaaggagtagcccagaaggccctttcaatgggggtagcactcacggagttaccgccggaatt

SEQ ID NO: 681406 - DNA, 232 bp, Homo sapiens
gctgataccctcgatagggccaccagcttctaagggtacgtcgctgtgaggcgtaatgggacatgaattgcatagggtctcgctttctccttattattcttgtggttacatcatccctggttgtggtttttgcctttaagtaacaaatgctccctccttaaggttatagggctccctgagtttgggagtgtggaagtactacttaactgtctgtcctgcttggcttatcgag

SEQ ID NO: 681407 - DNA, 392 bp, Homo sapiens
gtcgatgttcctcatgattagactgaggttcgggtttggagaggaagacagaggtcaggtgccattctgccacatcttatgaagggttcatgctgactttgatcacctgactgaggtaaacttagccagacttctccatagtaaagttactcttttttcttctttctgtactggaccctttggaagagaagtcactgtgtgcagcccacatttaagaattggggaattatgttctacctccttaagggcagaatatctacacaggcttttttttttttttttttttttttttttaaccccgagggggacaacagaattttttcacaaaaaacacaggggttggggggatagggccacaaaatctaaacgggactcccaaaaaaagggaaaac

SEQ ID NO: 681408 - DNA, 261 bp, Homo sapiens
cttgtctgtgtaaaagaaacctgggctcaagtggccatccagcctcagccttcctgagtagctgggattgcaggcaggcgccaccatgcccagctaatttttgtatttttagtggagatggggttcactatgttggtgaggctggtgtcgaactcctgacctcatgatccacccgcctcggcctcccaaagtgctgggatgacaggcatgagccaccgtgtctggcctctctgcctgttttttaagacttttgtctttgga

SEQ ID NO: 681409 - DNA, 481 bp, Homo sapiens
ttttctttctctctctctctctccccctccctctctctccctctccctctctctccctgtctctctgccccctccctctctccccacctttccctctccctctgcctctctctcttcctctccctctccctctccacttcctccctccccttcccttcctcccttcctctaccttttttttttcttgtaatgtaatatgtagtctggagaaaacatctcccaagttctgttgggccattctccctattggaagtatactaatagtatctgctcactggaacatgccatatatgtcacctgccccacatactgatatcacaataatatgtaaaaccttcatttaaattgtttttgaatgtgtatatcaattgttacagcatatgactgaacttttttcatccttaaaaatttttttaagcaatatgacacaaccactaatgaagaaaaataaagattactgattgacattaaaaaaaaaaaa

SEQ ID NO: 681410 - DNA, 560 bp, Homo sapiens
tggttgtagtaaggggtggaaggtgatttatcggaaggggaggtgattcctagggggtggttggatcccgtttgtgcaaaaataggaggtggagtgctgtagggtgaataatgaagggaaaatgaattgaagggtaaagaatcgtggtgagggtgggactggtctacggagtagcctcctcagattcattggaactaggtctggtcccaatgtatgggatggcggatagtaagtttggtaattactgggggcccctcagaatgatattgggcctcacgggaggacatagcctatgaaaggtgtcgctatagttgcaagcaggaggataaggccgatgttctcgggtttcggagtagagaaaggatccgctaatataggcctcgcccgagtgtgtacggacagaggcgcgataaagactatggcggcgccatgggccgtgaacgtacgcggatgatcacccataatcacgctccgagtgactgtgggccacggactgaaacagggggctgaggcgtcggggagtactcgctggtaggaactagccccgcggcgatcggcag

SEQ ID NO: 681411 - DNA, 458 bp, Homo sapiens
taaagcaaggtgtctcacagactgtcccttcacaaccggtcagtagtactgtccctcctccaacaaccaggactctttatcaagctatgcagcctcatcctcagcatttggcttctatgggttttgatccaaggtggctcatgatgcagtcctacatggatcctcgaataatggtaggaagacctgctatggatattccacccattcatcctggaatgattcctccctaaaccattaatgagaagagacagatggaagggtcaccgaacagttctgagtcatttgagcatttagctcgatctgcaagagatcacgcaatttccctttctgagcctcgtatgctgtgggggtcagatccctatcctcatgctgagcctcaacaagcaactactcccaaagcaacagaagaacctgaggatgtaaggtctgaagctgcgttggaccaggaacagattact

SEQ ID NO: 681412 - DNA, 257 bp, Homo sapiens
ctcacatacttcatcattatctccaaaagaacttatagcaagaatactgaaggaatgaaagtcagattaaaaaacaaaattatctcacaaagttcatcatcagatgatgcagctcaattacccccgctttcagtcactaactaataatgattataaaacgcgaaatactttgcataactcaagtatattgtttaataggcacaaagttgttcaaactatgtatcaatcagcaaaaatatctgcaaggtcattcatat

SEQ ID NO: 681413 - DNA, 369 bp, Homo sapiens
ccgttgtcaacagacgagctatcgacaggtgcttgtgcttgcgttgtgcggcaaagagcaataacgccaatgcaagcactggcattacaggaatcctcttcataggtcaccattcacgcggcttgctgggcgtgtagctgcccgactgaaactgcgcattggcggcgctacgacaattctcgtcacgcatcacaaggtcaggatcagccttacatttttcgagcatgactttccgctcgtcctcgtgctgtttgtagtattcaatcgaatgcaccggttgactacacgacgcgagcaagatactccctaaacacatacaaccaatttgaatagctcgtttcatttatatttccttggaattaccagttt

SEQ ID NO: 681414 - DNA, 842 bp, Homo sapiens
gggacaagtgctaagcggaccagatagaatgatgaaggtgaataccttgggataatgatacatcaacaggtgaaccgtctacaacagacttatgtattgtggaagcatggagcaaatccatggcagaactcagggaaaatcagtgaaagataaagatacacatcagaaggtctccaggcaaacccattacctgacgtgactgttgagtataacactgatgtccaaaacagatctgtgctactatagaggcttcccaactgttgcaattcttgtgacataaacgactggttagaagataaaggtcaagtactacatatcagatgagagaccattgctaaagcatttaagggatcacttcaggtggtgtgggatcgcatggagtctgctaagaaactttggtggagccccctgccagaagtacaaagaatacagaccctgctattactttgcatggacgattacttgtgccataaaacaatgtatgaaggcaatagcaaattacaggggaagctaatataagagctaaacaggagcaaggaagcaaccaaccagtttgacagacgatgctgaagatgattcgtctagaagaaaaggatgtgaatggtggcgaaatttgcgggtgattaggatgatcagacctggtgagaacgatttcccttactgtctccactctgttcacctacaagggtgagacttgccagagggcgaaaggggcaaatcctatagggaaaacaggaccttggtaccccaatccaaatggccccctagacaaatgtttgcgcctcacgaggggggcagaccgggaataagcacaaacccaaagggacggtaagagaagacac

SEQ ID NO: 681415 - DNA, 402 bp, Homo sapiens
tctacacttgctgcatgggcgctcatccaggcagcttgacggcagctatgcgtcaataaagaaaaggatagaaaatacacaaaaacaaagccaccccacagtctgtcttttctcaaactataggagaaactaagggatggtgtggcctccggcgtgcctccgatctttcagagatgatggctggggaccaccggggcagagtcaggttgtctgcactggcctgagcgcttcctcgcggatcttcttaggtccttgtacttgtcctcgcataggcaagagatggcctcaagcttgtgagccctctccctgctcaggggctccaagggaaagctcaggttgtacgcttctgccaaagaacgaagatcaaaataatacttggcatatacaccgaaaggaacatta

SEQ ID NO: 681416 - DNA, 443 bp, Homo sapiens
tcgccgccaccatgtgcgaatgaatgttctggcggatctctcaagagcatcaacaacgctgagaagagaggcaaacgccaggtcctcatcaggccatgttctaaagtcatcggttcggttcttaaccgtgatgatgaagcacggatacattggtgaatttgagatcattgatgatcacagagctgggaagattgttgtgaacctcacaggaaggttgaacaagtgtggcgttataagccctagatttgatgttcaactcaaagacctagagaaatggcagaacaacctgctcccttcacgtcagtttggcttcattgtgctgacaacctcggctggcattatggaccatgaagaggcaagaccgaaaacatacaggagggaaaatccctgggattctttttttaaacgtaaagcataaataaaaagcctctcgtgccgaattc

SEQ ID NO: 681417 - DNA, 85 bp, Homo sapiens
aaaaaagtgtcccatttttaataactatattctattattttataaatgtgtaataaaggggtccctctttaaaaaaaaataaaaa

SEQ ID NO: 681418 - DNA, 713 bp, Homo sapiens
agcggggtggcgtcgtagtctcctgctccgtctgcggttccgttgctgtcctcggaaccaggatctcggcgtggcctatggagttatggtgacgaacgccgtgatgcgtgctgaaatggcgacggcccagtgcagggcatcatcaattctcgagcagaaggacagtcctggaccagtgatggtgtgcgtgaagcattactaggactgactgaaaggcctgcagtggcagtgccagtgtctcatgacgttccgtgaggataagtactggcaggctgtaccagctgcaggtcctcactttaatcctctatccagaaaagacggtgggccatcggatgatgagcggcctgttggacactgttgggcaactgtgacttgctgtgactaatacgatggtgatggccgactgtgtctacttgaagatcgcgtgtgatctcagctctcatggaggaccatgtgcatcatctggccgcacactggtgggtccagtgaaagaagcagatgagttgggccagaggtggccatgaagaaagtacacagacaggaaactgctggaagtcgtatggctagtggtgtactcgggatcggccaataaacattcccttggatgtagtctgaggccccttaactcatctgtgatcctgctagctgtagaaatgtatcctgataaacattaacactgtaatcttaaatgtgacacaaaacacatgaaatta

SEQ ID NO: 681419 - DNA, 408 bp, Homo sapiens
cagtggcgcaatcacagctcactgcagccttgtcctcccaggctgaagctatccttgcacctgaggctcccacgtagacgggaccacaggcatgcaccactacgcatgactaattgtgtaaatatttgagacggtgtctccatgtgttacccaggctggtctcaaactcctgggctcaagtgatcctgccatcttgtgctcccagagtattgggattacagacatgagccactggacctgcccagctacccaactacatgccagttgttaagagacagattcgctccatcgtccaggactgagatgcagtgatgtgatcatagctcactgtaacctcctctgaggctcgcagttctgccaccagcctgctttttattattttgtacagatggcgtcctgcttgttgcc

SEQ ID NO: 681420 - DNA, 429 bp, Homo sapiens
cccatcacattatcatgtgcaatacttctgcagtctaccagactcattgtacagctggtcattactgcgtgacatacacccaaagccatataaattctagctatctacatcatcagagtgaaacggtcacctttactcaagttgcctcgtttgtcgaaccatacgttcctatgtgcgcttcagagtcctaatgtgtcattggcttagtcagtattgaggcatagttatcttccacgacagggtaacagtctacagccaaagactagtatagcatagtccatggtggtgttcactgaccggtatctcttctgcccacgatagcatcatctgtgtattcatggccgttgtccggacggtccatcacgatgagagattgtgaataatccatgctatgcagcggttgcacccagctcctcgccagccagacac

SEQ ID NO: 681421 - DNA, 123 bp, Homo sapiens
cggggtgcaggcagatgcatgaacctggagttatggtgaattgagatggatccgtgtggagacgcttcaggcttgtgtggagggagcggcgtttggtaaatatgcaggagttgacctaatgca

SEQ ID NO: 681422 - DNA, 299 bp, Homo sapiens
tccagcgggccccaagcaggaggagggagaagtcaggcggcacaagaggacaggacccggcccaaggcagagcggcttggccccctcttcccctcaggcatcccggggacccggccgggtggtccacccacatatgcacggctctctcggtctgggaccacggtaccatcacccacaccagcttctgagccagccctccataggcgtctgccctgaatcatggcattggtctcagaagattttggatattaatgtcattctgcactaatgagtccagcccactggggggccagctggag

SEQ ID NO: 681423 - DNA, 475 bp, Homo sapiens
cgatctagaggatcccgtctcatgcacagttggacaacggatccaaagaagtaagcagatggtccaagaggatccagctagtgagtgacagagccagaactagaacccaagcaggaaagagggggggggggctgaggataattcctagaaggcagatggcacacctaccggtactgcataacggctgcatgcaggcgtggggatgcaatctcagggcaggcatatgcatatgcatatgtactcacacatgccttcatagggcagctatacatgcacccatttctaatccccatccccatacacatcgggacagatatctctcatcttaacccaagccttttcagtcaccagagcactagggtgcaccagtagtacattggggggagtcatttttcttccagccatagcagccctccggtgtcttgaagggccctactttatggcttgccttgattggccggaatcctctctgata

SEQ ID NO: 681424 - DNA, 292 bp, Homo sapiens
tacaaccgagctcgtacccctaattgcttcttcgatgacgtgacctccgtcatttaggatgcccttatggagcatattctgtgacctaggcactgcaggtgcagcagtgaacaaaacagacccaccccctcaaaaaatccttgccctccttgtgtttatatgccagtgtgggggttgatgtggacggcaataaacacataaataagcaactctatggatttccaggtagtggcaagtgccacagagaaaaacaaagcaaaaaaagggaacccgtcatcgaagaaccaattag

SEQ ID NO: 681425 - DNA, 428 bp, Homo sapiens
cccgcgctgtacgaattttgcacgaggagagagagagagagagagagagagagagagagagagtgttctgtcaaacatacactcttgtgtgccactctccacaaatttggagaaagagctttctcagcatgtgcactaactctcctgagccacatatttccccaagctgagtttgcagataacttccacggttatgaccgatcttatcaaagtccacacggtatgctgtcctggagaactgcttgaatgtgctcatgacagaggcgagaccttggctatatgcgtgaaccaagattctgaacccagtacactgtatgaatgcgtgtgagactcccctgtttggaaattccactttattgttcgaatggtgatagagattcctgttgactctcctctatttcctcctgttcttttcgggcgtctttttc

SEQ ID NO: 681426 - DNA, 286 bp, Homo sapiens
tttttttttaataagcagcaacgttgtcattccgctatggacctgttttctgcatattaattctccagtcagtaaccggtgcaaagtgtgtttatcctgtgtttccatttaattggctagtaaataaataaataaaccagtttgtgtagtactgaatcataagtaaggctatgggttttgcagatgcaaggagggtatgactgttcagaatgatgatatgatacgaggttatgattaataagttgactgtttatagatgtgataggtaaagaccgtttaggtcgac

SEQ ID NO: 681427 - DNA, 218 bp, Homo sapiens
gagactagcctcaggaatatagggagtccccatctctacaaaaaataaatataaaaataaactaaccagacatagtggtgtgtgcctgtgatcccagctactcaggagactgaggcaagaggatcacctgagcccaagagttcgaggctgcagtgagccatgagccatgatcatgtcactgcactccagcctaggtgatagagcgagaccctgtctct

SEQ ID NO: 681428 - DNA, 898 bp, Homo sapiens
ggctgccggacgcggagcgagaggtgagagagtcggagacatatccgttcatccgtcgcgcaacctgcggagcgtgcgtatggatgatcgagaggatctggtgtaacaggcgaagttggccgagcaggctgagggatacgacgaaatggtggagtcatgaagaaagtagcaggattggatgtggagctgacagttgaagaaagaaactcctatctgttgcatataagaatgtgatggagctagaagagcctcctggagaataatcagcagattgaaccagaaagaagaaaacggggaggagaagacaagctaaaaatgatgcgggaatatcggcaaatggttgaagaccttgagctaaagttaactctggtggtgaccattcgtggattgtagtgacaaaacacctcattccagcagtaacaatgggagtccaagggtttctatttatacaaatgaaaggggggactaccacgagggtatccgtggcagaatttgtgccacaggcaaacgacagggaaggagggttgcggaaaaacagcctagtggctataagcgtgtagtgatattgcaatgacagaacttccacaagcattctattgagttaggtctgtgtcctaaattttggcggatttaatacgaaatttttaattcccctgacgggctgagggtgtggaaaaagagcttgtgatgtgaatcgagacgggatacgtgagtgaagaaagttacggcattacttttatgagggtagtgtaattggactaggattcaaatgggggaggggaacgcaaaaagaaggggggtgggaaagaaatagggataggcaaaaattttgactttcaacacgtggacacggggagaccatttttggaaaaggggggtgaaacaaagagtaggagaa

SEQ ID NO: 681429 - DNA, 685 bp, Homo sapiens
cgcggtggctcacgcctgtaatcccagcacttgggaggccgaggtgggcggatcacgaggtcaggagatcgagaccatcccggctaaaacggtgaaaccccgtctctactaaaaatactaaaaattagccgggcgtagtggcgggcgcctgtagtcccagctacttgggaggctgaggcaggagaatggcgtgaacccgggaggcggacgcttgcagtgagccgagatcccgccactgcactccagcctgggcgacagagcaagactctgtctcaaaaaaaaaacaacacaaaccaaaaaaaacccacgaacatggctggtccttacaacctactctttccggtacccaatactgccacaaatatttcgccatctttataatcaggctactaaccacctaaagagacacggttcatacatcggatcgacagtacatgaaggtgcctcagaaaccaatgaaccaggtacgcatatctggattggctgaaaaggataccggggaagactccgcacacacgagcatgggccggaggacacaaataccacagcgtcttaatacaatggcttagctccaaaccatagcaaaaagagcgagaacacacacaacagaggacgggacagcaagaacggggcggcacactccataaacacactacaacggggaacataaccaaggcacaggaga

SEQ ID NO: 681430 - DNA, 304 bp, Homo sapiens
ggcaaccaaaacttagcctcactccacttttctaagatggaaattcttttttgggccttggactgcttctagggtagcattttgtaggtcactctggcctttgtactattttgcttcttgcctgatgtccttaggtctccatcctactgctggctaacttggcctcatttctcagcttctgcatttccttcctgctcctaacagatgagaagcaggctgcagctcgatgtgtggaagatctcagcctccttgtaggggataaggggatgtgcacatgcatgtgattcgacgacaagttccagta

SEQ ID NO: 681431 - DNA, 224 bp, Homo sapiens
aatgtgtaagtaggtccccatcatgtttaaaagaatcattttggctgggcgcggtggctcacgcctgtaatcccagcactttgggaggccagattgcttgagcccaggagttcagggccagcctggccaacatggagaaaccctgtctctacaaaaaaagtaaaatattatctgggggtggtgacagatgcctgtagtcccagctactcgagaggctgaaatgg

SEQ ID NO: 681432 - DNA, 233 bp, Homo sapiens
cttagaagagctagttttgcatatttaacacaattcataaaacagggccaggcatggtggctcacatctgtaatcccagcaccttgggcaggctgaagtgggcggatcatgaggtcaggagtttgagaccaacctggccaacatggtgaaacctcttctctactaaaaatacaaaaaattatccaggcatggtggcgggcacctgtagtcccagctactcgggaggctgaggc

SEQ ID NO: 681433 - DNA, 1757 bp, Homo sapiens
  misc_feature (227)..(227): n is a, c, g, or t
  misc_feature (256)..(256): n is a, c, g, or t
  misc_feature (380)..(380): n is a, c, g, or t
  misc_feature (397)..(397): n is a, c, g, or t
  misc_feature (1059)..(1059): n is a, c, g, or t
  misc_feature (1757)..(1757): n is a, c, g, or t
caggagatggagaccatcctgtctaacacggtgagagcccgtctccgctaatatatacaaataatattaggcctgcggcattggttggctaggttgtccctgataggtcccaagactacatcgcgcacgagcatgtcaggcaatggaaaattggtcagtaaatcccgggcatggtggacgcttgccatgtgagcactgagattgcatctcactgacagtatcctagngcctgggttgaactgagccgcaggactcntgttcttcatacaaaagaacaaaataagaaagagagaagaagaaatgaatgaaatacatacacaaacaatagaaaagaagcgtgtttcctctagaaccgatgtgacacatgtgcgcgctgttgntttgtacgtgtgctcanaaacacgaggggttattaaaactgcccagtgttgacgcacctcgagcctatagaacatgagcgtgcgagtgtgaatctattgtgtgtgtgtctttagaccaccagactcaaaggacagaagtcactcgccgagagacaaacaatctccccgggggccccttgtgtgcgcaacggtgctgttgtgcaccgatgggctgctctctacgacgggtgataatgatgcgagtttatttctcctacgacgccctattaacagtgccaatgtgctgcgcttgagagctgggctttggggttacgatgtgaggtgtagccggaggggcggccacgaggggcccccctgggtcttcacgacgtttggctccttctctattatttttgcgtttcataccaagagtgatttttatcacccaacttctttttcccgtagtgataatttcatatatgggaggacgccagtattaacattagtattggggcggggaagagaaaataccgcatattaccacctttttgggcatttttttctccttcgaaaaatataacaagcgcggggtgtggattccaactttttgggttatgagaaggaccgccggctcctagcggatgagtaacaccctttgtgtggcaccttttcaccacaatgttgcgcgcgggtaatgtanacaccgcgagcgttattatactgccgcctctagaacctttatggtgccgccggcgggacgcaaatccgcggcttgttaggagggcattctgtgttttcttattattccaccgcccctttgttatgggcgcgtttttagagggcgaaatttctgccccatatagaggggggtttctccctgttgccggccggacgcaccccccagtgtttttttacaccagcgttgttcccccccacgggcgggcgggagaagcaacacttttgtgtttcgactcgccacaaggtgtgtcgtcgtctacacaagagacaattttgcttcggacaccatccttgtttgttgtacacacacggtggccgccgacgaggggagaacaccccgctcgctgaagacaaaccccccccagagagagagagacttctttttcttgcgtgccaccgccccgctcacaaattaatttctccaccacaaaatgttgtgtctatttcccagaaagcaagcccgcttcacaggctgatggtgttcgtaacgacggacgagattctacatcttgacatgagctacaagcaataggatgccggcccaacgtaggagagcagggagagcccctcatattcatggagggacgtgctgcttgaaagcacccgcctcatgcagataactgtttccctccttgcagagcaaacaagaacaccctcttn

SEQ ID NO: 681434 - DNA, 638 bp, Homo sapiens
cccaccttagccgtgggggatagaagagagcgggagggggcggttcccgttccaccgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccacggtcatcccactagccacggtcaatcccacaagccacggtcaacccacaagccacggtcaacccac

SEQ ID NO: 681435 - DNA, 453 bp, Homo sapiens
cggcttcctggtcacaggtgggttcaaagactttctgattaacaattggttgagagagttaagttattatctgatcacctggactcaacagaaaggagtgtctggattaagataaggggttgtggagaccaaagttcgtattctgtagaagaaatctcatagggggctgcccttcaaggcaatagatggcaaatgtctcctattgagacctttgaaatgtgctagatgctaagcccatctctccagcatcagaaaaagccctggaaagggaagaggattctctacagaatgtggattttccccacaagagacagctttgcggggccgtttaaaattatgtcaaacactctattccttccaggacctgctccctgtcatgtgatgttatactagactcgggttggaatttggtgtcttattgctacaaacagcctgtgctgtcagtcaaaaaaa

SEQ ID NO: 681436 - DNA, 112 bp, Homo sapiens
tggaaagatagatgtcctccagagcagagggcagcctggaatgtggcccgcacgcggactcgaggtaggtgcggagagtggcacgtcgatcgcgggcgcagctctgtgacag

SEQ ID NO: 681437 - DNA, 897 bp, Homo sapiens
atatcctataatatatataagtatcaataaaaacatgaagcacagcatcataataccgttacgacaagaaccggaatatacaatatgggctcccccaccgcctatggaaccccaatttttacaccataaattatcttcgccgccaaaccccgattctccttctccgcggggaaaactatttaaaaacaacagggccgaaagagatccccaacgacgactggcccaaccacaccgaattcctctccgaggcacaaaaaattacccccccatttcccattatattaaggcccctcctctgcttgtacctgcgagggacttcccccccgaggggtgccccagcttgtctacccccaacgggttgaccaacaccgatggcggtttctttaagggctttgcttagcgccaacacaaaagggtgtctttaacacctggggaatccgacttcaagtccctctgcgcttgcaccatttcttctttggtgccgggggactcccccccccacccttcttgtaactgccccgcccaggtggacaccttagtgtgagaacacccaacccaggggagcagcatacttgcaaacagtctcagcaacatcccgcttctaaaacgcatactagtcccaaatcccaacacgggttgaatcaagttttctccacccacacaccttgagaattttggagtatcttggattgaaaactcggtcttgaacagacctcctctcttatattaaaatttttaaaaccctgtttgcccagaaggccggaaatgcaccctaataataagaggagtcgcttctgttaaagacactacccaccctcaatctccgagagttgaaatccccccccacaaacttggggggcccttttaaaatttttttccccgcccccacaaaaacaa

SEQ ID NO: 681438 - DNA, 603 bp, Homo sapiens
catgagcatgattgtgcagtataaccagagaagtctctatgcggtgatctgacgagtggcattatacaccgtatctggagatcactgcttctaggtctctgaataaccgatatcttagacaccaaggccactgtgcacaggcgtcagatacatgtctggagtggaataaccttgcgcaagagataccgtgtttgagcaagtgcatttgcaattgcactggcatgaacatagaggttgtatgatagcattcgtatagcaggtatttcccaaatgggagaagccctgcagttgctgcagttggtgagaggaaaggggcactcttggttgattccagccagtgtaatcctggattacacctcagttttttaacagaaagaggaagctggccgaggaaaaaaatcccaaacttcttttggcagagggagtctggcttgaaacattagtcctgtctaagttagtgccaccagaagagtgttccttggatccagctctgctaccataaaaggatgatgactgtaaaggtaaaagccctgatgtcctattctcttctgactgtttcaaactcagctgcttttctctactgctggtcaatactttctggag

SEQ ID NO: 681439 - DNA, 928 bp, Homo sapiens
  misc_feature (43)..(43): n is a, c, g, or t
  misc_feature (64)..(65): n is a, c, g, or t
  misc_feature (89)..(89): n is a, c, g, or t
  misc_feature (119)..(119): n is a, c, g, or t
  misc_feature (126)..(126): n is a, c, g, or t
  misc_feature (177)..(177): n is a, c, g, or t
  misc_feature (187)..(187): n is a, c, g, or t
  misc_feature (204)..(204): n is a, c, g, or t
  misc_feature (206)..(206): n is a, c, g, or t
  misc_feature (224)..(224): n is a, c, g, or t
  misc_feature (242)..(242): n is a, c, g, or t
  misc_feature (248)..(249): n is a, c, g, or t
  misc_feature (264)..(264): n is a, c, g, or t
  misc_feature (275)..(275): n is a, c, g, or t
  misc_feature (282)..(282): n is a, c, g, or t
  misc_feature (299)..(300): n is a, c, g, or t
  misc_feature (303)..(303): n is a, c, g, or t
  misc_feature (306)..(307): n is a, c, g, or t
  misc_feature (313)..(313): n is a, c, g, or t
  misc_feature (330)..(330): n is a, c, g, or t
  misc_feature (334)..(334): n is a, c, g, or t
  misc_feature (337)..(337): n is a, c, g, or t
  misc_feature (354)..(355): n is a, c, g, or t
  misc_feature (407)..(407): n is a, c, g, or t
  misc_feature (412)..(412): n is a, c, g, or t
  misc_feature (439)..(439): n is a, c, g, or t
  misc_feature (443)..(443): n is a, c, g, or t
  misc_feature (502)..(504): n is a, c, g, or t
  misc_feature (702)..(702): n is a, c, g, or t
  misc_feature (849)..(849): n is a, c, g, or t
  misc_feature (916)..(916): n is a, c, g, or t
aaaacaaaaacaaggaaacaaagaacaaataacttgaaaatangcttgtcaaatgatgtaaatnnatcctttccagggagggagaaggnagagcctaacagaaagaaaagatgcttagntaatggnggttaaatttaaaaatacagttaaattcaggctaacttctgaaaatcccgntttattcacntcactgtgggaccagtnantatactgagtcaggttgntttacagttaactatgtnacctannacacaataatccatnaacactctaanaacagtnattgggtgtggtcatannggnganngttaancatatagttgtgttggnaatnttnttttttaaagaataaanngtcttagtataagtgactggatttgtgtaacaaagtaatgaaagggacagcnaatcnaagcggacttaaccctattcaacaacnagcngaaaaaatactttggttcttcaaggaaaaaattacaaaaaaaaaaagaggggattgggnnngagagttgttaattttcatagctgtactccaagagctacataaaaatattccagaagaaccaaattatgtagcaatgaatgaacatgcgtgacagaatttgtgcattcaacatagctggcagaaaaactagttaaaatgctaggtagaacaaattggtctttaaaatatcagtttcctgtcctttaaaaaaaaattanctagtctaccaagaaaatacaaaaacataaggctgtaagtaaataagagttgtgtttaggctattacagtgcaggttatcctcaaggccacatacatcctgcttcactgctgcttgcactctgctgggttttgatccttctttgggncatagtctggatcatttcctcatctccttcttcttccccttcctcatccgcttcttcaccttcttcntataatcatcat

SEQ ID NO: 681440 - DNA, 122 bp, Homo sapiens
tattgaaaatgaatttttcacaaatgtttcttgtacaaatgaatggaattgcaccatgctgccctgtggacaccattagtgtggcctgatacccaactggtgacctggtgacttctggggat

SEQ ID NO: 681441 - DNA, 1059 bp, Homo sapiens
agcggagtttcggccgggagagactgaacagccgtgaactagagcgcgagcagtgatgcacagtccgtcgagtcgacaagctccagcatcccgatccaggggttgcagtgtgtgtgtggaggcatagaatacatagtgactagaatatgggcttttcgcattggtacatctttctcgttatgacgtaggattcgtgcaaagtatggctacagtgtgcgctatctttcgctcttgcaaggaagactcattgtgtgacattgtcaagatgaatatgtataatcgctattacagtcctacatggtgtaatgatgcaaaagatgatttcgtcgtatcctcgttcacaatggaccgtactttggcatccttgtcagaatgggcatatgactgggaatctttgaggggacccctaggtaatcttatcaccagaaaaaggaagattcccgtccaactccaactggggattaatgaaacaggtccttataagaaattgaggtggaaacgaaattttgacattatcttttggaacgggagttttgactaaacctattgagttgagcttgacttaaataggtaaggaagcgcaattaatggttgaattgacaaagatttgggcaaagtggtccctgtgtatatgttggcgagtaattggacttttcgagtggttcaccattgaagggaagttttttgatgcaccaattggagtgtagaatataagtacttgtttaaagtgtcacggtgaggtcattattcactgctgtgaacgtggcataatcaaagaaagaggtagggcccgatgagtcccaaaggataaggattcaaatgaaggttgggggtggaaggaatgtaaactataaataacgaaatcgttgggtggacaaggaattttggggtagataaccctcgaaaggtgaatttttggaagttgctggccgaggtgtaattctgggtccctcaatttaaatgactggtgcatacttttgaagggggaaactggaaagttcgacaaggttaaggggttgtcacaattcttataaaacgctttattttcactacagtgat

SEQ ID NO: 681442 - DNA, 445 bp, Homo sapiens
accctgttcgttttcagccaggccttttttggttttttgttttgttttgttttttgagatggagtcttactgtgttgtccaggctggagtgcagtggtgcaatctcagctcactgcaacctctgcctcctgggttcaagcgattctcctgcctcagcctcccgagtagctgggattagaggcgcccgccaccatgcctggataatttttttttttttaaaatttttagcagagacagggtttcaccgtgttagccaggatggtctcgatctcctgacctcgtgatccacccgcctcggcctcccaaagtgctgggatttcaggcgtgagccactgctcttggccagggccttttttttttttttttagaagaaatttctgcggatactctcatatctcttcacctgcctcttcttcccccttgtgctgccaccgtgcttatctca

SEQ ID NO: 681443 - DNA, 255 bp, Homo sapiens
actctagaggacccttactgtggtgtaccgtgctctgtatgtgagatagctttcttgtgctgttaaacacagtgtgcccacaaattagtccatgtaataatgcatgtctagtgcactttctttttttaactaaagctaaggaagaaaacattgccaaagattccgtgtaagcctttgttttaagagtcactgtagacagatggaactgttaaaagtgctgacatcttttttttcaagttctgtatatttcacttt

SEQ ID NO: 681444 - DNA, 328 bp, Homo sapiens
  misc_feature (163)..(163): n is a, c, g, or t
  misc_feature (192)..(192): n is a, c, g, or t
tacttttcacagggggggaaaaaacagaaacctcaagtttgtagcttctcactacataaacatgtactaaattctaaatttgaattttttttaagtgtgccataccatctaatgaatggaaggcaatacaatgtagacctggctttaaggatcaatttcaggngcgatctacggggggactgatatacaggngtgctaagaagtttctgcttaccctcagaaatacctctcctaccaagcaaactaacgcctaaaatttgagaattttattttcttagcttagacttttgtcttcttttaaaatacaaatatccctgtggtaaaagta

SEQ ID NO: 681445 - DNA, 205 bp, Homo sapiens
  misc_feature (52)..(52): n is a, c, g, or t
  misc_feature (54)..(54): n is a, c, g, or t
  misc_feature (57)..(57): n is a, c, g, or t
  misc_feature (71)..(71): n is a, c, g, or t
  misc_feature (118)..(119): n is a, c, g, or t
  misc_feature (149)..(149): n is a, c, g, or t
  misc_feature (154)..(154): n is a, c, g, or t
attgaaaactccttgcacttagatttaatttatatgttagttacattattantnttnataaggcatttatntgagtcattgctctacagagagcaattaatggcttgtaataataaanngaatattttttttgtaatgcattgttgaangacanccagaatatcaggaaaatgtatataggaatatgctacttgcctcctccctg

SEQ ID NO: 681446 - DNA, 171 bp, Homo sapiens
aaagaaccaagagcctctgaccagctgttactcactaggtcttcctaaccaggggtaccttgctgtgtgaactgaggcagagtcagccatcccaatctacatgccttggatatcatgagagcatggatcaccaatcctcaaaagtgtcctggaccccaggtttctgactag

SEQ ID NO: 681447 - DNA, 856 bp, Homo sapiens
  misc_feature (176)..(176): n is a, c, g, or t
  misc_feature (229)..(229): n is a, c, g, or t
  misc_feature (250)..(250): n is a, c, g, or t
  misc_feature (260)..(260): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (279)..(280): n is a, c, g, or t
  misc_feature (284)..(284): n is a, c, g, or t
  misc_feature (292)..(292): n is a, c, g, or t
  misc_feature (298)..(298): n is a, c, g, or t
  misc_feature (300)..(300): n is a, c, g, or t
  misc_feature (306)..(307): n is a, c, g, or t
  misc_feature (309)..(309): n is a, c, g, or t
  misc_feature (317)..(317): n is a, c, g, or t
  misc_feature (433)..(434): n is a, c, g, or t
  misc_feature (439)..(439): n is a, c, g, or t
  misc_feature (444)..(444): n is a, c, g, or t
  misc_feature (453)..(453): n is a, c, g, or t
  misc_feature (456)..(456): n is a, c, g, or t
  misc_feature (460)..(460): n is a, c, g, or t
  misc_feature (467)..(467): n is a, c, g, or t
  misc_feature (478)..(478): n is a, c, g, or t
  misc_feature (498)..(498): n is a, c, g, or t
  misc_feature (503)..(503): n is a, c, g, or t
  misc_feature (505)..(505): n is a, c, g, or t
  misc_feature (511)..(511): n is a, c, g, or t
  misc_feature (523)..(523): n is a, c, g, or t
  misc_feature (526)..(526): n is a, c, g, or t
  misc_feature (529)..(529): n is a, c, g, or t
  misc_feature (533)..(533): n is a, c, g, or t
  misc_feature (538)..(538): n is a, c, g, or t
  misc_feature (540)..(540): n is a, c, g, or t
  misc_feature (550)..(550): n is a, c, g, or t
  misc_feature (555)..(556): n is a, c, g, or t
  misc_feature (558)..(558): n is a, c, g, or t
  misc_feature (586)..(586): n is a, c, g, or t
  misc_feature (588)..(588): n is a, c, g, or t
  misc_feature (597)..(597): n is a, c, g, or t
  misc_feature (602)..(603): n is a, c, g, or t
  misc_feature (608)..(608): n is a, c, g, or t
  misc_feature (611)..(611): n is a, c, g, or t
  misc_feature (621)..(621): n is a, c, g, or t
  misc_feature (624)..(624): n is a, c, g, or t
ggggattatgctgcaatttagcatgttggaacgtctagggagaaggttgactttttgcacttctgtatatagtcaaaagagagaaacctgtataatagtaagatcttatttgaataaaaagtctataattacaaggagtttgttaaggctaatacaatgacagatgagcaaaatgnttgcaaaagtggcacagagttagcactccataccccttcaaacatgtggcttngctttcttgtggacagcttgnagttgccagnattttttanctnganaganncgcnatcctttnaaaccntnatgatnncnaaaactcnatggggccaaatctgcctgagagatcattaccaaaaatagcaggtacttctaccattaaggtgaaatcatggatcagatattccttacatttttcaaaactactgcatgtttaaannttacnaaaanagagagaangantatnctaagancatatattatncagatcagtttgtgcaattncaggntntatgtncacaaaaaaatnttnaanacangtatngntttcacaaantttanntnataaacggcaaaccaaacagcacactgnanctatagtgntatgnnatgtnttnaattgtgtangancctgttttttcagcgaggtgaaaaataaacgcagtttcaaaatttcagtggtttaaatttccagtcagaagcatcaaaaatgcaaatgtgatatgggcatgttgaaaagaattaggtatcagcttcatccagctgttaaatggtgcttatcaggaaccctaacattcattgtcggacaggccaatgtggtggtgctattatgtatcaaattattttggtgaatggttaaatt

SEQ ID NO: 681448 - DNA, 212 bp, Homo sapiens
gtggtcgacgaaagggtttggtttgtatgttctcctccccagaagaagccactaaagcagttacagagaatgaacggtagaattgtggccacaaagccattgtatgtggctttagcctcagcgcaaagaagagcgccaggctcaccctcactaaccatgtatatgcagacgaatggcaatgtgtacagagcgtgttcccacacccgtgtaat

SEQ ID NO: 681449 - DNA, 757 bp, Homo sapiens
  misc_feature (1)..(1): n is a, c, g, or t
  misc_feature (74)..(74): n is a, c, g, or t
  misc_feature (190)..(190): n is a, c, g, or t
  misc_feature (228)..(229): n is a, c, g, or t
  misc_feature (240)..(241): n is a, c, g, or t
  misc_feature (249)..(249): n is a, c, g, or t
  misc_feature (263)..(263): n is a, c, g, or t
  misc_feature (288)..(288): n is a, c, g, or t
  misc_feature (467)..(467): n is a, c, g, or t
  misc_feature (485)..(485): n is a, c, g, or t
  misc_feature (510)..(510): n is a, c, g, or t
  misc_feature (578)..(578): n is a, c, g, or t
  misc_feature (682)..(682): n is a, c, g, or t
  misc_feature (714)..(714): n is a, c, g, or t
nagaaaggtgtgtggatgaggagtgtgggtgcacatcacgtagcagcctcttgaggtggtcctcgggtcccccnctcgattctccagtcccccagagactgacccttgtccgagtcgttctcgagccgcacaaacttgccccccaggccgatctcctcgatgctgacgctacccgaggccgaggcctgcngggccagggggaagccaccgctgccacccgtgcccgcnncccaggacgcnngggccgcngcccaagggctccnccacctccagccgctcccgcttacngcggcccaggcgcccgggggcggacaagccgccgctgctgcccgaggtggctcgtgagagggtgacgcgcgaggatgggctgggggacagcctcagcctctcctcctcgccctccaggagcttccggtaggcgtggatctccatgtccagggccagcctcacgtccagcagcccctggnactcggccagccgctgcngcatcacgtcccgcatctccgtcanctcctgccccttggcgtccagcatctcccggaacttgtcccgctccccggccatggcctcctccagcncccgaatgcgatcttcagcggcactggcctgcttctggaggccggagagctggtagctgagggactacaggcgcatgcgggcctccttcagctcctcgcgagcngcactggccgccttgtcgttctggtcagagcncagcttggcgctgtccagcttggcctggtaggtctgctccagc

SEQ ID NO: 681450 - DNA, 255 bp, Homo sapiens
tgggggccgggaaaaaaattttttgggggggttaaaaagggggggggcccatttggaccccttttggggggcggccccccttttttcccaaagggcccatgtggggggttgttctcaccccccccccctttgggggggcccctttttaacccccccttgtttaaaattcttacagttgggactggggggacccccctttttttggaaaggggattttttgggggccaaaaaaatttaatttggccctgggggggg

SEQ ID NO: 681451 - DNA, 154 bp, Homo sapiens
agaggatcccagttaagaagttcaatagcatcttacacacacatgtccataaggatatctttggttttaatgaaaatgagatggtgcattatgtattattctggtaaggtggccttttttcactggattgtatctgtggtattttttccatatg

SEQ ID NO: 681452 - DNA, 880 bp, Homo sapiens
  misc_feature (129)..(129): n is a, c, g, or t
cttggagagccagcccagtaagaaaacggaggaccacatgtgcccgagaatctgattcattactttgcattggatgacggttgggtgaataccagaggccctaaataagaaagctatccagattattancagggttcgagataagctcactggtcgggacttctctcatgatgacactttgtgatgttccaacgcaagttgagctgctcatcaaacaagcgacatcccatgaaaacctctgccagtgctatattggctggtgccctttgctggtaactggtaggcccagatgtgcccatcgacgttattttctggaggctttggtcactttagataagatagctatccacttaaactagaaaccatggtgcagaaagtttgactttgttaacatatttggaagatgtaaatgaccaagaactactgtagtattgacaaagttggtttgaaccaactttctagctgctgttgaagcaatatatcgtcagaaaacagcaaggcttgatgtaggttcccaggacagtgaaacatagtaataccacgtaaactcaagccattcattatggggaacagaagatccataacctttagcaagatacgggttattgacttaagctcacaagagaactcatcataagtactttgctgatggacgactgacctagtggctcctctcaacatgggtagcagcacaactcagacacagcaagaagcctcaggtcgtgggagaaacatggcttacggaatcgtaagactggaaacagcaccaccgaacgatgctggacctcaacccatggcagctaatccaagacctcactggatcggtgcacagcaggaagacaatgaacgcacgaaaaggccaaaatgagtacaaccaggt

SEQ ID NO: 681453 - DNA, 397 bp, Homo sapiens
ggaagtcaaggatgcagtgagccatgatcaacccactgtactccagcctgggtgacagagtgagaccttgtctcaaaaaatataaatttttttggccaggtgtggtggctcgtgcctgtaatcccagcactttgggaagcagaggcaggtggatcatttgagtccaggagttgaagaccagcctgggcaaaacagacccgtttctaccaaaaaaaaaaaccaaaattgggcctgttgtggtagtgcacacctgtagtcccagctgctccagaggctaaggtggaaggacaatctgagcctggggactttgaggctgcagtgagccaagatcaagccagcgcactccagcctggacgatggcaaaaccctgtcttttcaaaaaataattcatatcctc

SEQ ID NO: 681454 - DNA, 476 bp, Homo sapiens
aaaacatacatggggatcccggatcccacatggtaaattgattttgttttgtttttgagaccaagtcttcctctgtcgcccaggctggagtgcagtggtgtgggatttcagctcactgcacctctgtctccaaggttcaagtgattctcatgcctcagcctcccaagtagctgggactacaggcacccaccaccacacccggctaacttttttgtatttttggtagagacggggtttcaccgtgttggccaggatggtctcgatctcctgacctcatgatctgcccgctgggattacaggcatgagccaccgcacccaaccttattgtcattttaatgtctgtggagtctatagtgaaatcccctttcattcctgttttagttcattttctattgctatagcaaaatacccgagagttggtagtttataaaggaaaaagatttatctggtttatgcgtctggaggctgagaaatct

SEQ ID NO: 681455 - DNA, 210 bp, Homo sapiens
ttcagcgtggtctgcgccgcgtcggtcatcactgcggtagcgcccttcaaaacccgaggcacatgcacaggtacagcagctccagcaggtacaggcgttcccgtgggctttgcagacagtggtcaagcaactggaaaaccttttcaccaccccaggcttcgttgtgcacggtgatcagcaggctctgcttaccccagtcactggtgctgc

SEQ ID NO: 681456 - DNA, 1151 bp, Homo sapiens
  misc_feature (41)..(41): n is a, c, g, or t
ccccgggcgtctccattttggtctcaggtgtggactcggcnagaaccagcgcaagagggaagcggagttatagctaccccggccgcggaccggctcactgcactaccacccgaccccctatctattccatccagacgcacgaagatcgcggagcgcatcatggcagggcactggaggatacatgatatcgacatcgagacaagcgccggccacatcaccatgcagtgcaggacgcgacatcgtcatgcatatctatgaccatatggagaagatggatgacaccacggattacatgcggacattgaggatgtcggatgaccagaccggagatcccaaatgactaagaagctcagaacctcgctgccagcatgggtggaacaacagatacaagacctgtatgtccatccggtacatgcagtataaggatgggatccagaaaagcatccattgatgaacagccatcacacggtggcagagcagacatgctcctcaaatggtgcgtggacatatgcgcatcaacagacaaagatggccagacattgtacacctgacacttgggactgaattatcatccgatgctagacacaccatgggcgtgaccttccaccaggaccatacaagaaaccagtgaggacgctacgggtacccgaactcgctgtcatggacatcaatcaacaaccatatcccatgacgccagtggcgaacacaagctcactgctcagacagagcccccaacccggaggaaggtcaaccgacattggcaacacgcagacagcaagagggctggaaccccaaatcacacggaactacccacacaaagacaaacccaccaacaacacaggtacggacaagggcatcacactgagctagtgacaccaccatgtagcgcacagacaaggaaaggaacgaaggagaagaaacagccttcagccacccccctaaactaggaggacaacaggaacgccacgatttggcaaaagacagataggcaggaaacgccgccgttagagacacatgcgacttgccacacgagaacgcaccacgtaggacacgccttagcgtcccaggaccctccggagatcccagcatagcctacaccgggggcccataggaccccccacgaagagcacgcgaatgaaactccccatgag

SEQ ID NO: 681457 - DNA, 126 bp, Homo sapiens
actctagagatcccggaccttacctgcgggggctgagtcagacaggacaagttgaaccggcagtaccacggacggtcacactgtgcggggcatgggtcagacagaccaggttggacccggagtaca

SEQ ID NO: 681458 - DNA, 676 bp, Homo sapiens
  misc_feature (41)..(41): n is a, c, g, or t
  misc_feature (107)..(110): n is a, c, g, or t
  misc_feature (112)..(116): n is a, c, g, or t
  misc_feature (119)..(119): n is a, c, g, or t
  misc_feature (123)..(124): n is a, c, g, or t
  misc_feature (126)..(127): n is a, c, g, or t
  misc_feature (133)..(134): n is a, c, g, or t
  misc_feature (140)..(140): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (160)..(160): n is a, c, g, or t
  misc_feature (174)..(174): n is a, c, g, or t
  misc_feature (179)..(179): n is a, c, g, or t
  misc_feature (182)..(182): n is a, c, g, or t
  misc_feature (185)..(185): n is a, c, g, or t
  misc_feature (187)..(187): n is a, c, g, or t
  misc_feature (192)..(192): n is a, c, g, or t
  misc_feature (198)..(198): n is a, c, g, or t
  misc_feature (201)..(201): n is a, c, g, or t
  misc_feature (212)..(212): n is a, c, g, or t
  misc_feature (214)..(214): n is a, c, g, or t
  misc_feature (216)..(216): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (229)..(229): n is a, c, g, or t
  misc_feature (261)..(261): n is a, c, g, or t
  misc_feature (270)..(270): n is a, c, g, or t
  misc_feature (276)..(277): n is a, c, g, or t
  misc_feature (280)..(281): n is a, c, g, or t
  misc_feature (286)..(288): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (313)..(314): n is a, c, g, or t
  misc_feature (317)..(317): n is a, c, g, or t
  misc_feature (330)..(330): n is a, c, g, or t
  misc_feature (339)..(340): n is a, c, g, or t
  misc_feature (348)..(349): n is a, c, g, or t
  misc_feature (351)..(352): n is a, c, g, or t
  misc_feature (375)..(375): n is a, c, g, or t
  misc_feature (382)..(382): n is a, c, g, or t
  misc_feature (385)..(385): n is a, c, g, or t
  misc_feature (395)..(396): n is a, c, g, or t
  misc_feature (399)..(399): n is a, c, g, or t
  misc_feature (402)..(402): n is a, c, g, or t
  misc_feature (414)..(414): n is a, c, g, or t
  misc_feature (421)..(421): n is a, c, g, or t
  misc_feature (423)..(423): n is a, c, g, or t
  misc_feature (430)..(430): n is a, c, g, or t
  misc_feature (445)..(445): n is a, c, g, or t
  misc_feature (465)..(465): n is a, c, g, or t
  misc_feature (486)..(486): n is a, c, g, or t
  misc_feature (499)..(499): n is a, c, g, or t
  misc_feature (572)..(572): n is a, c, g, or t
  misc_feature (670)..(670): n is a, c, g, or t
ccccgggcgtctccattttggtctcaggtgtggactcggcnagaaccagcgcaagagggaagcggagttatagctaccccggccgcggaccggctcactgcactaannnngnnnnnttntttnntnnagaagnngaagtngngggngntaatggagggantggaggtaatgttngaatnggnagngnagganataaantgnaggaaggaagngntnttntgnttnttgnattgggaagtggtgaaaaaaggttaatgaggnttgggtgtnggtgannagnngggtnnnaatgataagaagtnagaantgntgnnagntgggtggaaaaanaataaaganntgtatgtnntnnggtatgagtataaggatgggtanagaaagntanttgtgaaagnnatnaangtggagagaagnatgatantnaatgtgntggaatatggataanagaaagtggaagaattgaanctgaaattggatgattatatngatgaagaaaaantgggtgaattaaaaaggaaataaaagaaaagtgaggagattaggtatagtattgtgtatggaataataaaaantataaatgagaagtgggaaaaggataatgtaagaagtaaaaaaagggagttaaaaaatgataaagaaagagaggtggaaaaaataaggattaataaanaaaaaa

SEQ ID NO: 681459 - DNA, 118 bp, Homo sapiens
tgactgtgactacgtggagtatattaggcttatgtagaatagaggttacggagtggtgatggtggctatatggtggggatatgaggctattgtttttttgtgaattcttcgactatgg

SEQ ID NO: 681460 - DNA, 253 bp, Homo sapiens
tggtgacgtgggatacggttcacagcacaccgggctaaaatttttttttggtggaaagggtttctttttttggcccaggggggtctcaggctccggggctcagatggctcttcctgcctcagttcccaatgggcacaggcacatgtggtagtttggtccctgtgcaatcatgcccaccaagagtgtcatatacctttaagtgaatggactttccgtttggttgcaacaaacaaaaaaaaaaggggctccctca

SEQ ID NO: 681461 - DNA, 758 bp, Homo sapiens
agcgggcgggtgcgccacgtctgaggccggctgctggccacgtctgaggcggctgtgtgccgctgttggtgtccgcgtcggaggagccggggcgaatggcacgatggaggactgggtctcgtggctcagagcccgggcgctgtggaagatattctagaccgggaataacaatgcgaagtgtgctgacagccttggccatccgaaagctcaccgaggctcaaaatcgtcgtcgcccgtggatctagtcgtaatacggcgtatagcacgagggcattcgaagcaacaacccggggtatccctgcgaacttggggccgattgagaaccttcgcgcgacttgggccaggcaaacggccacttgatcgcctagagacctttgcgtatagccacgagtcgagcgggtagaaaccgctgcgttgtttcgcaagcataaacttggggcagaagaggttcccctgtgaacctaaagggagctaaagcgcctgtggaaatctggcctgtcggttaacgtttggttaggggcaacgtttgttgccccccggtctggcggggggcgttcccgtttaacgacgacttctgtggcggcattagccgcgcgtccccatactatcccctgttgtcccagggtttcacccgtttgccatttcgccgggttatgcgtgtttacgcgttttggctgtccccccaagagtggggggcgactaagcggccacctcggtctcgaatggtccccccgagtggtttggcgcttgcaaaggcc

SEQ ID NO: 681462 - DNA, 391 bp, Homo sapiens
  misc_feature (26)..(26): n is a, c, g, or t
  misc_feature (36)..(36): n is a, c, g, or t
  misc_feature (40)..(40): n is a, c, g, or t
  misc_feature (58)..(58): n is a, c, g, or t
  misc_feature (73)..(73): n is a, c, g, or t
  misc_feature (85)..(85): n is a, c, g, or t
  misc_feature (108)..(108): n is a, c, g, or t
  misc_feature (113)..(113): n is a, c, g, or t
  misc_feature (167)..(167): n is a, c, g, or t
  misc_feature (388)..(388): n is a, c, g, or t
aatggcctaaggttgctagtggtggnaagggttagnctgncagaatttccagtttagnaagtccaacggaggnctcagttccagnacagggcattaaccgacttgtgnctggntatctaggtgcttggattgtccgagttgagtttgtctggtaagggaaatggggnctgcgtcggggggtcccgacaggcctggctgccagttcggcttccgcgaaaacgactcttgctgtccacatagccagccgtgaagccaaactgcaggcctctgccctcccctaaatgtcctcctaggatgcagtcactcgggaggaagatgtgcctgttaccaagtgcttcgtcccggccccagcgcagacctatgaatgaagatggatggagagctgatntga

SEQ ID NO: 681463 - DNA, 246 bp, Homo sapiens
cccccccaaaaggaaaaaaaaaggggagcccccccccgggggggccccttttaaaaaaaggggtcccccccgcccccaaaaattccccccaaaaggtttggggggccacccccccccttccccccccccgcccccccaaaaaggccttttcccggggggcccccctccccctggtaaaaaaaggaggggggggggggggggggggacccaaattcccccccgaaaaaaaaaccccccccccccgga

SEQ ID NO: 681464 - DNA, 223 bp, Homo sapiens
ataggtagtgaagttcccaggaagagcattagttttcatcgagagcttaagagaaaacaagaacagacgagatgggaagagatgttctgatcagcctttcactgagggcatagctctctgaggctccagctttatgaagaaggggaggtctcaattcaatttctctagttaatgtagttctaggtctgaatcttctttatttctatcggctctgcacgtctgc

SEQ ID NO: 681465 - DNA, 111 bp, Homo sapiens
atgacgagacgttcttactttaaaaagctaggagtgattacagcttagtgaggaaggcgtgttgaaagccaaggtaggctgacagctaggccttttgtgccaacagcctag

SEQ ID NO: 681466 - DNA, 441 bp, Homo sapiens
tatctgaagagaaaggaaagttgcatgcatggtgagtgagtgacacaggacatctgccaggatctatgggcggctgggcggctgacgataggagagtctggcatctagtattgatggttcaaataagccaactgtctggtctagtgctcacctgaatcggacgatcaatcactcggaaggccatggacggggcgaccattttaatcatggctatatccaaggctgcagcctatgtaacctgccaggtccatgaggtgggcagctctcagcaccagcagccgtgcctgctcagatctccacgcgcgaatgcgcaatgtccgccagcactgtgccctgctccaccaggggcttcccaaaagccaagcgggacttcacctgtcgacacaggagatgtgcggcagaagacaatgctgggctggaggtggccacgagaggcagggg

SEQ ID NO: 681467 - DNA, 976 bp, Homo sapiens
cagatatagaacactaaacatactcagttcttgtggggtctgggccttactttgctcttatatgtcgcactgtggatgtttgggtgctattggctgtggctgttgtattaccctcttggcctgggtataaggcttcggttttagtacccgtggagtggagagcttcaggttgcgttcttcgtggtccaccatggtgatgggctaggggagagactgttgaggacttgtgcggtgggggtcagtgacttgcctgtccctcggacggggggtgcgtataccagtgccttgtcgtttgtccgaggcccctctcggagctcttaatttgggagcggagatggcagaggcgggccataatgcccgcggtatgccagtggcagcagtcttgcgtgctcgagactgtaagtgtttcccagcgttcaatttcttccctcgctcgatgggtttgagttatttagccccatctttgcaggcgcgcttgcagctcatggtgccatgcggattctttcacctttgaaactccacccctcagctatgataaagtagtcttggcagaacattcgactggggcccctgttttgtaaatgcccgtggcgccgtccagatgttcaggttcgatcaattgtgctggcacccgctgcgttgagcggaagtagaggaccccggtgcatagccgattcccagccctgatagaatatggctacgagtcccaccgtagcgtggaagggagcgtgatgacagatattgcacaggtcggcgtggtacaagattcggtgaccttagagctaataagccgggaattataagtaaacaccagaagaaaggttcgtggccccccaaagataaatgaagcggtgcccgatatagtgttggacgtgttaactgaacacaatttgctccgacaaggcgaagggtggccgctggatgcttcgcgacaacccgcggaacagctcgatagcggctcttctcctgtcattgg

SEQ ID NO: 681468 - DNA, 965 bp, Homo sapiens
agaggagcgtggttgtctcctcttctccgacatgtgcgctgtgctcgcgcactgatatcaggtgtacgtacctgaatacggggaatcatcatgggaaaaatgtcactttgcctgctagtacttcaagtgctcctatgtcgagcacgatattgtgcaacactttgtatcaaaccgaatcttgctgtcgaattaatacctaacaagacagcctccatatgtctcgttcacgtggaattatgccacgtgtcatccatactatattctgagtctgtgagggtactggcagagctgtggctctaattcccagagttcgaggtgcgtgggactcaccgctctggccaggatgcttgtgtaaatcatgtgtcgtgaaggccgaatgtttgtgccaaccaacaagctggcgccgttggcagtcgatagagtgaacagctacagtcacataaagaggacgataactgggcaccattcggtgttcctgcgcctgtgcctgccatacacgaccctaccagcatctggtcgactgtctcaagtggtcatcgtgtagaggaagtatcctgaagcttacttgggtagctcgcgagatcaagttgaagggtacgaggaatgatcatactgaagctgtgagctccttaccgacatttacagctggtgatgtatatcgctcagggtctatgccgtctcagcgaatgagatgctgggctataggggcaaaactgaagacaaggctcgtacggaatccagcggacggagccccggggcattatgtaataactgcagactacttggtattcctctatcgccctcttacaacccatccctgggacttctcctgtttattgtaacaagtggactttagacactgcactttgtgacagtgtgcacttcggtgggatgaactgcccaaatgataaagaggtggtaaggcaccacagaaaattcaacagagtgccgttccctcaacaaca

SEQ ID NO: 681469 - DNA, 1642 bp, Homo sapiens
  misc_feature (1)..(1): n is a, c, g, or t
ntgtgtcttcgccgcgggcggggcggtgggcgaccgcgcctgctggatgaagggggctgccccgtacccgtgtggggcgtgagctttctcctccggcggtggagtgtcgcggtgccaagtgtgtgctgtcgctggtgtgtttgttgtcgacccactgtggttggcggcgcgctgtcggtgtggttgggccagtgtcgggggcccgttggggcgggctgttgcgggggcgcgcggcggtcggaccgggcgcccggagtggcggtgtggtggcgggtgtgcggcggtggggacgtggttgcgcctggtgtgtggtgcggtgggtggcctgtgggcaccccttgttggtggcgcgcttttcgccggtagtgggtgccgcggggttgccagtcgtcccaggcggggggtcgtgcgcgcggtcgccggcgtggcgttgcgtgggttgttcgaggttcgcttggccgcgtgtgcgcgcggggggtgtgccgcttttgtgcgtgcccagtctcggtgtagtggcgtggtgtgtctttggaggtcctagtgcgccattgtgtgctgctctgccggggtgccatcggcggttgcgccgcgaggtctggcttctgtgtctgtggctgtcgggcaggtgcgggtggggtgtgtggtggcgcggggcggcgggtggctgggccgggtggtggtgttggtcgtgcgtagccttccccttggcggtggttgtgctggggcgccgcgggcggactgtcgtttgctcgtggtgtgcagttgtgtgtggttttgattgccgggcgaggttgtggcgctccggtgtggcgctgtgggccgggtcttcggctgctccggcaggcttgttgggagtcggatgtgttgtccgttgtttctcggtgtgggtgtatgtcacttcctcttgtgtttgttgttcgtcttgccattggctcggtgcccgttgttgcggcgcttatgtggtgtcttcttgtctccgtgctgcgggtgtgccctctcgctctgtgtttctcagactgtgtggtgctcgtgttttctctcttttggcgcttttcgcgatgcgacctcaagtgttggtgtggggcggtgtgttgtgtgcggtgggcgtcctgtgtctgggggtgaggtgactgctggtcgagatttgtcgctgtggtggggcatgtcgttgtcatggcgttttatctgtttgttgtgttgttgtgggaggctgtactcatctgtcatggggtttctcctgttgcgcttcttgtcccgatcgggtgctgcctcgttatgtccccgggtcgttgttcgccgcccacccactccccgaggtaaattcacatggcacatttgtggggcttcacccccacccctccacgggtctctgtccaaggtgcgccctttggtcccctggggctgaatggccccccacgtctcccacgcacttcactggcccttgttgccacggtccctggtccctccctctcccacagccgcccctaccaccccttttggtgccaccaccttttcacaggctggccccccctggttggggcaccccgcagagccctggggttccattggtgcaaagggccctggaattgtgactacccgggccctatccggaacctaccgggtaaacctgtgtttttctgga

SEQ ID NO: 681470 - DNA, 691 bp, Homo sapiens
cggtctctggagtaatgcgcgcctgtcgacgtccgagcctacgatccgagaccgatccatgtggctagacatcctcctcactatcagatgctagggctattgccatactactggttcatctcccgggacaaagaggaaactttgccacttgacgatgggtggtagggggccatggcacgaggtccgcagccaggaaggacgacagcatccgccctattcaaggtggaaacgtcagatgagtgagataccacgacttacaccagaggatcgataagttaccgtatatcaccccacctttgggaggacagctgcttccactatggcttacaactaccaactacctgaagaaagtacatactcctactggcggaatgaattctgactggaagaagcaggtaggagatatctacaacagataaccctcacttacaagactaagattgaagggctggacataccacttacataccacgtgaagcccccccagtagatccgcaggacataacacccgaagcacctatagctagataggtgcacaggctaggaccggcaactatactacgagtattgataaggatcattcccagctcctgactgaacaccaagaaccatggcctgagcgatgagcacgtatatgaagtcatctgccctttccatacctgaataatggtactcagaggctcctccagaa

SEQ ID NO: 681471 - DNA, 791 bp, Homo sapiens
  misc_feature (28)..(28): n is a, c, g, or t
  misc_feature (61)..(61): n is a, c, g, or t
  misc_feature (63)..(63): n is a, c, g, or t
  misc_feature (131)..(131): n is a, c, g, or t
  misc_feature (158)..(158): n is a, c, g, or t
  misc_feature (165)..(165): n is a, c, g, or t
  misc_feature (170)..(170): n is a, c, g, or t
  misc_feature (202)..(202): n is a, c, g, or t
  misc_feature (258)..(258): n is a, c, g, or t
  misc_feature (283)..(283): n is a, c, g, or t
  misc_feature (285)..(285): n is a, c, g, or t
  misc_feature (315)..(315): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (337)..(337): n is a, c, g, or t
  misc_feature (342)..(342): n is a, c, g, or t
  misc_feature (383)..(384): n is a, c, g, or t
  misc_feature (386)..(387): n is a, c, g, or t
  misc_feature (389)..(389): n is a, c, g, or t
  misc_feature (392)..(392): n is a, c, g, or t
  misc_feature (395)..(396): n is a, c, g, or t
  misc_feature (427)..(427): n is a, c, g, or t
  misc_feature (446)..(446): n is a, c, g, or t
  misc_feature (449)..(449): n is a, c, g, or t
  misc_feature (458)..(458): n is a, c, g, or t
  misc_feature (472)..(472): n is a, c, g, or t
  misc_feature (499)..(499): n is a, c, g, or t
  misc_feature (501)..(501): n is a, c, g, or t
  misc_feature (505)..(505): n is a, c, g, or t
  misc_feature (543)..(543): n is a, c, g, or t
  misc_feature (560)..(560): n is a, c, g, or t
  misc_feature (569)..(569): n is a, c, g, or t
  misc_feature (573)..(573): n is a, c, g, or t
  misc_feature (703)..(703): n is a, c, g, or t
  misc_feature (706)..(706): n is a, c, g, or t
  misc_feature (712)..(712): n is a, c, g, or t
  misc_feature (721)..(721): n is a, c, g, or t
  misc_feature (731)..(731): n is a, c, g, or t
  misc_feature (772)..(772): n is a, c, g, or t
cggaccataggtcttccctaattgttcngggaacttttgctgcttgaagaatgcgtgaatngntatattgttcaccagaaagacagaagttaatccccagatggaaatttcagatttttcttttggtttgntttttggtttttcatttttgtagaganggggggngttgntatgttgcccaggttggtcttgaactcctganttcaagcaatcccccagcctcagccttctaaagccctgggtttaaaggaatgaaangactcacccagcccccagattttanantttaaacagccacactaagaactggaaatntgngggnggnggtctcagaggnggggnggaaagcctgtttgtgtgtgacagtttaacagtctataagnngnngnggngtnngggggcacatgggcacgcccatccctgggtnggggggttcgttctggtcnttnccagggggngtttttgtccttcnttccttcctcacttctttctcttgttngntttntcttcccaaatcacaatatagggggttttttggttttngatgggccctgaacttngttttgtgntttntttttggttaagaagggggggagagagagggagagtgggagtccccacttgtcctgctccatctccaaaatcagctcaaatctcccaggaactcttcaggagctcaggctacgtttctagcttaaaaggngcnaatgancattatccnaatcccacancacatcctcactgcttcacagtgcccttccttccgtggtantgtgtggccaagaaataca

SEQ ID NO: 681472 - DNA, 226 bp, Homo sapiens
  misc_feature (92)..(92): n is a, c, g, or t
  misc_feature (148)..(148): n is a, c, g, or t
  misc_feature (150)..(150): n is a, c, g, or t
  misc_feature (225)..(225): n is a, c, g, or t
ctgggcgcctcggcgcaatcggtcttcagcggtgaatttggtgttgacttctctcaagccacggaggacgtggttcgggggttgcctcgtgnccggagatcctgtcgcacgggtcacctccttctgccccaccctggtcacttcccancngagtttatcacaaggttgttcctcagatccctgtgaagagtggtggtccccatgggcaaggggtcctcgggctgna

SEQ ID NO: 681473 - DNA, 378 bp, Homo sapiens
ttcagatggagacacaggctcaagatggagctggagaccattatcctgtgttaactaatgcagaaacagaaaacagagtacctcatgatatggtttggcttcgtgtcctcacccaaatctcatcttgtagctcccataattcccacatgttgtaggagggacccagtgggagatgactgagtcatgggagtggatatttcccatgcttttctcatgatagtgaatgggtctcacaagatctgatggttttcaaagtgggagtctccctgcacaagctctccttttgcctgctggcacccacgtaagacatgacttgctcttccttgccttctgccatgactatgaggcctccccagccatcttgagcctgtggggtac

SEQ ID NO: 681474 - DNA, 1538 bp, Homo sapiens
  misc_feature (63)..(63): n is a, c, g, or t
  misc_feature (66)..(66): n is a, c, g, or t
  misc_feature (116)..(116): n is a, c, g, or t
  misc_feature (147)..(147): n is a, c, g, or t
  misc_feature (1117)..(1117): n is a, c, g, or t
tgtattggtggtgctctctgttgcccaggctggagtgcagtggctcaaccttagcatactgcnccnccacctcctgggttcaaggggttctcttgcctcagcctcccgagtagctnggattacagtgcacaccaccatgcccagctnatttttctatttttagtagagacggggtttggccatgttggccaggctggtctcgaactgctgacctcaggtgatccgcctgcctcggcctcccaaagtgctgggattacaggcgtatgccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggcagcaaaccactcacagagccaggaagaaatgaatgcgttggtattgccaggaggggaagccggcccggctgaaatacgctatgaccatagccaggagatactgatggagagaaaggaacacagagagggagaggtcacatcttggaagaggaagattgtggagagggggaatgagggtctggggaggggctgcccatcagagaagggacctcagtgttggggtgactactcatttggaaattgcgggatggaggggtattcgaaggtcggatgcaaatccgagaagccagaggaagggttttgggtgatgctcccaggatggtgggctccgatgggatctttggagggggtgtgtctaggtcggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagngagaccctgtttctacaaacatttcaaaaattagttgagcatggtggcatgtgcctagtcccagctcctcgggaggctgaggaaagaagattgcttgagcccaggaattggaggctgcagtgagctatggtcgtgccactgcactccatcctggggagcagagctagactctgtctcacaaaaaaaaaatttgtgggtgccaagactcaagaccatgggagctggtcgggcacagtggctgacgtctataatctcagcactttgggaggccgaggcgggtggatcgcctgaggtcgggtgttcgggacagcctggccacatggcaaaaccccgttctactgaagaccaaaaattggcaggcgtggtggtcatgtctgtggtccagtgcttggaggctgaggcggggattgttgaaccggag

SEQ ID NO: 681475 - DNA, 828 bp, Homo sapiens
ggaaattaggggtgaagtggtttctggtaattgttagccaggatggaatgacttgtgatcaccaaagatgaagtctctggaagttctgtcacagctgacgtagtcaataagtgtttggccctcatggacacaccaagtggagcacacagcaggtgtatttgaagaaacgtggtgatgtgaacgactttatgggacatgatataggtcgtggatagtatggtggaatgtacaaagagtcgtgccatgaggtgtgatgctgtgagttctaatacaacaagttggatgcggtcattcaaggagagccaagatctcaagaaattgccaggaagttacctgcaggcggatcatgttattgtctgcggtatgaatacacacatatctattacatgggataatttaaacctcatacaagcttataaagagtgattgatattttctggttggagtattatcttttctgtggcattactgatcgttgcatattacatacatgctcagaagatggtggaaagtagatcttttgttgacctaggatatcactgacagttgcataccttgtgatgtgattagtgacttatgtggtaccatggcatgggtattgatgagcatcttaaccctctgcaaagttctgatttgcctgaggctacaataggtagcataaattgtgatgagcaagcactagcatttgcttgctcccacaaggaaatgggttgggacacacatgagttatgacgggactacttctgtttctatttgtggacttttggtccacaataatatgactgtgaatgaggtttctatagagtgggcgcaggggtctgtccttct

SEQ ID NO: 681476 - DNA, 989 bp, Homo sapiens
  misc_feature (568)..(568): n is a, c, g, or t
tgactagccctgaatcccgactagcccgacagtccccgactagcccgacagtccccgactagcccgacagcattactgcccatcagagaagggacctcagtgttggggtgactactcatttggaaattgcgggatggaggggtattcgaaggtcggatgcaaatccgagaagccagaggaagggttttgggtgatgctcccaggatggtgggctccgatgggatctttggagggggtgtgtctaggtcggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagngagaccctgtttctacaaacatttcaaaaattagttgagcatggtggcatgtgcctagtcccagctcctcgggaggctgaggaaagaagattgcttgagcccaggaattggaggctgcagtgagctatggtcgtgccactgcactccatcctggggagcagagctagactctgtctcacaaaaaaaaaatttgtgggtgccaagactcaagaccatgggagctggtcgggcacagtggctgacgtctataatctcagcactttgggaggccgaggcgggtggatcgcctgaggtcgggtgttcgggacagcctggccacatggcaaaaccccgttctactgaagaccaaaaattggcaggcgtggtggtcatgtctgtggtccagtgcttggaggctgaggcggggattgttgaaccggag

SEQ ID NO: 681477 - DNA, 220 bp, Homo sapiens
cggatctctttccgccgccatttaatcagctcatacaacgctcgccgccgctgctgccgcgacccggactgagcgccagacccccctgccgacagctccgtaactatggaggatatgaacgagtacagcaatatagaggattcgcagagggatccaaggtcaacgcgagcaagaattaacagggtgacggtaaaaatgtttaatggaggcttgagctggg

SEQ ID NO: 681478 - DNA, 169 bp, Homo sapiens
tggtgggttcgagcccaacttcagcgctcttcgagaagtgcgaggcgaacggtgcgggggcgcctctcctctccaccttcctgcgggaggccctgcaagctctcagcgacgacgccaccatcttctgaccaacttcaggctactaccccaacttacaatgccaccgcga

SEQ ID NO: 681479 - DNA, 446 bp, Homo sapiens
ctgctaagtagtggagccaacagtgtgctggagtccacttgcattggctcacaagagccaaatgtgcacatctcttctcagctctgtattcagtaacctcaggttggcagcttgaaatagcctacagtgggagtactacaccacagaaattggcaaatgctacaaaccagagacctcttttggagaaccacttgttaaatatttaccagcacattactgggtagagtaaggattctaatccaagaagcctaactccacatctttttctgtatgatgtatttaccttttttagttagtattaacacttttagaaatgtggactggccgggtgcagtggctcacgcctgtaatcccagcactttgggaggctgaggtgggtggatcacgaggtcaggagatggagaccatcctggctaacacggtgaaaccccatctctactgaaaat

SEQ ID NO: 681480 - DNA, 920 bp, Homo sapiens
acctcccccaccaacaacagattgtggacaccagtttgcacagcggtgacaaccacagtcagaacacaccttggccacatttctaaccctctcaaatcccggcttgttccaatttgggctagtgaaaatactgtcaccaatatgccctggaaatgttaacgtttcccccaaaatcaataacttccgcccctcttttttcctcccactcttacaagacgtcgcgcccagagacctacaagaattgctcccaaacaaccttcccccgaattataagcacacgctttccgagcctcaatggaaatttccctaactgcaagtcggtggccctctctccgttgcaacagtcccaaagacgggtgttgccaaacaggtgtgttgtgcgcgtcagtcctcgtcctctttttccgccgtcaagggggcccccggatgttacgcgccacaatgcgggtgagccctcccgaaacgagctttgtcacgggcggagaagacattatccaaaggggattttgttgtccccccagacagcaagcatttcttctgccaatatgcctgaaccaccatttccccccagaaatctagttgatagagaggcatggtccccccagagggcggggggtaaacgccgtcgttcccccggaataaggcgactgaagtcctccgcgtcaagccgccaaactccgtgagtaatcgggcgcagagtgggaccggccctgggggatagagagcaccccgccccatgggaggacgcaagattcgatgatcgagagcacaagacggcccggaggggatgcagggggccccaaacggcgctgtgttaacacccgctatttcccccccgacatcctccgggggataatctaaaaagccaacaagtaaaaattccaaaattacaaaaaaaaattaatacaccacacataaca

SEQ ID NO: 681481 - DNA, 125 bp, Homo sapiens
ccctgcttttaagcaaagtgctgagagcctctagtcgcctcctgccatctgatttccctccccacaattcccgtactcagttgttctttggtctattcggaggccacggtgctgaggccctgcag

SEQ ID NO: 681482 - DNA, 188 bp, Homo sapiens
cggctgcggcagtgagatcagttgcggtcaggagttctatgaccaacctgaccaacatgatgaaacctgtctttactaacaatacaaaaattagccgagcaccccagctactcaggaggctgagccaggcgaactgcttgaacatgggaggtggcggagattgcagtgagctgagctcagatccacag

SEQ ID NO: 681483 - DNA, 339 bp, Homo sapiens
tttttttattttttggagtcagggtcctgctctgtcgcccaggctggagtgcagtggcatgaacacagctcactgcagccttgacctcctgggctcagatgatcctcctgcctcagcctcccaggtagttggaaccacaggcatgtaccatgatacatggctaattttttaatctttttgtagagatgggggtctcactttgttgccaaggctggtctcaaattcctgacctcaagtgattcttcggccttggcctcccaaaatactgagattacaggcatcagccatcatgcccagcctatattttcttcatattaaataaaatcatgttctcatcca

SEQ ID NO: 681484 - DNA, 673 bp, Homo sapiens
ggagagcaagtaaggaggatctaggctgtttaatcttgctgggcccgcgagtctgcgccccgttaagagcaaaatgatttatgccagtctccaaggacgccgattcaatgaagaagctgatcagcggactcaatgacattgaaattgccgatgcaatatgtgctgtatctgtatggcaggatcaatggaccgcgtgtaccctggcatgacgaaggctggaggaggcacgtgccgatcatctgtcccttggcagggtcaatgccatttgttgagaccccttgtgcttggtcccgcacgtgcccttgtgtagggcattctaggtcacgtctcactcaatcaacactagcccccctctgggcgcgtgttttggcagagacttggccgcctctgttcctagacgcgagagccgtgatggtgaggctgggcgggtgactctcccatgggaggggggggggcgtcaaagtggcatatcagggcgactaggattgtgcgagaacgtatgcagggcgccctcccattctcgcgctggggtaatattttttcccatatacattcactcgtgcgcaagtccccgcatatgaaacggggtctatacatgggagactcgtgttaccactcgggaaaccttcgtgcttatatagaggaaataccttgtaaaaaggaatgttcactt

SEQ ID NO: 681485 - DNA, 617 bp, Homo sapiens
gaatgtgggaaaccgcttcggatctgcccagaaccttcgaactacctgagaggacacaaacacacagtatgcacgtctgtagagagaccttataaatgtaagatatgtgggaggggcttttattctgccaagtcagtgtcagagatacatgaaaaatcttacagtggcagagaaacccttatgagatgtaagccatgtgggaaagcctttgctctccttcacttcacctttcgatatcatgaagaggactcgaccacgggaggcagaaccccttatgaagtgtaagcaatttgggaaagccttcagatctgtccaaaatcttcgatttcataaaaggacacacactgaagagaaaccctgtgaatgtgagaaatgtagataagcattccataatttctctcctttgcaaatccatgaaaggatgcacagaggagagaagctctgtgaatgtaagcaattgtgggaaagcattcatatctgccacgatcctttgaatacatgcaagaacacacaatggagagaaaccctatgaatgtaaagaatgcagaagagcattcaggcttgcctacttcctttcatagacgtgaacagactcaactggaaggaaaactatgaat

SEQ ID NO: 681486 - DNA, 513 bp, Homo sapiens
ggggttatcggaggccacagggactctcagggggctccaaaatcgatttggacccccggacccggtctcacggaggcatagcatccaccctaagtaaggatttagccaggaaggacagctttccacggagggtgatgggggacagtataaacagttgggaaagcaagtgaggaggggggagggctagcaatcattaaaagcacattaaaaaacaatttttaaaaatctttataagagaaagtggtaaaggcatatcggtaacagaattccggggattggtagagttttctagtcagtttggaatataaataggtcacatatcttaatcttttggcatacttggttacaaatatgcaaataagataggcatactggctacaaaataggtacagcaggaaggtaatatgtccagaaaaggcgaacgggttattaaaacacattagcgggtagggagtttctaatattttaaatactaaaatttgacaggtgtatctggaagtttttaaaatggaa

SEQ ID NO: 681487 - DNA, 116 bp, Homo sapiens
agttcccctgcttagctacgcgcctgcttggccgcgatgtttagcacgtacaactaacttgagtttttattagaatattatgtattacatttcacactatttttgcatgagtattg

SEQ ID NO: 681488 - DNA, 618 bp, Homo sapiens
agtaatcaacgttacgacttctagtctgtccactagtctggagcatagtcgtgcactagctgggatgctactgtgtgctgacacattatatttgaaaaatgtactttgatcccatgtgttagggaccccctctgattccttgtctccttgtatcctaagtgctgatagcttcatcattgttctactactgctgtgctccatgagtgacaggtctccatttctgacatatacttctgctctattcactcctttgtggtgttgtctcctgatacatgtggttgcccagtgccatgaggaaggataggagagccacttgaggtcatatgttaaggtatgtaaaacacactgttctgatcacttacatctgtggctctccagtttcccttctaaggacttatctctgcacaagcctggttatttgaggatgtgcttgtaacgtatgctttctcttctatttctcatagcctatgcttgtacctgaataggggaggtacgaagagggacagccatgcactaatttacttgattccatgccttcaattatgttgcttggaatgggtactccaaatcatatgactcactgtggaagttgaacgaagaattgtaagttgtccttgg

SEQ ID NO: 681489 - DNA, 116 bp, Homo sapiens
tgaagagagcattactcaaaggaatctagatagcacatcacacagttcggagtgcaggaagtctttagccccaaattaaagatagctggttttctctccatcttcttctctgtact

SEQ ID NO: 681490 - DNA, 238 bp, Homo sapiens
  misc_feature (6)..(6): n is a, c, g, or t
tctgtnttcgagtagggcaaaaggttaaaggaaaagtagattagggattgatggtgtgtgttgtggtggtgggtttgtgtgtgtgtatgttgtgtgtggaggtggtgggttggtggtgtgggagtgtgtgggtggtgtgggaggtgttgagggatattggagtatgtattgtgtggtatgggtggttgtgtggttgtgggggggtggtgtgtggggtggttgtggtggggtgttaggt

SEQ ID NO: 681491 - DNA, 498 bp, Homo sapiens
cgtcctcagctccaaagcgctgggattataggcatgagccaccatgctgacagggtttagtgttttcttggggtgatttctttctggttctctcctggcagtagttctactcattgagctccttaaaagctccttagggaagtggcagcatatcctgtttgtgaagacatccagtgaaatggttatttttattcctcgaggcctctttcttctcaccctgtagcatgtgcacacatgtgcttatgcacacatctcaaccccaaccttccaggacctgctttcgtcaatcctttgataatagggttgtgttttaacattgacaaggaatcatgcaccttttgttcctaagttcccctttcaacacagagcactatatgttctggatcattaacttccacttaagtagtttattgaagtgagagggagctataaagtaggtgaaagagcagaggctccctagaataataaatgtgaaactgtcttcgggagatttggaag

SEQ ID NO: 681492 - DNA, 413 bp, Homo sapiens
cagaggatcccttagaaggtgatattatttattgatttcaagtttcaatgtattttagattcaggcggtacatgtgcaggtgtgttacataggcacatgcgtagtggtggagatagggcttctaatgtacccattacccaaatagtgagcattacaccagacagataatttttcaactctagcctctcccctttaggagtccccagtgtctgttacttctatctttatgtccgtgtgtacccattgtttagctcccacttaaaaatgagaacatgtggtttttgatcttctgtttctgcgttagtttgctcaggataatggcctccagctccatccatgttgctgcaaagaacgtgatttcttttttatggctacaggggccacttttgtggttcctgttttccaacatgaca

SEQ ID NO: 681493 - DNA, 395 bp, Homo sapiens
  misc_feature (17)..(17): n is a, c, g, or t
  misc_feature (49)..(49): n is a, c, g, or t
  misc_feature (75)..(75): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (353)..(354): n is a, c, g, or t
aaaaaattaaaaatagncccagttgtgggtggctcacaccttgtaatcnccagcactttgggaggacgaggtggntgatcacctggggttaggaattcgagaccatcctggccaacgtggtgaaacgctgtctctactaaaaatacaaaaattagctgggtgttgtgacgggcgcctgtaatcccagctactagggaggctaaggcaggagaatcgcttgaacctgggaggtggaggttgcagtgagccaagatcgtgccattgcactccagcctgggtgccaagagcnanactnactcaaaaaaaattaaaattaaaaaagataaaaataaggttcaagaccagcctggccnnacagggtgaaaccctgtctctactaataaaaatacaaaatt

SEQ ID NO: 681494 - DNA, 146 bp, Homo sapiens
cgtcattatgccaggaccaagtagcgtgggccagacagaaatgcttggggaggaatgatggacctatttgacatgctgcccatcctggaagagggtgatttacgattttggccatgcgatgtcaacatgcacactgctcatgtcga

SEQ ID NO: 681495 - DNA, 434 bp, Homo sapiens
  misc_feature (209)..(209): n is a, c, g, or t
  misc_feature (397)..(397): n is a, c, g, or t
  misc_feature (402)..(402): n is a, c, g, or t
agaaatccagtctcaaaacaacatcaataacaaaaaagttcctcttagagctgagatattatttagaccaatagacatttgtgagactaataagtgtatcttgactcagatggcagcaaagtttacttatagtgctttatagcactaagtgatttcagatgttccgggaactttgctggggatttagctcaatggttgagcacttcccntggcatatgtggaggcctggcttccacccctagcactgaaaacaggaaacaaattgctgtgaattgtcatctccacagttccttctgtccattgttccagctgcttctctcttaacgccgtactcagaatcggagctcaagttgtgatttgcatcaagtcctggacaataacacctattagaaaaaanggganggctaacccctaatctctgctgagttcgtact

SEQ ID NO: 681496 - DNA, 427 bp, Homo sapiens
  misc_feature (345)..(345): n is a, c, g, or t
  misc_feature (356)..(356): n is a, c, g, or t
  misc_feature (397)..(397): n is a, c, g, or t
  misc_feature (399)..(399): n is a, c, g, or t
taattaaggaacatctgtagtctacaaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtgggccagggcgtgacacccttcaccagggccccgttgcaatcttactccacttcgttttcacagcagtcccgggacatgcccattattagggcctatttgataggatgatactgaggctggagtcgggggggtcacaaggccaaagccacaccgntaggaaggggntcagggaccccagcccaggttcccgttcctcttgggtgggncntcaagctttgttgttggatatggagggt

SEQ ID NO: 681497 - DNA, 760 bp, Homo sapiens
gccaggcggggtgcatgacggctgctgattctggggctggtcaggaaaccaaggagaccccccaccccaactaatggacctcacctgtctactcaagcctggacctcccaaacccagctccacagccacctctccgctgacttcctaccgctggcacacaggtgggcggtggggatgaaggctggcttggaggtgttcctgctggtgagcctgctttgctggcctggggctacgtggcccttgtagcacacccagtgatgccccatgcgtcatgccacctcatgcctagcccccttcgtctctgatacttccgctcggagtccctatcttgcgccttcccataggacgtcatcggcaccatgctcgccattcagacatctcacaatgtgcccctctgcgtggctgaggcattatagaatcccatcctgccgggatgccatgacccgggatgccatgatgcagtgatggctcccatgacgcttggatgcctggacgccaacgagctggatgcctcctcttacccacaggcacgatccgctgatggccccacgacatcaccacatcggctgcctcgtctcgggacaatatggcgcggcttcacgccgtgccgccagcactgcgagaaacgctgcgcttgctcgctttgcagacgtgacgccgagatcgcagcgggtcccatctgatcatggcaccccgcggcatggcgcaacgtcgcctcaccctcccggaggcagcacgccactccaccatggcccattgg

SEQ ID NO: 681498 - DNA, 376 bp, Homo sapiens
  misc_feature (26)..(26): n is a, c, g, or t
  misc_feature (34)..(34): n is a, c, g, or t
  misc_feature (76)..(76): n is a, c, g, or t
tggatcaggtacgcattcttgaggcnaaaccatntttcacgttatccgcataaattctctgcgggatccccaaccnatgattgattccgatggcgctgtcatgcccccgcggtgctgattgccgatgagccaaccaccgcgctgatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtaccgtcgaacagatttttcatgcaccgcaacatccttacacccgtgcgctgttagctgctgttccgcaacttggtgc

SEQ ID NO: 681499 - DNA, 122 bp, Homo sapiens
  misc_feature (6)..(6): n is a, c, g, or t
  misc_feature (97)..(97): n is a, c, g, or t
tgtagntgtacaataaagtgctattaaatccagtcaaaattagtggcaatatataaaaacagttatggtagtatgaatttgaggccaggtttaccanaacgcattttcggctgctgcagatc

SEQ ID NO: 681500 - DNA, 1002 bp, Homo sapiens
ggtcaacatgggccggttcgcaccagaagcgtgaagaaggcggaccggagtctaactcagtagcaagagtggctagccacgcgcctgggcaacgacttccacacgagacaaggcgcggtgtgcgaggagatcgccatgtgatcctccagcaaaagagctccgtaacaagatagacaggttatgtcacgctagtcatgcatgatagcgaatttcacgtagagggcacagctaaccaggtatctccatcgatgcctgcgcggcaggagcgtcgatgagatcatggagacgcacgaattactgtttcccttgcacgggtcctcgcagccgttgtgcgcactcatcggaggaattattttgacacgtggcgatccatagaacatcttagatggacaagttgcctgacaggcgtttgctggagcgtacagagcatggcgtgatccgagagcgcttctaagggttcagcatcaggcgctagacaggttgggggagtcgatccttgtcgacatagagcagcgcttggtgggaggaccctgttagggcagatgttattctggtggtagtgtggctgttatgtgatttttttcagaatttagaaatttcttgggggaaccaagcgagcttgcgaaagaagagaaaatagagcgatacattgagagagaaagggagacttaaaacagaataaacatacaaatacaagtggcgggggagagtcactgtgttttagtggaacggtggcgcgaggaaacacagcaaagtcgaggtggaacaagcaaacaggttggtacagcatagttgggggtggacacataacacgggggcgagagcaggtgagtcccaaggaggtttttgttggtggttgacaaacggagcgggtgaggaaaaatagattcggcgacgggccgttcacgattatataagaagaaggaaggcggttaagtaaaaatattatgaggaatagaaggaacgcgtggggttgacccgttgggaatatataagaaaggc

SEQ ID NO: 681501 - DNA, 145 bp, Homo sapiens
tcccggcctcgccgtgagtaccgctggagtgaggagtagccgctggagtgaggagtagccgctggagtgagtagccgctggagtgaggagtagccgctggagtgagtagccgctggagtgaggagtagccgctggagtgagtagc

SEQ ID NO: 681502 - DNA, 286 bp, Homo sapiens
  misc_feature (33)..(33): n is a, c, g, or t
  misc_feature (41)..(41): n is a, c, g, or t
  misc_feature (45)..(45): n is a, c, g, or t
  misc_feature (103)..(103): n is a, c, g, or t
  misc_feature (161)..(161): n is a, c, g, or t
  misc_feature (257)..(257): n is a, c, g, or t
  misc_feature (272)..(272): n is a, c, g, or t
ttccacaggcgtgagtacgtgcatcgagcgagntgccctcngagnacaattcctcccgagggcatcgcactttctcacctggacagactgacgcggcgcaacngcaaccggacccggcaaaaccgcgcagaccttgatccattcacaggactcaaaagtcnggaccggtccaacaacaatcagctgtcacggtctcccaacctcgggcacatgcctgaactacagacgctgaacctgagcggaacccatatctcccngtttcccgagaactngctcaatcgccccc

SEQ ID NO: 681503 - DNA, 341 bp, Homo sapiens
ccctcacgtactcaaaaaatactagcaaataaaatccatcagcacattaaaaagttaacacaccacaaatcaagttaagctttattcctgtagatgtaatggctggttcaatcagcaactcaataaatgtgattcaccacataaacagaatcaaaagcaaattccatataaccatctaaatagatgcagtggaagcatttgataaaatccaacaccccttcatgatgaaaactttcaacagattaggcatcaaagaaacattactaaaaataaggccaggcatgagggctcacgtgagcctgtaatcccagcactttggaaggctgaggcaggtggatcac

SEQ ID NO: 681504 - DNA, 143 bp, Homo sapiens
agcaaggcgtgggaggagggaggaggcctacagagggctccaagcaaaggtgaacaggaaagctgccgacagggcgctccccctgccccagataagccctctccctgttaagactgcacgaggcccgccctggtccgagcgga

SEQ ID NO: 681505 - DNA, 371 bp, Homo sapiens
cgccagccggccatggcccagtgtgaatgctgcagcagtaaggaactgaagtggtaaagcctggggctacagtgaatgttgtcctgcagtgtttcttggttacatcttcacaagttatgatatagactgggtgaggcagatgcctgaacagtgacttgagtggattggatggatttttcctggagaggggagtacggaatacaatgagaagttcaagggcaggggccacactgagtgtaagacaagtcctccagcacagccaatatggagctcactaggctgacatctgaggactctgcttgtctatttctgtgctaaagggaactactataggcgctaactttgacttgtggggccacaggaccaaggac

SEQ ID NO: 681506 - DNA, 1226 bp, Homo sapiens
  misc_feature (431)..(431): n is a, c, g, or t
gtgagtcaggcgttagggtgcgccaggaggtgggcgtgcagtgacggctgggtcgtgcaggacgccagtagctggagtcaagagctcgagccaggtggtgcccgggatgagattcgggagtagtgcaggcggtcgtcgtgatggtcgcgcgacgcattgcgtgcgcggcagcctgcgttgagggctcgcgagtgcgctgggaagcgtcgcccgtgatcactgagggctccttgggggcaggccctgggccctggaaccgtgctccgtgaggtcgctatgccagggggctagcacgctcaggcttgggcttctcgtggaaccaacgtcaaggattcccaatcccatcttgtagcggcttcctgtacccacgggaatagagagaccgagcccagagagcggggaattcttaaggtcccattattgctttgctngaggcgaacttggttcaagaaggggctcgagcctccagcgcaagcggggaattcaacgggtggttcctgcattaacgcccgattccgggtggccttcgaagcagcacaccaagacagggaacaacagggtatgtcgtataagcatgagagccttggggtagggaaggtgcttggttgagtcccccgtttttactctacggacgcggagagggtgaaaatcggaagttcgcgcgcactaacgggaaaagttgaaggctggctttcgttgcgcaagtactttgaggtgcgcatgcggagggaagcccgaaccatttggaagcgtagaggggggactcctttccaaaaggtggagagacccttgccgtgggggagtccccattctagtgggcgcttccgtagcaccaacaagaagattgtcgcgccacatagaggctgcaaagttcattggaagcagaatgagggggatgagcttagagcaggcacactttatgcgccacaagcaaaagggccccaagttgtaagtgtgtccgcctggattgagtggggcctgtggggaaccaatgtcgcctgtgggggaccacacttgtggaatttgagagaccattatggcgcttcgcatgtgggcaccatgtattttacccctccattggttggaaggccgcaccgatgttcgtatgcaagtgtcactttctgtgagtccttatcccatagaagggtgcccagttaccgcttgtgtcgtaacataattggggatgtgaccagacaaatatggacctccaaagtgatgaaaggaaa

SEQ ID NO: 681507 - DNA, 245 bp, Homo sapiens
gagccaccgaacccagccttattctgcttaaatataacgtgttttttgacttcttaattaacttggtcatatactaaatgtgatctcctgtggattaccacatgcattaaaaaatttttcaagctgggcgtagtggcgcacacctgcaatcccaacactttgggaggccaagaagaggaagattgcttgagcccaggagtttgagaccaatctaggcaatgtagtgagaccctgtctctaattta

SEQ ID NO: 681508 - DNA, 1108 bp, Homo sapiens
gaaaattccgcaaacgaaaagaagaccacagggaaaaataaggggcctcccggacaccccaggtccgtgaaagaaacccacggaaggcttaaaaaaaagtgggggaaaaccccctcgttttgaagcaaaagcctctaagaatttttggcgcaatttggaaccaaggacattcctagcccccacaaggaggcgcttcaccccccccttgttgtgaaaaatgggccccccgctaatattccagaggtttcaaatcggccatagagagtccactctctttttaataatcccggctttgaaaaagtggcgcctccctgcccgagttaaccaccagggtttctaaccccccagggcactatggggcccgccccctatactagagtaatatctaagctgtggctttaaaagcttgggcccccaccaaaggtacccaagaccccagtaggaccccaagcccacgatgaagatacccagaagaaccgtttgggcccgcggccgaagaaaaaaggctttcttggcacaaaggggaacgtgtccccaccgaaagaggaccacacctgtgcctttcgaaccacaggaagttaaacaccccgtccacaccacaccttgggtggagaaacacacagaaaaacttctcaacttgggtgggtggaatgccaccacgaacaggtgggatatcccatcgagactctgggttgtctttcttttgccctgccccctggtgtgtctgtaaaatgggggttcccctttacgtgccatttatcaagagggaaagagccaagaacatgggacacgtctttagatcccacacagagaagaacctgccacccacatttctcgcccttctcaacacacagagtgtaacatctgggaaacaccaaagagcgctttggctaagactggtggaagacttatccaggacccaattaccaatgaccagataacgatagagatcccccgtccactggggtggccaatagtcctgggtcctaaatctttggctcgtatccccaaagctcgaaaaggccaagggctaaagaacttgcccctaaactgggttaaaagtaccctgttgaattttctgtacataaaaataattgaaataaaacca

SEQ ID NO: 681509 - DNA, 277 bp, Homo sapiens
tgcctcctcccctgctgtctcaccaccaatgagccttcttgtgaggacaacattagaaatggaactggtttacgagccaagaaacataaaaatttaggtgttcttagccaagcgtggtggctcatgcctgtaatcccagcactctgggaggccgaggtgggtggatcacaaggtcaggagttcaagaccagcctggccaacatggtgaaactctgtctctactaaaactacaaaaacttcactgggcgtggtggtgcgtgccatataatcccagctc

SEQ ID NO: 681510 - DNA, 133 bp, Homo sapiens
aagctcccaacaggaagagagagaacccagcacagaggtcaggactgtagtcaaatagattagcatccaggacagagtccagactaaaggagcgggaaaatcgccataatcacactagggatgatagtaatta

SEQ ID NO: 681511 - DNA, 345 bp, Homo sapiens
gagggaagggcggtggcacctgccatcctaaaaccaatttaaaaatgtgaccagagctgggcaaggtggtctataatcccagcactttgggaggtcaaggtgggtggatccttgaggctaggagttcgagaccagcctggccaacatggcgaaaccctgtctctactgaaaatacaaaaaattacaagctgggcttggggcgcacacctgtaatcccagctacttgggaggctgaggcaggagaatcgcttgaacctgggaggcggttgcagtgagctgggatcacgccactgcactacagcctgggcaacagtacacaactctgtctcaaacaacaacaacaac

SEQ ID NO: 681512 - DNA, 268 bp, Homo sapiens
  misc_feature (7)..(7): n is a, c, g, or t
  misc_feature (35)..(35): n is a, c, g, or t
  misc_feature (52)..(52): n is a, c, g, or t
  misc_feature (80)..(80): n is a, c, g, or t
  misc_feature (174)..(174): n is a, c, g, or t
  misc_feature (237)..(237): n is a, c, g, or t
  misc_feature (246)..(246): n is a, c, g, or t
ggccaancctctgataaccctcctgtagctccaanaaggagggcagttattnaccctccaagccgttccttcctgggttngggggcagctcccggagggctcaggtacccacctttcctgcaggtgtccaggctcctctgcctaccagtggggtggcgaccaatcaccaaggtntgaggggcgggggacctcctgggggctggtcaggcaggtcccccaagcccctcttaatactcnccaataaantctacttcctgtccaaaaaaaa

SEQ ID NO: 681513 - DNA, 265 bp, Homo sapiens
caggactcgtgacattactcctatctgctacccacgcttccttaggctccccacctctggctagcttgagaggaaggacgatggtcaaggtacatgtctcttctcctctgactctgggaatgagatttttctcactcccacaggcttgcactctccttatcggagtgtctccacatgccaaaatcagaggcaagtcagaataaaactcccaaggctgaaacatagagctggcacgtagtacatggtccagtacctgtattacagg

SEQ ID NO: 681514 - DNA, 231 bp, Homo sapiens
  misc_feature (90)..(90): n is a, c, g, or t
  misc_feature (131)..(132): n is a, c, g, or t
  misc_feature (151)..(151): n is a, c, g, or t
  misc_feature (204)..(204): n is a, c, g, or t
gacataataccgctgacaaatgcgcttaatagtttcattccagaaccagcaacactcccaagtgcatacccaacgccataaacgaatttnataacagtctgcattgctatgtcgataagacgcggcatagnntttccaatcccaatcaagnatttagcaattaggtttatgccggcattaataatgtttcctaagttattagcnataccgttgttgatgatcattacgtgt

SEQ ID NO: 681515 - DNA, 500 bp, Homo sapiens
gggcattccagttacagcctccccttgaacccgagttgggagatgctgagagtccaggaccctccctgttactcattcactttctcggttccccactctttcagccgccacgtgagagctcttctaacctctgttcctttctgtgacccccacgtgttaatattgaaaaaaacaaaccaaacctccagctaaggcattgctctaactctaggcagaccattcattagtggagcatgagatgagattgtgtgactgttgatgggatcgacccacgctggtcttggcgatggaagttttcctaagtccaaggcccggttactctggtgattcgtaattcaatacctgggcatttggagtaacctcttggggcacccaaattaggaaggtttagagaatttccctaattaagggggggatttgatctaagcccgttttgggccttaagtgagatttaaatatatggggcccattaacctttttaaaaaaaatggagttccctg

SEQ ID NO: 681516 - DNA, 349 bp, Homo sapiens
tagacagggtctcactatgttgcccaggctggaatgcagtggtgcaatctcggttcactgcagccttgacctctcgggctcaggtgattcacctcagcctcctgagtagctgggaccacaggtgtgtgccaccacacccagctaattttttgtattttttacagagatggggtttcactatgttgcccaggctggtcttgaactcccgagctcaatggatttgcctcccttgcccttccaaagtgctgagattataggcatgagccaccatgcctggcctggaatcttcatttttaacaagtgccccagtagagtgtttgtcgacgcggccgcgaatttagtagtagta

SEQ ID NO: 681517 - DNA, 721 bp, Homo sapiens
agtgcgcacttgggtttatccagcgccccctccccccacgcggggtgttaatgtggtctctttaaaacccccctctatacgagacgtggttttattgggaacccccccctgcttattctcttagacaaagacatgtgttcgttcgggggaagaccacttagaacacatctttcctcgcccacgggcgcccactcgcgtgtgacatgcccgccccagatatttgcgtctatcaccaagagagagtttctttcttttataagtgagagtccctccccacgctttatgagccactctgttatataggagaagattctgccacgccgagtgtgccccatgaagagaccaccgggggtcacacctcaaccctggtggtgaatgcccccgatgttttcacaccaccgaagtgggttcacacgaagataaatgatgagtccccgaggttgtcacacttattgtggacaattttctcttgcgactataatagagggagtgtaggcataattgtctcccacactttttgggacacccacgcagatctacaaaaaactttttcatacgtctatcattttacccacgaatctcccaaggcaagttctattaaaaagcaaggtccccctccacactcgttacatacactatacttcaatgaggacaaacaaaccacctcgtctgatccaccgcccacatcagcccacccttcctattcccatacaataaacga

SEQ ID NO: 681518 - DNA, 329 bp, Homo sapiens
agtgagactgagtcccactctgtctctgtactttaattgatataaatactaacatttttactaagtgctccaggtgatgatcatgcatattaaagttggagagcactttaatttatgtttttaccatctattccaggaagtctgcccagatttctcccttgctccttacctaagtctaaggttctgagggtcagggtcagattcccattgggttctgctgggtgtgctctcccaccggactggggaggccccagggacagatatcttgccctttctttactctcctcaccctaagcccagatgttcctggtactactgagtgtagattc

SEQ ID NO: 681519 - DNA, 645 bp, Homo sapiens
gaaacacccgcgctgtttgtgctccatgcgaaaaagaatataagttcaagtgactcgattctaggagacaacggagagggtgggcactctccatgtctaaacatgaccccttatcacctaataactggccggagccagctgggttatatgcaaggacatcacctgttcaataaaagttaacaaaattgatattccaacatcaccacctatgatacaaatactggggccctactcagtttactcataattgctcgacctcaggggattatagactccttcttcactccgccagttgctgaaatacacactaagggctttttagagctacacgaatctcttaatatatctaatcctccagttttccattgtgaaacctgaatgtgcacccccattcaagcgcctaatagtaaatgtaaaaaaaggcacacatacacgcaattgtgcgtttgtgagatcaaatgttaactaaagattgtgacattgccctcttatgttgggtgaacagtgttgaaacccaggacacaggaagggcctaacaacagcgtttcccgttgagcaacttacccctgtggaacgctgctcccaaagagacacttctccgcaagaaatcacctgaagttaatgtttttaaaaaccacccaaacg

SEQ ID NO: 681520 - DNA, 532 bp, Homo sapiens
cacacacaacctctgcctcccgggatcaagcgatcctcttgcttcagcctctcgagtagctgggattacaggtgcgcactactgcgcccagctagtttttgtattttgccatgttggccaggctggtcttgaactcctgacctcaggtgatccgcccacctcggcctctcaaagtgttgggattataggcatgagccaccgcgcccggcccataatgttttaagaaagtttacgaatgtgtgttgggcctcatgcaaagccatcctgggctgcatgcagcccgcgggctgtgggttggacaagcttgctttgtgccattaaattgttatttgtaattagtgctggaaagtcagggtttgagaggcagacactgctgtctctgaatggaaaggtccacgtgtgggaatgaggaagccttgttcatgagcaccctgacagagcacccatgcctccagcagtgggagggcaggtgtgacgctgccgattccacattgtatctggaatgtttgttttggagatggagtttcgctct

SEQ ID NO: 681521 - DNA, 127 bp, Homo sapiens
cttgcgctgctcgcactgaggatggatgcgtcgcgcccgcgcctgatttcgatctggctgcggtaacggccctgctgtggcggccatcgcatgcccacgatctgcgctggcgcggtgcatcgacttg

SEQ ID NO: 681522 - DNA, 115 bp, Homo sapiens
ggaaggaggggaaatggatagtgaaaagcaatgtggactagccctcgtgtcattcatagatccagttctagagcacagctcgtgtaatactaccagttcctacagggtagaaacc

SEQ ID NO: 681523 - DNA, 777 bp, Homo sapiens
gagcggagtgtgaagagtaaaccttcacatgaagcatagggacgtctccgtggggccgatgcgacggcaggcgaaggcgatggagctctggctcgagggcttggccggacgacggtgacactggtcgcccgcctgctggaactgcagatgaccgaggtccatggacaattatactggcacatacagacggacttgaggcgtggtggttcccctcaccgaccggacgagggcggtgatcaggaggcgggcaatagacgatgagcgggtgggaataggagccaataagcaactgcagccttgcacagaggcaggcgcgtgaggctacgggtgagtgcgaggcctgcagaccggcgacgcgggcccctatcaggccagcggacctgctcgtggggcgcggacggcgacggacccgagtgatcaccacggagagacatacactgagggcccaacagcgtcagtaccagcacgttgcagagtaccaagaagagggaatagtcgcaagaggacatcagggtctgttacgcccactctacaacacaaggaatcaccatgcagtcaacgcaattcatatctactaccgaaagggaagcattttcaccagctataaacacagtgcaagggggacaacaatactgggacactccaatttatggaatttcctgaacaccgcatccacgcaactacaacaatactttgcaacatgcaacgtctgctaacactggaaaccagacgatagaaatatcatacactcagatacatgctaacccaagtaggtga

SEQ ID NO: 681524 - DNA, 174 bp, Homo sapiens
ccctcctatcatgcaactgtggtggtcccccgtcgtcccgggtaggtcaccactaatgatgtccgaacttagttgcgcgacacctcgatcgtggatatgctgcactacaagcccaggaactcctgggtctcaaagcgatccgtcccacgctcagacctcccaaggttgcttggg

SEQ ID NO: 681525 - DNA, 442 bp, Homo sapiens
attggacatttctatcattccacggtttgggctattatgaagaaactatcatgagcatgcatacgtagcaggcctggtcttactaacacaggcctgcctaaaaactgtttcagtagcgactgagtggttcaattaaatattgagaggaaaaaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttactgggggtctgaagaaactccccaggcctccacagacaagtttattggagatctgaagggactctccaaacctctgtgatttagcaggagacaagatgagggcccccagcacctagacccatttagattaagtgaattt

SEQ ID NO: 681526 - DNA, 787 bp, Homo sapiens
agcggagtgctgaaagctggtttgcgtctacttggtggttaccctgagtctcttgctggcgtcgggtcgcgtttgcgccgccgtctctcgctgtgggttcgcgacccgtctgtggtggcgggccctggccctagttgtgccggtagccgagcaccccgagttccgatctgttgcagtccggaggcaacgggtatgctgctaggaggttggagatgagtatccggtctctctccccgcggcccttcatgcttgtacgctagggccctcgtgtccccggacgctccagagccgtgcccccttgcgcgccgggatgtcctgccgctaggcttgacgcatgcggacccttgtgttcttctgtacccagtagcttacgtgggcgcgagcgtcaggtgttgcagctccccgggaccactggatcccttcagtatagtgaccttatttctagtcatactagttgtagaggacgcttcggaatagcctctacaggcacgcttcattgttgctaaggtgtcagcgtttacattgcgtgtactggagcatctctaaacctggcatacaatggcccctggtatgcccttggcgatcaatacatgaagagaggcctgggcgctgccctggatttatgcctggaggacttcttctaaaccatcgcattctagcttctcaaccgcatgcgcttctgccattaggtatactcttcccccagcaccctggaaacgaccagaatacaagcgaatcccgattccagaacaattcgtgagtgcaagttggaggcgcctggtgcacc

SEQ ID NO: 681527 - DNA, 612 bp, Homo sapiens
  misc_feature (21)..(21): n is a, c, g, or t
  misc_feature (76)..(76): n is a, c, g, or t
  misc_feature (80)..(80): n is a, c, g, or t
  misc_feature (130)..(130): n is a, c, g, or t
  misc_feature (148)..(149): n is a, c, g, or t
  misc_feature (179)..(179): n is a, c, g, or t
  misc_feature (188)..(188): n is a, c, g, or t
  misc_feature (190)..(190): n is a, c, g, or t
  misc_feature (217)..(217): n is a, c, g, or t
  misc_feature (219)..(219): n is a, c, g, or t
  misc_feature (221)..(221): n is a, c, g, or t
  misc_feature (236)..(236): n is a, c, g, or t
  misc_feature (255)..(255): n is a, c, g, or t
  misc_feature (261)..(261): n is a, c, g, or t
  misc_feature (269)..(269): n is a, c, g, or t
  misc_feature (271)..(271): n is a, c, g, or t
  misc_feature (285)..(285): n is a, c, g, or t
  misc_feature (287)..(287): n is a, c, g, or t
  misc_feature (297)..(297): n is a, c, g, or t
  misc_feature (299)..(299): n is a, c, g, or t
  misc_feature (344)..(344): n is a, c, g, or t
  misc_feature (386)..(386): n is a, c, g, or t
  misc_feature (407)..(407): n is a, c, g, or t
  misc_feature (465)..(465): n is a, c, g, or t
  misc_feature (540)..(540): n is a, c, g, or t
  misc_feature (583)..(583): n is a, c, g, or t
cagaatgcctcattgtctganggggagcgtgttgtttctcatactccatccccagagccctctctttcaggcaggnaganacaaagcccttgcgccccactgcactgcgcaacacagcagagacgctggnggggggggccctgggggnngggggctgctaccaaaggggaagaaaaggnttccaaaangncaggcgcccactctaaccctgcggaanancnggccacatgtctgcnttatatccagatgatttantttcancccgggtnancctttcccaaaatntnggtccctggncngttactgttccctctggctgtggccagccacttctctctcatgcntgaccatgagctgttgtgcaggtctcaggcgtccactcggcnaggctaaggtctcgggagcanagatccccagcagcaggagtcacagcaccagttccattcagtggtatcagtgaaaganaaagcaaggaggtgggaaagtaaatattcatccccctgtccatgcaaggtggtaggcaagaggccagcctcccanaaacaaagtgctctagggctacagcaaaaactgaagccagccnagatggggatataacataaccactcccag

SEQ ID NO: 681528 - DNA, 1211 bp, Homo sapiens
ccgcggcgtcgctgagcgtgtgcattactttgtgtttgtccgtgctgttgttcctgcttgtgctggtgcttctctctcggtttcacactttgccttgcgagccgggctgtaaactggtttgcccgctttgtccggcctcttttcccgtttatgtccctggggcacggcccgtttctattcgggggctctttagggtgtgccgctgttcctgggtgcaatttgtcccgtacgtgaattttgacttgtgaactaatatcccgggtttctcacggttacccgggagggaccaagttgccctcctgtgaagaccgctcgcattccagggtaagttttcggagaaacatctcgggagggtacaaaaccctggggatgtgatggttttatccggtcctcaaaggatttcaagttgttaccgcggggagagcttttccccaaaagaaaggcggcccaagatgggatttcaatccgaacccccacattttccgaagggtcttcccgggccacggtatgaggtctgcaaaactcacatgaattccgcgagttttccccctttggttcatatggctaatcacgcatttttgcttacgcaggattgtaagaggaaccttgtgtctggaggcacaggtgttcataaaaatttttgggttcaaacattttgggggtattgggaaactggagccccggggccacggacctgcgtcctcaaaactttttttggggaacctcatatgaggcggcccacaacggtgccggggcccgctcccacggtaaaaggaggctgcacgaccaaaagcaaatttgtgaaatcccctgcaaggtcctatacttttccactcccccacgtccccactgagccgaccgtgaatggttctccaccggagatgctatatttgaaccttggtgaagcctctcggagaccccgtgaggcacagggttccaccttcacgaggcacacagtgtgtttgtcaccggcgggtttctcagggagcacaaaaggtccacccgcctgctttttgagagaattctgggagatgtgcaccgagatgacggttctgtccccacatattttttgtttttttggccggagtggctgagggcctggtggctgcctcctatagaaagtggcacacagactgagaagggccaacattttctgggagcttggcaaggagatccttcccgggcatttaaagagactccaagggttaata

SEQ ID NO: 681529 - DNA, 144 bp, Homo sapiens
ctccagaagggcgactggtgatataggcggagagggtcacttcgatcttctactcctccctttatggcacttgttgagcagtgacccaggagctcctgtaaacagccattgtccttctgcctctggagtaagtgcgcctgggtg

SEQ ID NO: 681530 - DNA, 123 bp, Homo sapiens
actgccgtgcacggtctgactctaggaggactccccacgcaatattctcctattctactcgcgcatcttatatagcttcagaggccagatgtcgttcttcaaaaactatgaaattaagaatga

SEQ ID NO: 681531 - DNA, 1172 bp, Homo sapiens
cccacgcgtccgcagagttctagcagctgggggttcttgggccatgctccgtgtgtggatcaggaatagaatatactgtattctgggagctcctcccagcaggtcacaaagctgtgtgttcatctgatggcccctacatcgtctgtaaacttatagctattactcactagtggctgcctttccggcattactggcttgatctaatcttccttgcatccatctcagctgacaggatcctagttactacatccctactggaacatatgttcatattgacagtcttacttgggagagccagattttctctgtgctcttgagttgttttattcattcaagaaaccttgggccaccgctttgtacatagcaccgtgctaggctctgggatcccaaatggacccttttaactttctgaagatgggaccgtcccctggaggaaagtcattcctgcctaatccatcgagagaaagaggcttacaaaaaactttgcctctgatgctcagccccacccccaaatagcacacaagcttgttaaccccacctcttacaaaatgtttagattctgtaggtgttaaaagcctttctggaagtattgcattctgccgtgtttataggtgttcactttcctccagagctgattaactactgacatgacttggctttctcatccagaaattatggaaacagggtctgtcagtggcaggaggccgtgctgtgtttacttgggatgacacaatgcagttaattgactcttcatactcatgcttgctgctcaccctagaacatgacatataaggccggatattatcatgtgcccatttttttacacacaccttatatatatcacagggggacacggacaacaaaacagggcggaactgtcctctggcagcacagaacattataccacttttttatcccacgacaagaaggagcgttacataaccatgtgttttgtttgacacatagtcccagtgtgcatcacagggagacgaataaccatcctcattagagaacaacatctagttacaccatacgaggcacagaacatgagtggctgtcccacaaataagtgtctacctcggcgaggggcgacacacaaggcggattagcttaagttcggtagccaacaatcactgtaggcaacatacaatcacatgtagtaatcagctgca

SEQ ID NO: 681532 - DNA, 622 bp, Homo sapiens
  misc_feature (484)..(484): n is a, c, g, or t
  misc_feature (555)..(555): n is a, c, g, or t
cacgaatctgtaaattgcgtgggcagtatggccattaaaacaatattggtttttcctatcaatgagtgtggaatggtttaatatttttttgtgttatctctgatttctttcagtagtgttttgtaattcttgttgtagcggtcttttaatttcttggttagctgtactcctagctgtgttattttttgttgctattgtgaatgggattgcattcttgatttgcctctcgtcttggatgttataggtgtgtagaaatgctactgatttttgtacattgattttgtatcctgaaactttgctgtagttgtttatcagctgaaggagcttttggaccaagattatggggttttctagatataaaatcatgtcatctgcaaacaggaatagtttgactgcctctcttcctatttggatgccctttatttctttctcttgcctgatggctctggccagggcttccaatactacgttgaatctgagtgtngagagagggcatccttgtcttgtgctggtttcaaggggaatgcttccaggtttgctcattccatgtgatgnttgtgggttctcgtagatagctctatatttgaggtatgtccttcgtgatagttgttgaggtttacat

SEQ ID NO: 681533 - DNA, 1648 bp, Homo sapiens
tggcaaaaaattcccctttaaaaacccgggggggacccccaaaggggggggggggggtgcgcggggcgcccaagaatacccagggcccggggcgcccaccacactccacaaggccacaaagggggggtgcatgaaaaaagagccccacagacaggggggcgtataaaaaagcgcacaataacatattcaccacaatcgcgcgagagaggggcgccggggagagagagcgacaaggcgcccaaactctataaacacacactgtgggcgtgtgtgcaacaaaacacatacaacaacaaacacaccgagggggcgcctgtgtgggacagagaaaaaggggagagagcaacaaggggccacacagaggagaggcgagagatatccccacaaaagagagcagagagagacaccacaaaagaacccacagcaaacaacagaggagcgacccacaaagcgagaacaaacaaaagagcagaagacgaaacaccaccaagtcaaaatagagagagcaaggagagaaaagcaggaggaaaaggaaataaagcagcacaaaacacacacaaaaaatgaaggagagaaacgaaccgagcaaaaaacaaggagaaggagtgagaacgagcgcagagaaaagaggaaacaagacgcacccacgcagaaaggtgagagcagccagagaggagacgagacgaagcgcaacgcaaccgaaaagacaacggagacaccagcaggaatgaggaacccgtgtagaagacaaaacacgaccacagcgcgcaccacccaagccggatgaacacagaagaggagaaaccaatagagaggaaaacagacgatacacacacagaagaagagagaaccacatcgaagagaacgacccaacaaagaaaaaatagagagaacgaaacataaattcaaacaagagagaaaggagagatccaccaccaacacgaccctgaagaagacaacaaagaaatcaaaagcacaacacaaaaccgaaggaagcaacccagcacgcggaaggcactaaaaaagcgtagagagagagcatagtaaaaaacaccagacgaacggacatgaagtacagacagatagaccaacagaaaaggacgagggaagaacaaaagaagcgagcagaacacaccagggtgccacaaccaccaacaacaacacaacaagacacagccacatacacaagatcccacacgagaaagaagaagaaagaacgagacgcaccagacaagatgagaggataacaaccaaacaaggcaaaaataacacaaacacgaccagacgaaaacgaggtgaacgaaacacaaacacgatgaaacacacaccaagagcacacagcaggacagaacacgagacggcgaggaaaaacgaacacagtacgacgcacgcacaacaatcagagcgcagaggcgagcaacacagcggacgacgcgtaaaacaaacgagcgacaaacaagacgcccacgacaaaaagcagcacagaagagatagccgacaaagaacagcacaaacgagaggacgacaatcacagtagaaagaaacgacgcatcaatacaagcgcacacaagaagagaagacctttagtcgcacacatcacaaggtggtagaaataacagagagataagaacggatgaagggtgcggag

SEQ ID NO: 681534 - DNA, 205 bp, Homo sapiens
caatgctgactattccctcggaataacattactcaacataccgtgtctattgtcctccctccttcgtgttatatctttctcctcctactaatgaagtttagcattcgcttaccatacaacccaacaagttcacttctgagtattatttaaccaagaaaaacgaaaacatgcccacacaaagacttgtacatgaatgttcatatca

SEQ ID NO: 681535 - DNA, 152 bp, Homo sapiens
tgacatgtcgtaaccattctctttccataagcccatcaatacaatttctggtgttgcagatagttagaaggtaaagctagagaagatgagagtgtgtttacggtagaccagaaccaatcaagaagaatacttactatgctagcatagaagag

SEQ ID NO: 681536 - DNA, 676 bp, Homo sapiens
ttcggcacgaggttctattgtatccttggccagaaactgggtgaaaagaataagcagacaatttttggagatactgaggaatttcaagctgtgtacatggagctgcaaaacttggtccctaagtcagcaagaggaacattatctgtcaattctagcgatgggattcaagtgatcattgatgcatacaagttcctttcctcagaagtcatttgtggaaacgggcattgtgagaaggcgttaccattagttacaaatgttactgctagaacggagtgaacggcacaggtgaaaatgggagaaaaagttgcaatatttacattggggatgagggtaaattttgaagtatcatcactgtagataagtgtcccatacaggaatgtgacagctataaaaattatgcctctgtgctttacggaggaaggtgaggttattcttcagtacatcctgagaatgtggatgccaaagccgaggcattccttgaaagcctcaagtgcatgaacggaaagggacatttgagtgcgtgcccgtccagttcaaagaagcgctgtattgtacgacatttgtgatgctgcacagatgaaggttacagttgaagccaaactgctgatttttgtaacaactgctgcttctagagctggggtggttttggagctcttaacggattattgccagagct

SEQ ID NO: 681537 - DNA, 418 bp, Homo sapiens
tagaggacctgcaggttaagggctacccctataatcccagcagtttgggaagctgaggcgggtggatcatgagatcaggagctcaagaccagcctggcaagatggtgaaacccatctctactaaaaatacaaaaataagccaggcgtggtggcgggtgcctggaatcccagctactcaggaggctgaggcagagaattgcttgaacccaggaggtggaggttgcagggagctgagatcgcgccactgcactgaagcctgggcaacagagagatactctgtctcaaaaaaaaaaaaaaaaaggacggtttttccgaaaccaaattccctcttaaatttcccaattttgcagacaccaatgggattttcctctcattccaaaaggaccagaattttcaccacatttagaactatgggggt

SEQ ID NO: 681538 - DNA, 164 bp, Homo sapiens
acgctggtgattatctcttccgctcgctttcctcttcctctttctcttcctcctcctcctcactgctgtgctggtcctctataggtctcctatggggttgacggtgatggtcagggcagagtcgtcccagtcctatctcgttctcccccctggacaaggcaggg

SEQ ID NO: 681539 - DNA, 137 bp, Homo sapiens
  misc_feature (1)..(1): n is a, c, g, or t
nctaaccgtttctgttggctacaaagtcacagttacccgctgaaaagggtttcttagaactgaggccctttgcacatgtctactaccaaagggttgatgtggggctactggaattgacagggggatcatctagagtc

SEQ ID NO: 681540 - DNA, 1001 bp, Homo sapiens
gcgcgttgggtcacacctggaataacatgaatgaaggcaggcccgaggcgcgctgattcatctgaggtctagagtcagtatgactagggccgtgtcaggatggtgacatagtcttatctctataatcagagacggatgagtgagccagacgcgctggcaggtgcgcgtgggtatcaccaggtacctagctaggggcgcctgatgtcatgggacgattgcacttgcaaccctgggacggcagagaggtgaaagttgcacgtctacggtcacagccacccgcaactcaagcgctgggtaagcaataagcagagcactacgcggcacttcaaaacccttgataaaaacaataaagttaggctagggggcctaaacattttaggggccattccccccagtataacacgatgtgaggagaggatacacaagccttttgggatggcctgtgacgtctgaaagggaattcctagagaatcacctgggactacaataataagtaggtgtggatcaccggaactttaaaagaacgtctgggcacaatgggaaagggatcctgctaagacctgcatggtgggggctcacaccgtgtaaagttccgaagcaatagggaggctgcagcacggaggaatgtttgaacccaggcgcgggcggaaccatgtgggccacatggtgaagaccccggttctctacccaacaaaaaaacacaaaattgaccggtgttggaggtgtgcgccccggtgccccagccaatcaacagctaagggggcagattggaacccaggcagcgagagtcgcgtgccctgatggccaccggactcacctggtgagagcagacggttccacacaaggacaactcgggttggtggaaaacgagaaggggcggcaaggaacaacggaaaggaatgcgcatgagatgactgagacggttgatgaagaaacacgcattttgaacaactcggagataggagaccacaggacaacacaacacaacaatgagagataca

SEQ ID NO: 681541 - DNA, 496 bp, Homo sapiens
  misc_feature (28)..(28): n is a, c, g, or t
  misc_feature (47)..(47): n is a, c, g, or t
  misc_feature (50)..(51): n is a, c, g, or t
  misc_feature (60)..(60): n is a, c, g, or t
  misc_feature (75)..(75): n is a, c, g, or t
  misc_feature (77)..(77): n is a, c, g, or t
  misc_feature (112)..(112): n is a, c, g, or t
  misc_feature (151)..(151): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (213)..(213): n is a, c, g, or t
  misc_feature (350)..(350): n is a, c, g, or t
gaataatttcgtaaggaagatcttgtangtagcacctagtcaggatnaanngctgcgganggccttccatatgcncngttaaaatcataaactcctccgcccccaaataaanatgatccagatttctatagtgtgtatttccttgtttctntaatagttttatagtgcattcctagacactatacattatagtttagtcctgtngntttnctnaccttttaaattaactttattaaggaataatttacatacaataaaatgttattctaagtgtacagtttgatgttgcattcagttcctttaaagttatggaagtattcaggctttctatttcttctcgagtcagtttnggaaaaaatctgtgtctttcaagaaatttgtttcatgtaagttgtcagatttttttgacatcaggttgttaataattttgcattattatggttctgatgtgtctgttatgatgacccctctttcagttctgatacggttttgaggg

SEQ ID NO: 681542 - DNA, 210 bp, Homo sapiens
catggcgagcgcgcgctggacattgacatctaccagtagtaggaataagactatatctctatggcacagaagtatacatttctgtatgtgtctcagacctagatctgcttctgatactctatttctataccgtccaccttgaagatgaagcaaaagaaactcaaacttaaagctacatccgtgatcctgcctgttgctcatggatcattg

SEQ ID NO: 681543 - DNA, 552 bp, Homo sapiens
  misc_feature (68)..(68): n is a, c, g, or t
tgccatggtgactcatatttggctcagaataaatctcttcaaatatttcacagagttcgactcttttntgacacaaaaacactcagcagtgaccctcccctggaaacattttaaggggatgaaacaagcaagaataaggcagggcttccttcaaattgaagaaaattcctcataaggtccccaacccactagaatcaggaagggtcatagagccctgtggcacatattctagtataactaatacccaggtgcccaaaggactcagccttctagagaaaacctacctgctttacctaacagagccctgaccccaccaacggctccagaatacccagcctccggtcctgtaaatcaagacatcatcacctctcgatcaccttctgtacagatgtgggaatacccattgtgccaaaatgccaaaacagagtccctgctctggtctccatgagctgtgacttccctgtgaacctaccctctgtatggctggcttctgaagacccaacaaaacctgtgagtgtttaattacggagggccagcaggaacatttctgcg

SEQ ID NO: 681544 - DNA, 395 bp, Homo sapiens
tgcaacttgcattctgctggtcgtctctagagttcccgggagtggagagagaatgcagcagaagagtgtctctaggtcgaacaggatgagtatctccacgtatgggttggtggtacctgttagtcacatcccggtagattttccgtgtgggcagtgggacgcgagtctgaagctcaggcgtataggctacatgttagatccttggatgtcatcagcctcactgtaggactgtggcatcccaggtatcaaaagctagggaaagggctctggagagagaggggcttccttagttgacctgtatgcttttgaagctctataaagacacaatcttatcccttcaggacgtgtattatcttcgggccagtaagatgtggttccctactttctctctccac

SEQ ID NO: 681545 - DNA, 118 bp, Homo sapiens
ttatttcccttttttgattcagcttatacccgggctgaaaacctccatttatgttcatgccagtgggggtttttttaaatgtctcccttctttttaataaactgttggaaggcttcca

SEQ ID NO: 681546 - DNA, 115 bp, Homo sapiens
  misc_feature (43)..(43): n is a, c, g, or t
agaaattcaggtatgtagccttaaaattattatttagattaangttaattaagaggatatggttattcatttgcaaaaggattagggttagacttgtacaggatatacacattag

SEQ ID NO: 681547 - DNA, 777 bp, Homo sapiens
gcgggtggtggatgaccttgagtccctcaggaacgagatgggggttctctggaggctgagttgccgtttgcgtgtgccctaggaggccgagctctggttggcttcgaactccagtggtcagacctgctcatagtctcagacaatttcttcaggacacgatcctatccgcagaatggtgtggagtgcagcatcatacacttggtcaccgagtccacctagttctggctccgaaggctgctatctctcgctactggagctgagtgagagggttgtcagtgttttgctcctggggtctggcttccggctgcgttatttgcatccttgcgtctgcgatggtgtattccctgggctgctgtcctcactcttcatgcgtcacttggggccattggacaaggttgttactgactatgttcagtggggatgccttgctagaaaggtgcacaaggccggggttttggcactttcatgctttgagcctttgctgggcttttgctattctcaactatcacgatgtgggcgatctgcaatagctgatggcatgctggggaaggctctgacacttttgtgacttcatactttgcaagacttgatgtatgcctcttgtgcctctgcgtttgtcatgccattgagcttagcatataaggcaagaagtagcagatgcgtccatgggtggacaggccttcttgctctttaattcacacagaattattttgcacgacttgtagctcttgtgcggaacaaggttcgagacggaatgatatctaagttgtgcagact

SEQ ID NO: 681548 - DNA, 137 bp, Homo sapiens
tacctcatacagtccataccataacacacacacccgcacacatccatacagtccacaccataacacacacacccgcacacatccatacagtccacaccataacacacacacacccgcacacatccatccagtccaca

SEQ ID NO: 681549 - DNA, 181 bp, Homo sapiens
tctctctgtaggggacgtactctctgtgggggaggcacccatctgccttacgctctctcttgggggacgttctctctttgggggaggcccagctattctgcctgacgctctctctgtgggggacgctctctctttgggggggtggtccgtgcaagctgggcctcccccacagagagagcgt

SEQ ID NO: 681550 - DNA, 279 bp, Homo sapiens
ggaatttgagaccagcctgggcaacattatgagaccccgtctccacagcaaacaaaaaacttagccgggcgtggtagtgagtgcctgtggtcccatctattggggaggcagtggtgagaagattgcttgagcgcaggaggtcaagcctgcagtgagctgcgatcgtgccactgcattccacccttggcaacagagaccctgtatccaaacaaaaaacacacaaaaaaaactttccttagtatctagttatacctattagctaattatcaacataaattt

SEQ ID NO: 681551 - DNA, 241 bp, Homo sapiens
tgggacccccgggggggataatttattgccccaggatttctaacccaccccgggcgacaagggaaagtcttgtttctccaagaaaaataaaatttagccggggggggtcgcatacacccgttttcctatttacttgggaggctagggcgggagatcatttgagctcgggaggttgaggctagctacactgggatcatgccactgcactccagcctgggtgatacagtgagaccttggctca

SEQ ID NO: 681552 - DNA, 243 bp, Homo sapiens
atgtgcttacagaagcctacatggtgtagcctactgcacacctagattatatggaatagccttttgctcctaggctacaaacctgtacagcacgttgctgcactgaatactgtaggcaactggagcccactgttaagtatttgtatatctaaacatagaaaaagtacagtaaaaaacagtgatataatctcatgggaccataccatagtcatatatgtggttccttgttgactgaaacatcgt

SEQ ID NO: 681553 - DNA, 850 bp, Homo sapiens
gttccagagtgggtggccgcccccgtggaccacggggtgtgtgcccccccccacaatggttcaaggggtctaagaagagttagcgccgtatattggggtctattgaaaacgccgctttttgacgctgagagtaattcccgccatatgtggtggtacacgtgtagtttgcaattagtcggatgacggggtagaccgcgcacacctgtatggcccgcgcccgatcattgccgggtctctaaataacgggtttccccggaccacgcacgttgtttcctaaattaatcattgctccttgagtccccaccgttttcccccaattttttggctttttttacaaccacggtcgcctcttcccccccacgacggcttattaccaaagacggcaattccccacatctataataggggggtgaacccaagaaaagtttcttttcttagccccaactacgcacacaaaccctgttcgctctcgcatagattaagaccttctcctccaagatattgtctgtgccacctctccaacacacgtgtcgtcattcacacacaaattcatctgcccggctcactcaaatttcctttctcccgtatcacaatgctcctcccctttacaactattggcggagggacaacttataagaaaaaatatattccgacccggagtcatggaggactttgatgtaaactgaggaattcacccgttgttaccaaaataaagagccatacaatggccatgtttatgacgacgatgttatgcctgcagagcaacgacgcctcgaggttccggcggtataccttatgacgattcacttgctcccgcccccaacaaaaaaaaaataaacaactacataac

SEQ ID NO: 681554 - DNA, 325 bp, Homo sapiens
  misc_feature (53)..(53): n is a, c, g, or t
  misc_feature (62)..(62): n is a, c, g, or t
tctaatccgagcccactgtcccgcttcccgcacgggaagcccccccgttcagnagaccccanctgggcaattcagccttgatctgagtgagctaactgacacaatgaaactgtcaggcatgtttctgcggctctgtctggctcttttctgctttttaacaggtgtcttcagtcagggaggacaggttgactgtggtgagttccaggacaccaaggtctactgcactcgggaatctaacccacactgtagctctgatggccagacatatggcaataaatgtgccttggtgggggccatagtgaaaagtggtggaaagattagccta

SEQ ID NO: 681555 - DNA, 714 bp, Homo sapiens
gctctagaaccgaggatccccaggcaccatttattaaatagggtatcctttccccattgcttgtttttctcaggtttgtcaaagatcagatagttgtagatatgcggcattatttctgagggctctgttctgttccattgatctatatctctgttttggtactagtaccatgctgttttgcttactgtagccttgtagtgtagtttgaagtcaggtagcgtgatgcctccagctttgtccttttggcttaggattgacttggtgatgtaggctcttttttggttccatatgaactttaaagtagttttttccaattctgtgaagaaagtcattggtagcttgatggggatggcattgtatctatttaccttgggcaatatggccattttcacgatattgattcttcctacccatgagcatggaatgttcttccatttcgttgtatccacttttatttcattgagcagtggtttgtagttctccttgaagaggtccttcacatcccttgtaaggtggattcctaggtattttattctctttgaatcaattgtgaatgggagttcactcatgatttggctctctggttggctggtatttgggtataagaatgcttgtgattttggtacaattgatttgaatcctgagactttgctgaagttgctaccagcttgagatttggcttagacaattgcgtttctagaatttaatctgcct

SEQ ID NO: 681556 - DNA, 605 bp, Homo sapiens
tcgaggtcccggtgtgtcctttgtctactatcacatggcgccgactctcagaccttcagatttatgttgacgatctgagacatgtctgtgagaatgttttccacgtccctatagaattgacgagtccagagctatgactgataggaactggtggacacggttaaagtgtgtaggacaccaaaatgaatagagcgaaggtgtgctttgagaaggctctgtaatagaagccaaagaacccagaattcacctctggactggcaatagcaagctaccgtctggacgacttgccgccatcttacaacgccattgaccctctaaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgtacttcgcagtgcagcccagttttatcgaagaaaagatgagccagacaaagcgattgaactgcttaaaaaggctttagaatacataccaaacaatgcctacctgcattgccacattgggtgctgctatagggcaaaa

SEQ ID NO: 681557 - DNA, 179 bp, Homo sapiens
acttggtgacctcacaatcacgtcggtatgattgggcaccttgcctacctgtaagagaccctaaaacccttggtgccagttggtgggggcccgaaaaacaacccacgggagggaggagatacaatcatttttttagtatttaaggcccatcttaaagacaagctctaattttttttttt

SEQ ID NO: 681558 - DNA, 485 bp, Homo sapiens
agcgggaacctgcacggtggccgggaatagtacgggaccgggtccggcagcgggtcgagtatgccctataaattgaaccaggataacgagtgccccaatgttgtcaagatgcacaatcatacataatctcgtcggtcagcgatgatggacgcgaaaatactgaggaggcccagtccgtggtgctatgttgaatagcagtgttttatccaagtatgaagatcgagattactactttgtcactgcactacactagcaagaatatccagatacagatgagctggtactggatcttagggaaggcagcatcatccgttaaaacagattgggaaagaaagaccttttaacctgaaatctgctaacagtccagcacccagataaagccagagcttggaaagaggcagctctgagatttcgtgtctatgtctgaggagacatcctcttcagaggggcctcacttagcgtggaggaaggaacggaagaggctg

SEQ ID NO: 681559 - DNA, 354 bp, Homo sapiens
tgaggcttctacaagtgctagcgcttggcacatgtcacggtgagaggttacggcagtgggtgtgtgcagagcctggtgggaatggggagacccgtggacagagcttgttcagagtgtcctatgagccagggggaactccatgcagtgcaacttgggccctggatgttgagaagctgggtaacacgtactgagagaacaaaagcttgtgggtcagcaggccccacaaagatgtgaccgcagacaggatcaggacctgggagagaccgagtgtccaggtgactcctatatcacggcggtgagagggcgggtctggggctccagttcaggaatacatagtcagctgcagccactgca

SEQ ID NO: 681560 - DNA, 161 bp, Homo sapiens
ccgatctctagagtgatcccctcccaaggataggaattgcaggctttgggtggcagtataggcatgtgcccaggcagaagcaaatgctagagaaaaactacatgagaggccttgattgtgcacctggaaccaagaaaagacacttccatgtgattcagttt

SEQ ID NO: 681561 - DNA, 693 bp, Homo sapiens
gcaagaccggcaccgtcccggccttccatgctctgcagcacgctgctggtcatcaagatgtacgtgggggccatcatcacgggccaagatgaggctgcggaagaaggccgttgccaaccccgaggatgccctgagacacggaggcccccagtattgcaggagtgaccccgacgtggaacgctgcctcagggcccaccggaacgacatggagaggcatctacacccttccttttcctgggcttcgtctactcctttctgggtcctaacccttttgtcgccatggatgcacttccatggatcttcctcgatgaggccgatgatggcacacaccgtggcctacactggggaagctgagcggcacccagtccgcctccgatgaactacaaccatggacccagcatccccctgcgccatccatggctctgcagatcctctgggaagcggcacgccacctgatgaccagacagctgatgcctccttggacaccagaccatgggacaaagagccgacgagggcatataccctgggggacctctgatgttcccttccacaattagtgagaggcacccttgagatcctgggtaccctggcagactgctgccgcgtgtagcgtctctgggaccacaatggcgcctgtgtgtgtgcccatcatgatgtgtatctgtactgcgagtgcgtatgctacttaagccc

SEQ ID NO: 681562 - DNA, 216 bp, Homo sapiens
tccccctggtacgggagtggagtggctccgcagatacctggagaacgggaaggagacgctgcagcgcacggacgcccccaagacgcatatgactcaccacgctgtctctgaccatgaggccacccgtgaggtgctgggccctgacgcttctacccgtgcggagatcacacgtgaccgtggcagcggggcatgggggaggaccgagacccagggaca

SEQ ID NO: 681563 - DNA, 199 bp, Homo sapiens
aatttgttctataccacataatttgtctctagcttgggtaagtccctttctcttaagtgcctgtttcctcatctgtaaaataggggcagtcattatctatctcatgcaccaatacactatgtgcatctatacaactgtgagggcaccatccatgtcacctatgcgcaatgcaggacctactgtgtgatctatggcctga

SEQ ID NO: 681564 - DNA, 184 bp, Homo sapiens
gcagatcgagtcatccacgccactcctagtcctaggcatgagtacaggccactcagcattatctcacccttatgcttatgaagccctagaactgggatcacatgagatatccggatagtggaactgcccagtgattcacaccccttagtactcgggtttctggatcccctcgggcatatcgact

SEQ ID NO: 681565 - DNA, 301 bp, Homo sapiens
  misc_feature (44)..(44): n is a, c, g, or t
  misc_feature (196)..(196): n is a, c, g, or t
gagattttgatctatgttatacagtaaccacaacaaataggtanagcacagaattgattaaaaatatgaagtcagccagttgtggtggctcacacctgtaataccagcactttgggaggctgaggcaggcagatcacctgaggtcaggagttcaaaagcagcctggccaacatggtgaaaccccatctctactaanaatacaaaaattttcccatgcgcagtgatatgtgcatataatcccagctactcaggaggctgacacagaagaatcacttgaacccgggaggcggagttgtaatga

SEQ ID NO: 681566 - DNA, 83 bp, Homo sapiens
gtgggaacaaaacaatagatcgttttttgtttaaaatctcttcttcctcaggagtcagcttggctcccttctgtcgtcttctc

SEQ ID NO: 681567 - DNA, 175 bp, Homo sapiens
ccctgattgcagccggctgagctcacccagtgagcctacattcctaccttctcccattcccagcctgatgtaaccttcaacgtctctggtccctgtaggccaccgctcagcttcccagcatcttttgtaggtgggtactactagggtaagacagatctttccatcatgagggtgc

SEQ ID NO: 681568 - DNA, 133 bp, Homo sapiens
tcacccggacctgctattatcggcacctatctttcctagcctccctatcttgcaaagggtgccgatagaatagcgaagagtgcgatgactagcgcaggtgccgatgacatagcgaggtgccgatgaatagcga

SEQ ID NO: 681569 - DNA, 141 bp, Homo sapiens
gtataaacataaattggatttcctgttttaattccaggggaagtactgttgggaaagctattattagggtaatggtttaccaattactggttttccctttccagtcataccctaatgatcccagcaagataatgtcctgtc

SEQ ID NO: 681570 - DNA, 392 bp, Homo sapiens
  misc_feature (392)..(392): n is a, c, g, or t
tacctatggctgcaggattggatattcttctccgcttacactctctgaccagtccagccaaaaaaaaaaaaaaaaaaaaaaaaaaaaacttgtgtgggcgccgcgctttcggcgcccttcggaagaaactgttttttaagaaccatatccggttgggcgcgcgcgggggcgcccaagtagggtaatggtggaacttgggccatataagtgtggtttccctaaggaaaactcctggggccacgtggactaaggtggcgggggttctcccaaccaataaaaaaaacgccgccgggggggcaaccggacgcggttctggaccaaactcccaggaggggaggtcggaggggccataacggggactctactcaaccgggagcccagcggagcccggn

SEQ ID NO: 681571 - DNA, 882 bp, Homo sapiens
tatagagtgcacagccaccatgcccagctaatttatgtattgtttgcatagacaggacttcctcatgtggtccacggctggtctcgaactcctgggctcaagcagtctgcccgcctgagcctcccaaagttctgggattacaggtgtgaaccaccatgtccccgcgtggcccttctttacttagctatatattatccttactaagagttaggttccctagcccatcagaaagattcccaggctggctacttcgggatgacccttgcgattttgtatttgaaactcatttctgaatcttgggtccccagtagctgttaagacataggaactatatctgtgttgcagctttgcacttcgcaagttataagaagaatatgcctggcgtgtgttaggcactcagaaaatgttcgaacgtgaaccaatggtgtgtgtgtctctggacactctaagttagtgtaaatcagaacaggctggttgttgcgtgcttgtttggatgccaagaccaagagagtgattgataaatgtgctaagtattttctgtggtcttaaggtatgttgggtgtaacagtaagtgtggcatacacagcatagttaaatggcccttcattcttcagacaagaaatgcacaagggccaacgatgtcagggccgtttgaacttcactggggagaccatggacagttctgtcctcagggctagacggccccggggaacgggggtgccccttggtcaccgggtgataagctaggaacagaaggttcgtgcgataggaaatcagagcacggcgaacggtgccaggtggctcccgaacagaagggcttgcagcgacaggtcccggggaagctcccaaactgacgcggaaccaaatgtcacatccgctaga

SEQ ID NO: 681572 - DNA, 391 bp, Homo sapiens
tgctaatttttgtacttttagtagaggtgggttcagcatgttgggcaggttagtctcgaactcctggactcaaaatatctacccaccttggctaggattacaggcttgagccaccgtcctgggcaagattggcactcttttttttttggagatggagtctcgctcttgtccctcaggctggatggagtgcaggggtgggatctcagctcattgtgcaagctcctgcctctgtgggttcatgccattctcctacctcaggctcccgattagttgggactacgggcaccctgccaccatgcccggctgatttttgtgtattttgtggtagagacggggtttcaccatgttggccaggcgggtctcgaagtcccgacctcaggtgatcctgccg

SEQ ID NO: 681573 - DNA, 312 bp, Homo sapiens
  misc_feature (262)..(262): n is a, c, g, or t
  misc_feature (279)..(279): n is a, c, g, or t
agacctaatcatagtcaactctgtctccagtgtgctagctaaacctctcgcggttcctaaatgactactccaccgaatattttatatctacattctgaggtctcaactgagtgagacaactcactatttccgcgtaagtcacagtgccccacttcctgcctggactactgaccgccgtctacataattgattccggctacacccggggagacgatgaaatatccaagtgtgatcttccgctcccactgctctgaacgtcctncgatcggtcattcgcanctgaccagcggtgacaattcactggactgctgg

SEQ ID NO: 681574 - DNA, 247 bp, Homo sapiens
ctttgggtcactcgcttaaatgcccattatctcgtctcctttttttgtcaaccttgtatccagtaagtaccaagtcctcattttgtccgggaagacttttgaattactttcaatgatgcagtcatttttctctatcaccctgcctcttttccctctaatgtttctagatttgcttccagacatgcaatccttgagttttcactacttgtctacatgcgggatacccgacgctcgatcattcgctaat

SEQ ID NO: 681575 - DNA, 143 bp, Homo sapiens
  misc_feature (52)..(52): n is a, c, g, or t
atcacccagccggacagcggagggttcggagagaaattgctaaagcccttancaaaagctttacgatgcactcactcaccattcatatggaatctccagttgaccattaccccgactgccttttctgtgaagacccggcgttc

SEQ ID NO: 681576 - DNA, 611 bp, Homo sapiens
  misc_feature (445)..(445): n is a, c, g, or t
  misc_feature (594)..(594): n is a, c, g, or t
aaagcttgatgcgtgtaggtgtatcgactctgatctcgccgtaaaattaccggcggatagtgttgtcgatataatgcaagcctcgcgcggcgcttgctactcattgggtttaccacggtgtggcatgggtttgctgatatgcttatttgcatgctttgcatgcgaaggatgccagagataaacggcacacaggaatattactgtggctgtacagactccaccttctgcgggcgttcaggaattcctggcatggagtgaacatgagcaacgccatgatggcatcccagaaacactcgacggcagagtgacacctttctggctcacaagtggcacacagtcctgtgctttcctacaacctgcccttgcttgggtctggctccaggccttactacagggccgggatgctcaggaccccatgaagcatggcattgtttgggcagcacanacacaacgttcacctgggtcctggcaccttttctcggcagcgctgctttggtaaatatttggctggctcacccaggagaggaccacaggacctctttacccatatcccaacaatcccagttccacaaagatgggctagagtgtgctggngacaggcacagaagaat

SEQ ID NO: 681577 - DNA, 213 bp, Homo sapiens
ctacaggaccccggaaatgtgtggtgttatgaacatctagaagttgagttcaaaattcagaaggtgtcacccatccagtgtctgttactgcagaagctataccttcttcggctctagaaatattttatggacctgacggtctacctcttccacctagactgattactatagaggagatagtagaggatattccatccataacaccacacaatt

SEQ ID NO: 681578 - DNA, 456 bp, Homo sapiens
  misc_feature (8)..(8): n is a, c, g, or t
  misc_feature (33)..(33): n is a, c, g, or t
  misc_feature (159)..(159): n is a, c, g, or t
  misc_feature (210)..(210): n is a, c, g, or t
  misc_feature (263)..(264): n is a, c, g, or t
atttaatntactcattatagtattttggctttnagcccaataatttggtataagtgctttccacttgggccttaaacacagcaagaataggccccagcaccggttcatggcccacttgcccgcacttgcagaaggataaggccatcaccctccgtggantggttttcggccaccacatccaccttctgaaggtggcccagacacctccangctgctgactgcacttcccatcaaaagggactccttggggcagagtgggccgnncccctacccccgaggaaggcaccctcctgggcggggacagaccttggctccatgctgccaagtcaaggtgctggcgtggaaacaggcacatgtggaacaccacatcccactgtccaaggtggagtccacccctcctcggagcactcagcccaccagggtccaagcagccctcgggagataccacgcggccgc

SEQ ID NO: 681579 - DNA, 380 bp, Homo sapiens
  misc_feature (134)..(134): n is a, c, g, or t
  misc_feature (187)..(188): n is a, c, g, or t
tatagtaaggagaggttttagtattggttttaggtttattggtttgtattgtaagaagggaaaggttattatcttttgtggatggggtcttggttatcatatttactttttgaaggtggcccagacacctccangctgctgactgcacttcccatcaaaagggactccttggggcagagtgggccgnncccctacccccgaggaaggcaccctcctgggcggggacagaccttggctccatgctgccaagtcaaggtgctggcgtggaaacaggcacatgtggaacaccacatcccactgtccaaggtggagtccacccctcctcggagcactcagcccaccagggtccaagcagccctcgggagataccacgcggccgc

SEQ ID NO: 681580 - DNA, 1026 bp, Homo sapiens
agcgggtgtgacaggaaggttaagcacgccagcaactcttggttagtgattgtctttctcatcctcatggtggccaggcaggggttagagttggtttggtcgaaaaaggacttgagcggtagatgtgtcgtaggtctgtgctcttcgtcgttggctctggtagaacattatgggcatcgcaagaatggtctcaataaccggaaaaagctgtgtcgcgctggacaataggttcgttcatgtctggccagtttcgaatagctgatcttatggctctatcaatgggtttgtgacatatctctgttggactctctgtcatggcggaacttcgtagatcctgacgtatgtgagtgtagatgcgcatgtaacatgaagacacatgactcccgaggcgagtgtcaagagaagagccatggcggagaaaacctgcactcctcatgggctgtgtagaacgttggagttccactcgggctcgtggaatcttagggctagtcaatctctgggcagtttaccgtatatggtaggaaccttgatgtctgtgtactaagtcgtcatggtggccaaggttgaccgtgcccaaatttcacgtccgaggcgagattaggctcctctgatttatcttccgcatgtagagttgctggcactctcgtatatgcccgtcatgacattttaattgtgcatggttgcctgtgaataaattgtctatgctaattgggagtaacaaggtctttgtggaggtagaagaccacatggtccagtcacttgccttgaagaaacaggatatcatttaaaaagtagtcatggaggaaggacattgcaaagctggacgtaagtactgtcattactggatggtgttagttgaaactgggagatgctgggggatggagagagagaaagtggggaaagtgagatcgtagagaaaagaacctggaaattaaattgtgaagatcgcagtttggacatctggcgtgtgatagggatgctgaacaaagagggatgcacatgggcattgttgtaagcttaagattt

SEQ ID NO: 681581 - DNA, 256 bp, Homo sapiens
  misc_feature (58)..(58): n is a, c, g, or t
  misc_feature (92)..(93): n is a, c, g, or t
  misc_feature (114)..(114): n is a, c, g, or t
  misc_feature (121)..(122): n is a, c, g, or t
ctcgtagagcgacagaccagaaggtgcagagtacataaatcctggtgaaagactcatnagaagaaggagtggtattcatataatttgggctnngggatggcaaagcgttaaatnaatccannagtgtgggcgtggatccccacaatggcgcactcttatgctttgcggtagttgattatcgctcagcgctcccattgaagtaggataatgtatgttaaataagtttgtggtagagagaccattaatggtgaagatc

SEQ ID NO: 681582 - DNA, 1469 bp, Homo sapiens
ggacaaagtcatgtgaccgaaaccccatcgccgacggcgccgggttcgcgatcaaggaggaggagcgatgtggtggccggttggagactggatatgggatgcacggttctagcagcaaagcaactggcgtctgtcggtcgatccgtacagcggactcagtccactattgtatacgtcctgtaaaatgatcacacatctatgctcacgcatgactgtgggagcatgtctgatgcggagcttgcatgaacgtaaaatggaggagactgacatatttcgcacgagttgagtagggtactactagttcaaactgtgcattgaatgagcagtcggagtattcctcttccctaccaaatcaaattgagcgtggctaccgtgtagtgactacttgcattggcgatgctacgtgggccacagctgccacaggtcgtttccatcgaaccaatgggaggcaacagtccttgggggtggtgcacatttgtcacggggtagattagttggcccctgagtgttctccagtgcagtcactcatgttggctgctctcattcatggatggcgccctcaatgatatccgttgggtgcgcggtgtgtgtaaaatcaagctgaactagactgctaggtgatcgaaatcacgaaggaatcccccaaggactcaactctcatgcaatgttgacccatcacatgccaagcgatcccgtaatgctggactaacatatagccccctccctttggcgacgcaacggggatcaaacttgcacctgaactggtcctagggggttagatcgcgtggaaacccgaaggttacacaggtccccaagcaatattcccaattggcattatgccactttgtgcaattcccaatgtaagtggatccaagatgttgcctaggcgcacccacttcgctgggacataaggcttgtgcggttgcaacggaggttgggcccgaacgggtcgcatcgtccccacgaacaacattcatgcacccttgggcattgttagctagggctagctggctcaagagcctgggttgtcagcaatgggttcaaacgccttggacactggaactggggaaacgactcaccatgggcgatggcgcgcttctacagtaggctcccccaagtgcgcaaccgggcataaggtcagcctgggaccttgacgatgggcgggcgtagaacagaccatggcccaacgaacagaacgcgagcgacggagacaaaggcgggacgaaaacaaccggcagttcagaagggcccgccccacaagacgaccacccaggaaccaaacatgaagccccaagggatgggacgccgccggaacgacggaacaacagaaaaaccaggactactaacactaagacgccgggcgcgtgacaggccacacaaacacacctgatgcaccacaactcgagagaacaaacacatggcaccaaccaacaagcagaggcaccagtgccaaaggcccaccggagaac

SEQ ID NO: 681583 - DNA, 554 bp, Homo sapiens
  misc_feature (192)..(192): n is a, c, g, or t
agcgggagcgcgggagaccggacccgagagcagagctgctgtttcggcgcgggtcggctggcggccgactgccccagagctcatcgcatcagagtagtgtccggccaagcagcgagcctagatcgagacgactctcctcactcggtgtgaccagatgctcgatcaggggtctggatcctactctggggcatnttccagacgattggtcttctgtctaccaatcacgtgttcctcacaaaagcgagagtcggacgagacagtctctgccaagcccagtcactggtgagctccccggtctccagatgcagacatggactctgggcccgcgccggctctgggtgcatgtgcgtgtgcgtgtgtttgctgcgtggtgtcagggataggtggatccgttgaggaacaatattagttcctattaatctcatctccccaagaaggcctcacttccactcgttatccgccgggggctcagttttcccaactaatgaagccgaacctctaaatgcaccgcccccagggtcacaagctcctgaaatacctgttgcatgagagcg

SEQ ID NO: 681584 - DNA, 110 bp, Homo sapiens
cgaggcgagtatagctgtttctgagtgtaaaagacggcgagtatagcatgtttctgattgtaaacaggacggcgagtagatagctgattgctgattgtaaaaggacggtg

SEQ ID NO: 681585 - DNA, 567 bp, Homo sapiens
ggcgtactagtggcagagctgtcctagagtaacctgcgtaatcctgtaatgctcacaactgaagtatatatattgagataactatgattaataagtcagcactattaaagaaatcccaattgacaatttactcagtacatggagattgaaaaattcaaattctagggactttggagtgcctagctagtaccagggagggcagtggtaaccttgccttccaaaactttggagctgtgcatttggattggtctggtggtgcccaagcgatgggtgaagacacttaccttagttttagccatctcagcagaagtggcttcccctggtagtatacatcagaagatttaaaaaggcaagaaagacactccctgttcccctttttggagccagacattaaaaaaaaatcttttccaggtcactggctgatcacagaaaaaatggaataggccaggcacagtggctcacacatgtaatcccaacactttgggaggtcaagatgggcagatcgcttgaggtcgggagttcaagaccagcctgggcaacacagtgaaaccctgtctctactaaaaa

SEQ ID NO: 681586 - DNA, 221 bp, Homo sapiens
gggagtacggaatatttcactcagaggaagagctatgaatcatgctagactgctagcctgttgagggcaggcatactcctccatctgtgtagtattcagcatgggtcagaaggtaactcaagcgcagattgaaatttctgtggtggagaaggaggatgtgacctgggcactgtgtgtctgaaacccgtgtatacgtactatattacttatttctggtacaa

SEQ ID NO: 681587 - DNA, 296 bp, Homo sapiens
aatggttgggcgggaatagagggaagagatgatgtaggtatcaggagtagttcaagaggatgcagatgccatttgattttgcaaatatttaaatgaaaagtgtgttagcaaacggtgagaatttgttcagtctgagcattaatcttaatccactcattcttggtatttgacaggctgtgtaattgctctaaagcctattatcttccctagtagttggtgcagtgtcattaggatacctcaaatgaaaggctaaattctcctatatacacagttttacataattacagacttttttt

SEQ ID NO: 681588 - DNA, 1324 bp, Homo sapiens
  misc_feature (1)..(1): n is a, c, g, or t
nagtggtgctttggtggaactgcctggtgaagaacgggtgttgtttgttaagacaccagagtgacaaatacctgtgtgctgtaagaggaggcgccacaatgtttcgccagctgtctgagaagaggcggtgcgtgtgctcatgtccggcttgtttgtgtactcgcccgacaagggtgttgttgccccccaggaaacggtgagtatgtaatggtgctctgccccctaatagagagggcgtgtactattgtagtaaacgccacttcgtctgttcatcgtgggattattgctgtgtcaagaaccttgggggtttcccgctggggaaccacacaaagaaccacgtgtttttgtagggggggtgtttccccacatgatgtggaacgactttgtctacttccacgtgagtatggtatgcccgcataaggcagcaaagatttttcgctgcagaagagttcacgacagtaatgtgtcttgttcccacgccgacagcgcgagagcgttttcgtagcgggatataatatatagtggggtcatattataggggcaatgtgtagtattttcattagcgtgagcataatatatcgctgctagatattgtgtgtttttaaatatagggcgatagcgcaccgcgcccccactatctctagtgtggaaatttctctcgggtgatgtttaacgacccgcgtgatagatatatttggcgctctttatatgatatagcgaaaataagagagagagatatgccccacccaaaatatctcccccctgtgtgtgaaataaagggagagatttataagccgttctcgacactctttcttctcggggtgttcttcgagctctgtagcgaaaaaagagaggggagaaaaatatatgcgctccagaaacttcgatattggttcacgataaatgcacacataagtctgttacatgccacagaatatacacgagaaaaataccgcacacctcacgaggagaactcccatggagtcttcccggagggcactggcacctatacccccacggggacacacgagagtcacggcagtccccacaaacctctctcaagagggccacgcaccacaccctaacctgtcgaagccaattctcaagagtctcctcagtagtgtccaccccacaaaccccactccacgcacgttctcttcaccccaaggtacacaataatcctgggggcccactgagacttttaattttccccgaaatagtagaatgtacccaaggagtcacattagattgtttgtaaagaattttttttttaatccctaactggggacacaatttttagataaaatttaatcacccaaggtta

SEQ ID NO: 681589 - DNA, 314 bp, Homo sapiens
  misc_feature (145)..(145): n is a, c, g, or t
  misc_feature (252)..(252): n is a, c, g, or t
  misc_feature (267)..(267): n is a, c, g, or t
  misc_feature (284)..(284): n is a, c, g, or t
  misc_feature (298)..(298): n is a, c, g, or t
gttaatatacggacgccctttcctcttacaaaacaggcccccttctaactctcagctaggagaatacctcccaacagtctccctcatgagctatctcctctgccaacaagccgaccagggcctcccaaaaccccacgaaggggtnctccaatcccaaataggacttgctctccaattccaaaaggactcttttaaggcaggcagtggacactttcaaaaccattcgagggtttaggatcttccttcacttgncgaggaaggggcggnctgttgtatctttttangaagaagggagtgntggttttctattaact

SEQ ID NO: 681590 - DNA, 205 bp, Homo sapiens
cctggctctgaacttaggcaggagtttgagactagcctggcagcatggtgaaaccctgtctgtactaaaaatacagaaaattagccaggtgtggtgggggtacgcctgtagtcttagctaactcgggaggctgaggcatgagaatcgcttgaacccgggaggcttcttcacctaagttcagagcaggcctaagttcagagccagg

SEQ ID NO: 681591 - DNA, 105 bp, Homo sapiens
cggcacgaggggaagtgaggccccagccccacaacccctccccgcccacccctggtcccctgtccctggggctgtttgttaaaaaagagtaataaaagggtttta

SEQ ID NO: 681592 - DNA, 240 bp, Homo sapiens
  misc_feature (169)..(169): n is a, c, g, or t
gtacagcgatatgtacatgggtattcatgccatatatttgtagtggcaggaagttggtgacagcctgtgtgttccacatatcagtctgaatgtagataagtaaacatttgtagagtgctcactactacgcttttctacgtgctacacatatcaacactgccacacactngggagcttgaacacaacacgaaatttattctctatacacttctagtttaaacatcaaacgctagcagcagc

SEQ ID NO: 681593 - DNA, 80 bp, Homo sapiens
aagacagcagcatatatctctgcagcgttgaagatcggggggagacccagtacttcgggccaggcacgcggctcctggtg

SEQ ID NO: 681594 - DNA, 1067 bp, Homo sapiens
gtctctactaaaaatacaaaaattaaccaggcatggtggcgggtgcctgtagtctcaactactcaggaggctgaggcaggagaatcaaggaggtggaggttgcagtgagctgagatcgcaccactgcactccagcctgggtgacacagcaagactccatctatagaaaaaaaaaaaaaaaattccttgaagatctggtccattctgggaatctagaactatctgacgggactgagaaaaagccatccatccattccctgagctctgcagtgtccgctcctcacatgtccttgaggcatttcctggaggttgcttctctggagttgggggctgatgtaatgggtttttccgggctctacgggcttggctatttctaagaaaacacctttagcaagtaacagcctttgggccatgcatggtggctcacgcgtgtaatcccagcacttagggaggccaaggcgggcagatcacgaggtcacagagattgagaccatcctgggccaacattggtgaaaccccgtctctactaaagaataccacaaattagccgggtatgggggtaatgtgcttgccaatcctagctactcagaaaggctgaggcaggcagcaatggcgttgaacctggcaggccagaggttgcagtgagccaacgatcacgccaattggcactccagccttggatgacagagggagaactctgtgtctccacagatacacacaaaaataactaagataaaggtgccccagctttacggggattaacactcctcagggaatactgtgcacacacagcgagtagaagacgctctataaataccacagtctacgcgattactaatatggggagcccacccgcgcccgtgatcaaaagcggggcccgcggtgaagtgaacaaaaaccggttggtcccgagggctgacaccacattttaagagaaaaattaggccagcgcaaacttggctcatatttcacacttgggcatatagacagtcttttttacaatgcgcagtataccacttggatataccaccacatgtcgcagcgtggtgttaaagcgaagaagggtta

SEQ ID NO: 681595 - DNA, 815 bp, Homo sapiens
gtgtgagctgcttctcctgctccagcatgcaacagcaagctcaccctgaagaacaagtttgtggagttcgacatgaagcccgtgtgtaaggaggtgctacgacgaatgttccctgctgtgagctgaagacagcggcgtgaagaagctgtctggagctgacctcctcgcaatggcccatgccacaggggccatcaggactctgcaactcatggcgctggaagggcccctgcttatgtcgtcacgcttgaccatcatcgagacacccatacgcgaaccatatccgtgcgcctctactcacggcgtggtacgcacttgactatgggacacgcaccgtacagaatacctcacagtacacacaccctgctcgcacaccatactctgacaaatccctttaaacgcgacatacacaacattgtcaacttacagtctatacccctgccaatattggccacattatacatcaacacctactcacgttgcatcaacccacgtgcaaactcaatacatgtgacaccctaacccccaaccagttgataaatacatacacaataccatcaccattatgagacccccgcctggcggaccgcatatcctatggcttaccttaggatcgagacgcgcaacgtacggccaaacgcggcaacgcgaccctcgggccgccgcacaagcgctagcgtacatagatcccacttcaacttggaaccacccccccaccagcactaacgtgaacgcacaccccccacatttgctgatcaaacagccatggcatcgccactccccctatgaccactctaccctgcgcctccacccaacgc

SEQ ID NO: 681596 - DNA, 266 bp, Homo sapiens
tcagtctggagaatggtggaggcgagcaggggccggatgccatggttcgacgtgtggagggcgatgacgatagagagagtagatgagcatggctgtccacaggatgtccctgaccagtgcggcatccagggttcctcctcggactcacttagacgggtggaaaatcggcaccagcagtgttactcatgacggccaggattaaacgaactgctgctccagtaaatgacattttgctgtcacattcagtgtaatcacgggtctgagct

SEQ ID NO: 681597 - DNA, 265 bp, Homo sapiens
gttgagtgaaaggaagaaatactgtataccttcgtcttcattccattagtgtcagagactaataaccctttgccttgaaaattggactaacacttcattcattcctacactgttttccccagtccttgctctgctctctggcattgatagcttataactgcaaatcttgattctgccacccacctatctaccatccttcaatgtttccttggaattttcaagataaattttacactcctccataattaggtccctgcaaacatct

SEQ ID NO: 681598 - DNA, 846 bp, Homo sapiens
gctctcctcccatccagcctgctcggggcggaggggggtggggcagggttgtccctgcctctccgccacctccaccgggttatcccctggtggcgggtggcggggcgggggacagtagttgtagacgcccgccctgctcagagaagatcccacattgattgaacaaagactgaacttgtgtttacggataccttttataaaagatgtctgtggagtagtgttacagttcaaataacaacggatttgtgcattatgagatgagtgagagtgcagaatgggacaaaaatggattttgatctctgaatggtggtttaagctcaccagttatggtggtagtctcactattgtgaaaattcatgctgaaaaactgagtgaatatgatcagatttctccaccaaattctcagcctgataaggaaaatcccgtttgtgtcaacctaatgaagcattcaaagaagacatatgactctttcaagatgaccttgaaagattatattaaggtacagaaagcagaggttgagagcaagacttggttcagacacgatgacggggactattgggaaccctgtgggttaccacggagcggtaattccagacccacgtttagatgtttgcccagagaattcccatttgaaaccatcaagaactaccaagaatatggaatattcccaaacagtgaaaaatcggtgcctcagggtacagccttgaagagattggaaagacctctgggcacaggcagtcgccggatgtgtcccaaacacacgccttgacttatcaaacgcactttttggccccgggtcgcaaaagatacattcgaaaggaaacatacggcaagaatatgagacag

SEQ ID NO: 681599 - DNA, 194 bp, Homo sapiens
  misc_feature (153)..(153): n is a, c, g, or t
gtgtctatgctgaacgagcggttcacttgtttccccacagaaaaaggccaaaatttttggaggataatttaaaaactaagccaataaggccaggcatggtggctcatcgctttatcccagcactttgggaggccaaggcgggcagatcacctnaggtcaggagttcgagaccagcctggttcacatggcgaaat

SEQ ID NO: 681600 - DNA, 536 bp, Homo sapiens
  misc_feature (28)..(28): n is a, c, g, or t
  misc_feature (115)..(116): n is a, c, g, or t
  misc_feature (166)..(167): n is a, c, g, or t
  misc_feature (208)..(208): n is a, c, g, or t
  misc_feature (212)..(212): n is a, c, g, or t
  misc_feature (226)..(227): n is a, c, g, or t
  misc_feature (248)..(248): n is a, c, g, or t
  misc_feature (273)..(273): n is a, c, g, or t
  misc_feature (325)..(325): n is a, c, g, or t
  misc_feature (415)..(415): n is a, c, g, or t
ctcgggcctagcaacaaagtgcaagatnctgccccgtggagactcccagaggaagcccccactcaacacccgctcccaggctccgcttctccgatgggtccttacactcagcttnntggtggcgacagttgcatgtagggctttatgcaatgtgaatgcaggcatnntggcatcccagggccatgaactttgtccggtggaaggcctncttnctagagagggaatnnccttggctggcttccttaccngtgggcactgaaggctttcagggcntccagcctcatcactgtgtccctctctctggaaaggaggaaggagcctatgnatcttccccaacgaaaagcacatccaggcaatggctaaacttcagagggggcgaagggatcagcctgccttcagcatctcagttctgcanagagctggaagacacctaatgtggcagctgtctaacctcaaagccctgagtttcagtatcctgttgaacggcatacactttcccgtggccatgaattttacacaacctgaaagatgtgtgt

SEQ ID NO: 681601 - DNA, 225 bp, Homo sapiens
agtcacccgcgtacatcgcgatagcgtaaccggttccgaacggtagctgttgcggttgttgctcagcatgttgccgatcagcaagccggtcagcaggctgctggtggagaagcctgagccgccgccgctggcctgagcgttggccgcttgcgcattggcagcgtcgacctgggattgggtcacctggccttcggcggtcagttcgaaaccgcccaagcgcgggtg

SEQ ID NO: 681602 - DNA, 462 bp, Homo sapiens
ggcattaagacgggtgctcacgctgggcgcaggcgatgacgcgattcagatcgcgatttcgttggcggcgattaccttgctgacaaggaaggaatggttgaagcgcatggcatacaccgcaggcggtgtgagcgtggtgctcggcgggatggcatggttgcatatttgagagctggattttcatcgcccttcggaagcagaaatacggcgtcacgtatcgtcgtatttcgctgatagctatcaccaaaccaaaccgactataaaactcgccatcgctcgcaacctggaaagttgactattgatgggagaaaacgaattcagtcagtgcgtcccggatgccagaagccctgtaacgttgaacacctcactggatgattacttcgcggcagaatgccttcagatcttcgctcaagtggaggacctgtttctctaccagaccagtagcaccaaatacctgactga

SEQ ID NO: 681603 - DNA, 719 bp, Homo sapiens
  misc_feature (717)..(717): n is a, c, g, or t
cgcaaggtgaccatgcagaattatgccctagcataggttaacaaggtctaacacggtggaccttccgcataatgaatggacagcaaatagctatccagggggagccgctgctcacacccctgaagccgaactagctgcctaagaacagctaacggagcccgctgagatatgaggctcagttgaggcaagatagataggaagcggcgacgaacctacccagcctgccggtaggatgatggccacgatggtaccttagttgacatttcaaaggaaccacagaaccatctatatcctctagtgaagttaactggtagctctaagagcatcagctctatggacactatgcaaccacctcgcatagagagagagaaaatgaacacccataggaggcctaaaagcaggcatcaattaagaatgtgtgcacactcacacacactagctagataatgacatacataaagctgtactcttcacacccagttggaccaatctatcaccctatggaagatctaatgtatgtacaagtaaaaagaaaacattctactgcgcataagcctgcgtactagcactgctctgacattttaacagacaataattacaatgaacgcacatggtagtagtaccctcactggaggtgttgcccgggaccccaattcctcatatactgggtgctgtacaattcactggcacgagatttacacgcggggcggggccgtncg

SEQ ID NO: 681604 - DNA, 198 bp, Homo sapiens
tttccagaaaaggtcaagccattgtcctccagcctggaaaacaagagcgaaactctttttaaaaaaaaaaaaaaaaaccacacacacacacaacacattttttccacgcctgtaaccctagaacatggggaggccaaggtggggggtttgttggaggccaggagtccaaggttgaagtgatttttgtttgaacactgt

SEQ ID NO: 681605 - DNA, 674 bp, Homo sapiens
ttgctatttaatagcagacattctgatcaacgcatcatgttatcctaaatctcactgggttttgatacatgacattctggttccctacccccggaaaaacggttgatgcaggtccttatcctacctcatagaggtacatatacgaaaggaccggaagcgttataaaggtgactggagacttcacaccaactgtgcatgctgtggcaaaacttattgctctacttttgtcagtgagggtgcctatatggctgtcccactgcatttatgttcaggagacccacgactagactttcatgattttaaaaactcgcctgaagccaagctctgatctattgaccttaccttgagaccggaagaaaacactgattgctgtagctctcaaagcgcaagtcttattcttgtagtcttcctgatgttcagaacttacacgaaatttgggaatgccatcaacgggcctacaactaattctggccagcctgtggccatggggatctttcttggggctcccagggaaactcccaatctgaggcttttacggaagtaaccctagatatgcgcttgggggcaaacaaacacttggttttatgtcctaggccttttggtgctgcctggaaggtaaaagattctgaaaccccatcttccccggtgccttatttcctaaccacattggaatg

SEQ ID NO: 681606 - DNA, 131 bp, Homo sapiens
gaatggataatttaatgtgcttttagtaggcacaggggtcccaggccaggcctcattttcctttggcctttaaaagtcaaagattgtgtagccatgcccatcagtaaaaaaatttttgagccaacccttta

SEQ ID NO: 681607 - DNA, 404 bp, Homo sapiens
  misc_feature (22)..(22): n is a, c, g, or t
  misc_feature (28)..(28): n is a, c, g, or t
  misc_feature (30)..(30): n is a, c, g, or t
  misc_feature (41)..(41): n is a, c, g, or t
  misc_feature (142)..(142): n is a, c, g, or t
  misc_feature (182)..(182): n is a, c, g, or t
tgccaaggactctttcaagagncccagntnggagagcaggnggatcggggggtgggggggtgttctgagttggccctgtcatggccataatctgtccttcccccatccttcactccccctcttatccctggtggccccggantgagaacgtgactcatccagctccaggcacccagtttcanccttgccccacccctgccccgggcctctcatttgctgtttaccccccaggagcaggtgcacctgggtcacctcaccgcgggaaggagagatataaggctctagggcacagcctgactccacacccacagattgcccaaggccagcacaggggttggagctctctagaaaggtgaggcacttggggagcataaaacagctccaagtgggcccaccaccctgta

SEQ ID NO: 681608 - DNA, 133 bp, Homo sapiens
tcagtgacaatggtactgctactgccacctactgttagaggagcagaagtagacatgaagttgcaaggtcaccttttcaagctaaagcacactcgatagctatgtgcatttatttgtttgttttaggaaagga

SEQ ID NO: 681609 - DNA, 975 bp, Homo sapiens
  misc_feature (251)..(251): n is a, c, g, or t
  misc_feature (419)..(419): n is a, c, g, or t
attgcaagatcctggtcaccgcaggctgggaccactgccattcgcgtgttccactgctcggacgaatgcacgcccatctggaccgtgctggccttccacagcgccgctgttccaagctgctgttggcccgttcgaccagccgtatgtgcttttcgtggactgcgcgtggccccctcagaggtcatccagaccgggaatccagtcccctcgtgggtcgacctcgtacctccactgcgtcgatgcatgtccancccagactctctcgttcctcggggaggacctaggcatgcgcggacgaaggatggtgcggctatcgaggtcgctttaggtcattgaggcctgtggagaagcctcgaacggggctctctgtggagggaccagggctaaggtctgatggcacccaaaggcacctcatgtgnaaggtcaccgcagacgtgactcttgtcgatggcagcgcttggagctgagtgttcccctctgtttgctgtgcagctgcgctctatcacgagaacgcaaacgagttagaacggtgctccgagaggcgtctcaaagcgcaagaaggcccccatagagcactgtaccctgaaagagctctttgactacgcgagcaaccagttccggggatatggagtgcccctttgcttcggaacgtcctagcgcactggcattgcagggcgcttatttcataatcacacttaatcattcctgccccattttggccctcacgagaagttcacacacctaagacagcgttgactaaagtgggcccaagtgacgccacctattgcctcccacccaagctgatctggcgaaatcacctatactaggtacgcacgccataagattatccgagccacacgcagaggcaccggacacatggcagccgccactcggaggttcaagctattgcctgcgagttagcgttcgggacacccctcctccttatgtggcacgttcacccagaacgcaacctac

SEQ ID NO: 681610 - DNA, 853 bp, Homo sapiens
gtggcactgacgaggaaactactaatagtttctgtcggatagttcaagatgataagtaccgtaagaacgtactggatggaaaggataaaaccgtatggatggacgtagtgagtcgaccctgatgctcactggtagtggtcacaatgattgtcatctgatgggccatgcaattgattgattagtaatacgaacatagccattaacatctggacttagctataaagaccatgtggggtggaccacgtcttgcttagctgagaacgaaaacgagtgaggatcgactattataaggcagcagaaatactcttacaactatgatgtcgtaatacgataagtcagttagccatgtatctatctacggtaggccgaatgttcagttactctactcggttccatcgaagattcgtgacttcccatattgtgctcactgtaagattggcctaccttggtagatgtgtcttgattgggcctgtggaaatgctttcgtatgattgatttgtctaaaactaatatataaatatctagttagactatatatataattatggcaatgaatcatatataaacaaaaatgtattataagcaaatattaaaaaaaggcaggaatggttaattgacaattatacacatgaaggtctgtaaccatttttaaccatttatagtgcttatttgcaaaatttgtataacttaggaattatttcagagacaagtgtttttctatgtgtgacaggtgagtagttgccgcgtaatatcattggagtacattctttatagctgtatgtgaaattaagtactagcattatttaagtgtaccaaatagatttgagaaaaacaataaagaaattgcatgcct

SEQ ID NO: 681611 - DNA, 3746 bp, Homo sapiens
cccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggcagcaaaagcaagaaggctgagaacaggtctaggtccaaagagaaagcagaaggtggggacagctccaaggagaagaagaaagacaaggacgacaaggaggacgagaaagagaaggatgctgggaattttgaccagaataagctggaagaagaaatgagaaaacgaaaagaaagggttgaaaaatggcgagaagagcagcgtaaaaaggcgatggagaacataggggagctgaagaaggagatcgaggagatgaagcaggggaagaagtggagcctggaagatgacgacgatgatgaagatgaccctgccgaggctgagaaggaagggaatgaaatggaggacgaggagctggacccattagatgcctacatggaggaagtgaaagaagaggtaaaaaagtttaacatgaggagcgtgaaaggcggcgcaggaaatgagaagaagtccgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaaacttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccattagctgtcatcatgactcccactcgagaactggctttacagatacctaagggtgtaagaagtttcaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttcccaagagctatggaagcgttggcccgcaggatcttgagcaagcccattgaagttcaggttggaggccggagtgtggtttgctcagatgtggaacaacaagtgattgtgattgaagaagagaagaaattcttgaaattgctggagcttttaggccattatcaggagtcaggatctgtcattatatttgtggataagcaggaacacgctgatggtcttctgaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcggggactgcggtgcctcctgacctagagaaactatggagtgacttcaaagatcagcagaaagctgaaggaaaaataattaaaaagagcagcggcttctctggcaaggggttcaagtttgatgagacagagcaggctttagccaatgagaggaaaaagctacaaaaagctgcccttggcctgcaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatggaaaaa

SEQ ID NO: 681612 - DNA, 249 bp, Homo sapiens
aactactcgcgagccgcatgcatcataatgagaggcacgctgaccactacattcttcctaggaacaacatatgacgcactctcccctgagctctacacaacatattttgtcaccaagaccctactactaacctccctgttcttatgaattcaaacagcatacccccgcctccgctacgaccaactcatacacctgctatgaaaaaacttcctaccactcaccctagcattgctgatatgatatgtctcc

SEQ ID NO: 681613 - DNA, 466 bp, Homo sapiens
catcaaaatctggtgtcctattcatttgaaaaatcagatgtgggctaggtgcatggctcatgcctgtaatccgagcactttgggagcctggggcacaagagtccctcaagctcaggaggcagaagttgcagtgagccgagatcatgctactggaccccagcctgagagacagagagagaactctgtctaaaaaaaaaaaaaagaaagaagggaagaatatacctcccctcaacccaaaccattttctcactaccaacttctatcatagtctatggaattacctgaagttatcaagtaaattaatttctttggttagctactgttgtatccttcttccagagaggttcttttatatcttgccctaaccactgcttggcacatggtaggtacatatctgtatttaatgattaattgagctattctacctctaatatcttaaactctaggatcttgccctgtgatacct

SEQ ID NO: 681614 - DNA, 724 bp, Homo sapiens
aggagttgtgatgatagttggtgcatacatggtgtcctgtggtaactggccaaaagtggttgcatcggcctctaatgtatatgcatgtactaggtgggaggctagtgcgatattatgtaagagagggagggtatcaaacagtgagtacatgcttcatgctatgtttgccaggatgtcatgcaagtggagcaaatcttggtcaactttaacctcctatttccctggttcaagcaatacaccctgtcttagcctcccgagtagcgtgggattacaggcacgaaccaacacgcccagctagttttccgtataacacagtagagacggggttttcaccattgcatgcccagttgaaccacgttccgttgttaaagcaaggggctgtgaagaaggccacagtgaggtatgtgggtgtctcgtggtacgttcatgcggctacatagacctgcattaaatttcaagaccgggggggggatccctcttctggacgctttctctttaagggtctaccttcttacctgtttagaatgacacagatgaattatttacaataatcttgtgtccacagactgaaacaaaacaatacaccctaatcaaaacgtgggggacaaaatgtattggtttgtcctttcatcctgtctgggtatgtgggtgggatggtttcattcttcattaatgtttgttaatccttggtatttgaatactttattattaaatctggtgtcaa

SEQ ID NO: 681615 - DNA, 1093 bp, Homo sapiens
ccgctgtcgcaggctacggtcatggcagatgtcgctcttactgttcgagctccccgcccgtgtgtttgtcggtcgatgtctgtctttttgcgagtgctcttcttgggggtatgttgtactagtcttgctctttctgttgtctctgtttgctctttggcctggggtgctccgaggtgtcatcctgtcgttatggctctccccggggactttgcccgctgtttggagaggtcgggacaagttctctgtgttggctcagcgtctcttcttgcttccgtggcaatgtccaatctgttgcagacggtcccagactgtagtgcgaaaaataaggagggaaggaatatgactgaccatagtcccaggagaaagatttccgggacccttgcatctccgagaacctgatccaattctgtgccattggacgagcgttggcaccaactaccccaaggatatgtgtgatccgcatgtctggtctgaggactcctactatgaggccttagcccaggccccagaaaattgagatggaccaattggaaaaggcccaaaaggagcgaaccaaaattgagtttgtgaccgggcaccccaaaaaggcaccaccgacccacgccacgtccaccacccactagcccctgccacgcacacgctgttgcagaatgctcagaagaggaaagagcacagtgggattcggctattccccgtgaccaccgatatgccccgccccccatcctcacccccaccagccacccctgccacgctgttgtcccggtcaccccccagcgccacgcggctccaagacccaccgtcatttcttgctgtgtggcacccattgtgaagaaggcccagccagtgacctgaggggcccaccctaggacttgaaaggaccgtgcagccccagtgacccctgccccagtgggaggcgccacatttgtatatttcaggactgggacctactcccccagatgcccacctgagaggagcttcttgtttggcattcccagatggaaggaccaggccagcacgggagcccggcgctgtggaccgggtctgtccacgcaccacctggggtctgccgcctattaaaagtgccgtattctta

SEQ ID NO: 681616 - DNA, 1288 bp, Homo sapiens
  misc_feature (1087)..(1087): n is a, c, g, or t
  misc_feature (1105)..(1105): n is a, c, g, or t
  misc_feature (1221)..(1221): n is a, c, g, or t
  misc_feature (1223)..(1224): n is a, c, g, or t
  misc_feature (1226)..(1226): n is a, c, g, or t
  misc_feature (1229)..(1229): n is a, c, g, or t
  misc_feature (1231)..(1231): n is a, c, g, or t
  misc_feature (1234)..(1234): n is a, c, g, or t
  misc_feature (1242)..(1242): n is a, c, g, or t
  misc_feature (1244)..(1244): n is a, c, g, or t
  misc_feature (1246)..(1246): n is a, c, g, or t
  misc_feature (1249)..(1249): n is a, c, g, or t
  misc_feature (1251)..(1251): n is a, c, g, or t
  misc_feature (1259)..(1259): n is a, c, g, or t
  misc_feature (1262)..(1262): n is a, c, g, or t
gacctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaggtctcccgatgacccccagcaggtacatctcggcctgaaccagctggctgacctgtaccaagtcccttcattcacacggactacccagtggatgtctatcgacagatcccttgacaggatgactgggagctggcagaagttcacagccagntgcaggaatccaggtagngggggatgatctcacagcgaccaaccaaagaggatcgacaaggccggaaccgagaagtcctgcaatggctcctgctcaagtcaccagatgctccggaacgagttttcaggcgtgcnanngnccngncanggtggggngncnggngnccatcgcnggnagacggaatactaaggaccgtgtggg

SEQ ID NO: 681617 - DNA, 829 bp, Homo sapiens
tgtggtggctaacgcctgtaatcccagcatcttagggaggccgagcgggtggatcaactgtgggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaggaacaaggaaaaaaaaataggattatacctcttcctgtgttttcaagccgccatgaaatttctgaacactccaaatccagtggaataatccaaaagcaaaatttactaggtataaaacataatttgacttcttatagtaatagtattacttaaaaagcctcagggtatataatcttctaaagcagtacaattcagctgcagttaaattaaccaagtatgtctctagtagagaacagtaggcctattcacctgtgtgtagcctcagtgcctaacattgtggttgccgagataacattattccgtagaatttaccctgaaatttggtaaaacaccattcgtttttggttaccaattgcaaaatatttcaaaaggcccgtattttatgtaatctttgaaatagatattggaataaaatttcccaagattggaggggggggggattagaaaaaaggatcaatgaataaactcaatatgaggagttacccaaatcttccataacaataatgagaaattggtacaccaaaggtgagttagataaaaag

SEQ ID NO: 681618 - DNA, 888 bp, Homo sapiens
gacctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctgctacactgacaacgccttaatcctgggatcacca

SEQ ID NO: 681619 - DNA, 101 bp, Homo sapiens
gccctctcccctgccccagtccccaggggtactctggagtgagcagtgcccctgtgggacgcctgtaaatgcgggctcagtggaccactggtgactgggct

SEQ ID NO: 681620 - DNA, 89 bp, Homo sapiens
gcggccgcctactactactactactgctcgaattcaagcttctaacgatgtacggggacatgtgtataaaaataaaaaagatcccaaat

SEQ ID NO: 681621 - DNA, 1423 bp, Homo sapiens
  misc_feature (1222)..(1222): n is a, c, g, or t
  misc_feature (1240)..(1240): n is a, c, g, or t
  misc_feature (1356)..(1356): n is a, c, g, or t
  misc_feature (1358)..(1359): n is a, c, g, or t
  misc_feature (1361)..(1361): n is a, c, g, or t
  misc_feature (1364)..(1364): n is a, c, g, or t
  misc_feature (1366)..(1366): n is a, c, g, or t
  misc_feature (1369)..(1369): n is a, c, g, or t
  misc_feature (1377)..(1377): n is a, c, g, or t
  misc_feature (1379)..(1379): n is a, c, g, or t
  misc_feature (1381)..(1381): n is a, c, g, or t
  misc_feature (1384)..(1384): n is a, c, g, or t
  misc_feature (1386)..(1386): n is a, c, g, or t
  misc_feature (1394)..(1394): n is a, c, g, or t
  misc_feature (1397)..(1397): n is a, c, g, or t
agatcatctgtgcggtcattatgggtgagagtatcccacttaaatcgtactatcagttttgtagctagtgcgaggtgcttaaatgtacgtccagtctatctatagctcatcattgctgttacagccaggcttgcaggccatttggaacactgtgatccaggtctgtccccagcaccctcctggccagactggagagatgctttcttcttggcagctcggcttcggctcttagcaggtttactgttgttgtccatggatgcagctcttctcctaggagatttcccgctcttgccaccccctgggtctagccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaggtctcccgatgacccccagcaggtacatctcggcctgaaccagctggctgacctgtaccaagtcccttcattcacacggactacccagtggatgtctatcgacagatcccttgacaggatgactgggagctggcagaagttcacagccagntgcaggaatccaggtagngggggatgatctcacagcgaccaaccaaagaggatcgacaaggccggaaccgagaagtcctgcaatggctcctgctcaagtcaccagatgctccggaacgagttttcaggcgtgcnanngnccngncanggtggggngncnggngnccatcgcnggnagacggaatactaaggaccgtgtggg

SEQ ID NO: 681622 - DNA, 790 bp, Homo sapiens
  misc_feature (41)..(42): n is a, c, g, or t
  misc_feature (49)..(50): n is a, c, g, or t
  misc_feature (54)..(54): n is a, c, g, or t
  misc_feature (56)..(56): n is a, c, g, or t
  misc_feature (59)..(60): n is a, c, g, or t
  misc_feature (62)..(63): n is a, c, g, or t
  misc_feature (65)..(65): n is a, c, g, or t
  misc_feature (67)..(67): n is a, c, g, or t
  misc_feature (69)..(71): n is a, c, g, or t
  misc_feature (76)..(78): n is a, c, g, or t
  misc_feature (81)..(82): n is a, c, g, or t
  misc_feature (86)..(88): n is a, c, g, or t
  misc_feature (92)..(93): n is a, c, g, or t
  misc_feature (103)..(103): n is a, c, g, or t
  misc_feature (105)..(107): n is a, c, g, or t
  misc_feature (110)..(115): n is a, c, g, or t
  misc_feature (120)..(120): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (132)..(132): n is a, c, g, or t
  misc_feature (134)..(136): n is a, c, g, or t
  misc_feature (138)..(139): n is a, c, g, or t
  misc_feature (143)..(145): n is a, c, g, or t
  misc_feature (150)..(151): n is a, c, g, or t
  misc_feature (156)..(159): n is a, c, g, or t
  misc_feature (161)..(161): n is a, c, g, or t
  misc_feature (164)..(165): n is a, c, g, or t
  misc_feature (167)..(167): n is a, c, g, or t
  misc_feature (173)..(174): n is a, c, g, or t
  misc_feature (176)..(177): n is a, c, g, or t
  misc_feature (183)..(183): n is a, c, g, or t
  misc_feature (187)..(187): n is a, c, g, or t
  misc_feature (192)..(192): n is a, c, g, or t
  misc_feature (194)..(197): n is a, c, g, or t
  misc_feature (199)..(199): n is a, c, g, or t
  misc_feature (202)..(202): n is a, c, g, or t
  misc_feature (204)..(204): n is a, c, g, or t
  misc_feature (206)..(208): n is a, c, g, or t
  misc_feature (211)..(211): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (232)..(232): n is a, c, g, or t
  misc_feature (234)..(234): n is a, c, g, or t
  misc_feature (237)..(238): n is a, c, g, or t
  misc_feature (242)..(242): n is a, c, g, or t
  misc_feature (253)..(253): n is a, c, g, or t
  misc_feature (261)..(262): n is a, c, g, or t
  misc_feature (265)..(265): n is a, c, g, or t
  misc_feature (270)..(270): n is a, c, g, or t
  misc_feature (273)..(273): n is a, c, g, or t
  misc_feature (288)..(288): n is a, c, g, or t
  misc_feature (294)..(294): n is a, c, g, or t
  misc_feature (299)..(299): n is a, c, g, or t
  misc_feature (302)..(302): n is a, c, g, or t
  misc_feature (318)..(320): n is a, c, g, or t
  misc_feature (327)..(327): n is a, c, g, or t
  misc_feature (332)..(333): n is a, c, g, or t
  misc_feature (335)..(335): n is a, c, g, or t
  misc_feature (339)..(339): n is a, c, g, or t
  misc_feature (347)..(349): n is a, c, g, or t
  misc_feature (357)..(359): n is a, c, g, or t
  misc_feature (363)..(363): n is a, c, g, or t
  misc_feature (369)..(369): n is a, c, g, or t
  misc_feature (375)..(375): n is a, c, g, or t
  misc_feature (378)..(378): n is a, c, g, or t
  misc_feature (382)..(382): n is a, c, g, or t
  misc_feature (394)..(395): n is a, c, g, or t
  misc_feature (398)..(399): n is a, c, g, or t
  misc_feature (404)..(404): n is a, c, g, or t
  misc_feature (406)..(406): n is a, c, g, or t
  misc_feature (416)..(417): n is a, c, g, or t
  misc_feature (420)..(420): n is a, c, g, or t
  misc_feature (427)..(427): n is a, c, g, or t
  misc_feature (433)..(433): n is a, c, g, or t
  misc_feature (526)..(526): n is a, c, g, or t
  misc_feature (537)..(537): n is a, c, g, or t
  misc_feature (562)..(562): n is a, c, g, or t
  misc_feature (579)..(579): n is a, c, g, or t
  misc_feature (639)..(639): n is a, c, g, or t
  misc_feature (648)..(648): n is a, c, g, or t
  misc_feature (653)..(653): n is a, c, g, or t
  misc_feature (686)..(686): n is a, c, g, or t
  misc_feature (690)..(690): n is a, c, g, or t
  misc_feature (700)..(700): n is a, c, g, or t
  misc_feature (731)..(731): n is a, c, g, or t
  misc_feature (742)..(743): n is a, c, g, or t
  misc_feature (745)..(745): n is a, c, g, or t
  misc_feature (761)..(761): n is a, c, g, or t
  misc_feature (767)..(767): n is a, c, g, or t
  misc_feature (773)..(773): n is a, c, g, or t
gccgcccacctgcccggatctcctggctctcatccctgganngggaagnnaaananaannanngngnannnaaaannnaannaaannnaaanngaaaaagaanannnaannnnnngaaanangnaanagaanannngnnaaannnaaaannaaaannnnanaannanagagtnnannaaacancccngagancnnnnanccncncnnnacncgacccnccngaagnggccancnccnncgangaggacaacgnggaccgcnnccngacgnagnccacccgtgagcgtngtgacngtccncancaacccagagcccaannncgtagtnaagtnnanaaanaaagtaannnaacgtgtnnngcancgtccncaggtngcncaangcgcgtcccaanngtnngtcantncacaccaacnnaanaaacgtngtcgtnaaaagtaaaaaaagtgtacgtagtcaaaaaacgtaaaaaaaagtcaaacgtccacaagtccgcaaacaacagtcaacaaacgcgtaagtagtngtcgtaaacancagcaaaaaaaaaaaaaaaaacaancgcagcaaaccgcgcanaaaaacgcacccaagtaagtagcccccgcaagtaagtagcaaacaaaagtaagggtcagnaagtgcagnggtcncgttcaaaaagcgcgcaagtaagtgtagtagtncaancgcaaacaancagcgcaaacgcagcaagcaagcagtgcaancgccccccaannancgcagcgcaagcaagnaaagtncgcagncgcaaagtaaagtaagt

SEQ ID NO: 681623 - DNA, 1448 bp, Homo sapiens
  misc_feature (486)..(486): n is a, c, g, or t
  misc_feature (493)..(493): n is a, c, g, or t
  misc_feature (495)..(496): n is a, c, g, or t
  misc_feature (502)..(502): n is a, c, g, or t
  misc_feature (526)..(526): n is a, c, g, or t
  misc_feature (1247)..(1247): n is a, c, g, or t
  misc_feature (1265)..(1265): n is a, c, g, or t
  misc_feature (1381)..(1381): n is a, c, g, or t
  misc_feature (1383)..(1384): n is a, c, g, or t
  misc_feature (1386)..(1386): n is a, c, g, or t
  misc_feature (1389)..(1389): n is a, c, g, or t
  misc_feature (1391)..(1391): n is a, c, g, or t
  misc_feature (1394)..(1394): n is a, c, g, or t
  misc_feature (1402)..(1402): n is a, c, g, or t
  misc_feature (1404)..(1404): n is a, c, g, or t
  misc_feature (1406)..(1406): n is a, c, g, or t
  misc_feature (1409)..(1409): n is a, c, g, or t
  misc_feature (1411)..(1411): n is a, c, g, or t
  misc_feature (1419)..(1419): n is a, c, g, or t
  misc_feature (1422)..(1422): n is a, c, g, or t
agatcatctgtgcggtcattatgggtgagagtatcccacttaaatcgtactatcagttttgtagctagtgcgaggtgcttaaatgtacgtccagtctatctatagctcatcattgctgttacagccaggcttgcaggccatttggaacactgtgatccaggtctgtccccagcaccctcctggccagactggagagatgctttcttcttggcagctcggcttcggctcttagcaggtttactgttgttgtccatggatgcagctcttctcctaggagatttcccgctcttgccaccccctgggtctagccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaaagggctgntttgaangnncacaanttcaaattaaaaaccttatttggncgcccttgctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaggtctcccgatgacccccagcaggtacatctcggcctgaaccagctggctgacctgtaccaagtcccttcattcacacggactacccagtggatgtctatcgacagatcccttgacaggatgactgggagctggcagaagttcacagccagntgcaggaatccaggtagngggggatgatctcacagcgaccaaccaaagaggatcgacaaggccggaaccgagaagtcctgcaatggctcctgctcaagtcaccagatgctccggaacgagttttcaggcgtgcnanngnccngncanggtggggngncnggngnccatcgcnggnagacggaatactaaggaccgtgtggg

SEQ ID NO: 681624 - DNA, 755 bp, Homo sapiens
  misc_feature (11)..(11): n is a, c, g, or t
  misc_feature (22)..(22): n is a, c, g, or t
  misc_feature (41)..(41): n is a, c, g, or t
  misc_feature (54)..(54): n is a, c, g, or t
  misc_feature (82)..(82): n is a, c, g, or t
  misc_feature (202)..(202): n is a, c, g, or t
  misc_feature (211)..(211): n is a, c, g, or t
  misc_feature (242)..(242): n is a, c, g, or t
  misc_feature (246)..(246): n is a, c, g, or t
  misc_feature (272)..(272): n is a, c, g, or t
  misc_feature (276)..(276): n is a, c, g, or t
  misc_feature (336)..(336): n is a, c, g, or t
  misc_feature (416)..(416): n is a, c, g, or t
  misc_feature (420)..(420): n is a, c, g, or t
  misc_feature (617)..(617): n is a, c, g, or t
  misc_feature (625)..(625): n is a, c, g, or t
  misc_feature (637)..(637): n is a, c, g, or t
  misc_feature (743)..(743): n is a, c, g, or t
actaccccctncttcctccccngctgcgggccaccctccgngggccggcggcgntcgccgggcccgcgggcgccggacgtgncttccccccccccggacctgccccctctcgtctcccctcttttccgccctgtgggccccccgaccctttttcttccgccggggcgggagcccctagttcccacactgaggacgcgtgacntggtgggcnccggaaaggaggggacttctcctgccccccnagangtggtggggagattgctgcccctatngccntatctcggccccttcccactccccccccccccccccggtgctgggggtcccttatttttntgccctacctgagcttgatgggggtgggcagggggcccgttgagccccgccccccgccccgctctgccgatcctgccccnagangctggggtggtgggggcagtaattcctgcccccctctctgccctagggatgggcacgggggcgctggtgaggtcccactggaccctcccgggtgctagggggccgggaggggacaccccctccccgcctttacctcacttccactgctgccttgatctctgtctgggaggggggagtgaaggggccctaaccacctncactccgncgcctcagaganatgcggttaattcctgacttagtttatttttgcaaaacgtcgatctcctcctcccccgccccgcatccgcgaaggcttttaatgggaggggcgtcaaagctcaaanctgtattcctct

SEQ ID NO: 681625 - DNA, 467 bp, Homo sapiens
  misc_feature (52)..(52): n is a, c, g, or t
gaccggatggcgacattccaaaattatggtgatcagactgccattcaacgtngtgataatccaagcccaggcacagaacacatttaagaaaacatttggggctgggcacagtggctcacgcctgtaatcccagtacttggggaggccgaggcgggcagatcatgaggtcaggagttccagaccagcctggccaacatggtgaaacccagtctctactaaaaatacaaaaattagccgggcatggtggtgtgcgcctataatcccagatactcaggaggctgaggcagcagaatcacttgaacatgagacgtggaggttgcagtgagccaagattgcactactgcactccagcctgggtgtcagagtaagactctgtctaaagagagaaagaaagaaaagaaaagaaaagagaaaagaactgagtcccaagctctgcttgtggaaaccagtttctgctgaagtgtttg

SEQ ID NO: 681626 - DNA, 840 bp, Homo sapiens
gacctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccgacctctttttttcttttcttttttttgagacaaagtctcactgtgtcacccagactggaatgcagtgacacaatctcggctcactgaaacctctgccttccagaaccccatgatg

SEQ ID NO: 681627 - DNA, 1289 bp, Homo sapiens
  misc_feature (1088)..(1088): n is a, c, g, or t
  misc_feature (1106)..(1106): n is a, c, g, or t
  misc_feature (1222)..(1222): n is a, c, g, or t
  misc_feature (1224)..(1225): n is a, c, g, or t
  misc_feature (1227)..(1227): n is a, c, g, or t
  misc_feature (1230)..(1230): n is a, c, g, or t
  misc_feature (1232)..(1232): n is a, c, g, or t
  misc_feature (1235)..(1235): n is a, c, g, or t
  misc_feature (1243)..(1243): n is a, c, g, or t
  misc_feature (1245)..(1245): n is a, c, g, or t
  misc_feature (1247)..(1247): n is a, c, g, or t
  misc_feature (1250)..(1250): n is a, c, g, or t
  misc_feature (1252)..(1252): n is a, c, g, or t
  misc_feature (1260)..(1260): n is a, c, g, or t
  misc_feature (1263)..(1263): n is a, c, g, or t
gacctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaaccgccttgctgagcgtgtcccttgccgtctgctgagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaggtctcccgatgacccccagcaggtacatctcggcctgaaccagctggctgacctgtaccaagtcccttcattcacacggactacccagtggatgtctatcgacagatcccttgacaggatgactgggagctggcagaagttcacagccagntgcaggaatccaggtagngggggatgatctcacagcgaccaaccaaagaggatcgacaaggccggaaccgagaagtcctgcaatggctcctgctcaagtcaccagatgctccggaacgagttttcaggcgtgcnanngnccngncanggtggggngncnggngnccatcgcnggnagacggaatactaaggaccgtgtggg

SEQ ID NO: 681628 - DNA, 281 bp, Homo sapiens
tttaatattggtgatggggtggaagagaactgattgattgaacccagcattatttcttgctagatagacagattaacaatgttgaagatatggtccacattattaataacactttggattgcactgatgtagcccagggaggggatagcatcgaacagagattgaacatagttgtatttgatgccagatctactattgtgtctttatttaggagctgacgactgatgggctgctacctctttggcctgccggtgggagtaatgagcatgatgtgctatggg

SEQ ID NO: 681629 - DNA, 200 bp, Homo sapiens
caacaaaagaaagcgccagagctatcatatctgactcttgtgactctttcaactatatttcatcatttataaaatatgggaagtgatagcagcttaccagagggtactaggagaatggatgtgcatgtgcatgcagcttaatgcctgagtatagtgataaacactaaggaaacgccgatgcattgcatcacggtctctca

SEQ ID NO: 681630 - DNA, 507 bp, Homo sapiens
taccttgcagtcggagaagtgaaggtgcagtgagccgtgactgcgccactgcactccagcgttggcaacagcatgagaccggggggttaaaaataaatagatatgccaggcccggtggctcacgcctgtaatcccagcacttcgggaaggtaaggcgggtggatcacgaggtcaggagttcgagaccagtctggccaacatgaagaaacctcagtctctactaaaaatacaaggattagccgggcgtggtggcaggcatctgtaatcccagctacttggaaggctgacgcaggaaaatcatttgaaactggaagacagagggttcagtgagccaagattacgccactacagtccagcctgggtgaccacaggagactgtctcaaaaaaaaaaaaacaaaaagggttcctaccaggtctaccggaatccggtctaatgtgggccccttttggatagaccaatttttttaaataatatggtgggacagaagcaataaatgtccaaattt

SEQ ID NO: 681631 - DNA, 684 bp, Homo sapiens
gagctccttcttaaaggccagaatgaccctgaggacgctgtttgaagttagctttcctgtcacagtatactaacatggttgaacctgccagcgtccattgtagcaacatgggaaatcaactttccggagcatgttaatctcacctctcccaaaagattttgtaactcatcctagtggctcattattcagagcagggtttatgccatcaaacatgatatgtgccttcaacgaacagtcagcactggggtgtccacaagaacgctcatgaggtccatcgtgtgagacaggcaaaaccatgcctaggtcacatctcgaaaatgtattccccctgtggtaaatgtggcacttgcacttcaaagagtgttagcatgaatgcatcacatttttttaccgcagtcaaagcgtgggatttcaaaatgtactacgcaatcaaatttgcaccccttcatagtttcttcgtctcacacagtcagttaataaggtagggataaaatcttacctgctacggagtcttgagatactgttaaaaagatgagattatgtaatatgtatataacacttttcaaaggaactgttttccattgacaagcaataatgtagccatagattttgcagctaggaaccttcgcgccccaaaaattattatgcattgtggatgacaatgaatgcaacttgttgtgtatt

SEQ ID NO: 681632 - DNA, 178 bp, Homo sapiens
catctctacgtatgcctcggaaaactcatctctcctctgtgcaaatttctaaattctggctctgtagatgaaatacacctctgatttttgacacaaaagggctttgatcaaagaaacatcttgtgattctgtggactctgtgagacccgagcattctgaggcagcaggtattctcgag

SEQ ID NO: 681633 - DNA, 282 bp, Homo sapiens
tctgtatactgattgtgtatccgtgacacttagctcgaagtatatcagttgaaggagctttgggtctgagactatgggtttatgagagtatagaattaagtcatctgcaaagagacgtagttagacttccctcttcctatttgaataccctttatttctctctcttacctgactgccctggccaggacttccagtactatgttgaataggagtggtgggagacagcatgggtgtcttgtgtcagttttcaaagggaatgtttccagcttttggttatttcag

SEQ ID NO: 681634 - DNA, 227 bp, Homo sapiens
cccctttccccaaaccccccccgccttgaaatgtttttgctttcccgtttacttttggccccccccctaaattttaaatgggttttttggaaaaaccggtttgggccatgttttttttttgggaggaaagaggccggctgtgggggggctggggaggggataggttccccccttggttcccccgctttagaattttaccccaaaaaaaaaccctgttttttagggga

SEQ ID NO: 681635 - DNA, 772 bp, Homo sapiens
tgggtccttgaatatgtatttttactgaaaaaatcatccataaattaacatacaaaaatgtccaaacacttgattaaataatgtaatgacaaaggactattttggtgaaaagtgtttttaaaacatcttaagaattccagtgtgcaaaaatgtgtacccctgtgcacctcttttaaaacgtaagagcaagctcaaaaacacgttaggtgagtggaaataagctagctacgctcaatgtgccatcgtcaaggggtgagtgttggatacaactcaactccagtggttggtctccgtgctcagctataaagtgtcgtggtggtagaggatctcgtgacacagcaggcacctatttatgttcaaaatgagtattctggcaaataccccccacaccccccaaaacagcatgaacaaagcggggacacctttcccttgcacacagcaatcaaagacaacattagggggccacccatcagtagcctgaagattttcagctaccaatatatgcacagggtcacattgggtcctgtatgggtttttcttgtttaaactatgacaaattccacactattaacagcaacaggggcctgggctggtacgtatttaaactcatgaccttttcccccatatgattatccaaggccgggtggacccctatgactggacatgtgccacatcccacaagtattctactctccatacaggacacagaatttggccccgaaggggttcacaacgtgaccccaattttaacgcagcgaaaaaacgaacttcg

SEQ ID NO: 681636 - DNA, 646 bp, Homo sapiens
gggcaggggctccctcaggcccctgattcccagcccacagctctttctactctgcagacagagttcctcgtgagactggccctgcattcaggcagggtagcagaggggtccctgcctgcagcacccagagctgaacctgaagctacaaagatgggctgatgaggtggcccatgaggtgtcagcaacatctccgaacccccgtgggtctcccctagttgagtcagggcacgtgatttgcatatagctggagctacatgcaccgtcgtcctcgcccgtcgagccaccttttaggggagaaaggagggcagatttgtaacctcgtggttctcgtgcatgggatcctgggcgtggaagaaagttcgataccatggatgattgccttttagaactccagacttatgtccaagcagtcgattcaccaaagcgatttgggttaggctgtagagagaaaagctggatatgagaaaataggaatgttggatcgtgagggataaaaacaatcgaaggtgtggaagtgcctgggtgtgtggagtgtaactgtgggagaactcggttgtgtcggagaggttggaggtgaatgaagtgcgatgtcgggtcatgagagggtcggtttacgcggcgggttcacagccagttctgtcgtgcc

SEQ ID NO: 681637 - DNA, 215 bp, Homo sapiens
cggacgcatcggcatttattttctcacagttctggaggctggaagtctaagatcaaggcgtcagcaggggcagtttcttctgagagctatgagggaagatccgttccagtcctctccccttggcttatagatggctgccttcttgttgtgccttacatggtcttccctttgtgtgtacaaccctgatgtctctctgagtatccacatttcttctt

SEQ ID NO: 681638 - DNA, 415 bp, Homo sapiens
gtgatatatatacgtcaataaacgacccatcacagctcttacccacctaggaacagcacatctcctcacagttatgaaaactggaaaacttggcaggatgcggtggctcacgcctgtaatcccagcactttgggaggccgaggtgggtggatcacgaggtcaggagatcgagaccatcctggctaacacggtgaaaccccgttctactaaaaaatacaaaaaattagccggacgtggtggtgggcacctgtaatcccagctatttgagacactgaggcaggggaatcgcttgagcctaggagtgcaagaccagtctgggcattacagtgagacgctgtctctacaaataataaaataaaatagctgggcatagtggttcatgcctgtagtccttgctacttgggaggctgaagca

SEQ ID NO: 681639 - DNA, 185 bp, Homo sapiens
cgctcgactcaagagttatccccacagttcagtgatctattagggcattgtttatgtgttggtttctctctcccctcccttggtcttaattcttacattctgccaacactctgcaaatacacacttgcgaagggccagagaagcccagcccttgctgcgggccaagctgcgagggtaccgagctc

SEQ ID NO: 681640 - DNA, 410 bp, Homo sapiens
  misc_feature (162)..(162): n is a, c, g, or t
  misc_feature (168)..(168): n is a, c, g, or t
  misc_feature (170)..(170): n is a, c, g, or t
  misc_feature (179)..(179): n is a, c, g, or t
  misc_feature (216)..(216): n is a, c, g, or t
gattacagaaacgtccaggtacatctcctttgcaagatagccatggtgaagggcaacttcagtaacaaaagaactaccaccatctttgctacagaagtgtttaataaacatcataatagatttggagaaagaacacacactccacccatgccactaccttcntactcncnagggatacnagacagcaaagaatttctgtctcctacaggacaactncaggggattaaaaaaacagtaactgccagctgggagggatagaattaaagaccacatatagtgtttttaatctagtcacttgccacaaggagaaatatatttaggatatacaataaataattcaaatgcttaaaataattgaatgaacggaagagtagacttgaccaaatttacattcgttgggcgtacgggga

SEQ ID NO: 681641 - DNA, 918 bp, Homo sapiens
atctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataacagaaaatgtggtacatatacaccatggaatactgtgcagtgcagccattacagcttttggtgatacagtgaactcagatttttcattaattcttttaactggttattactgaaacgttgacaaaaagtaatgttggtattgaaatcttgagtctggccaatgttctatcttacattcctaaagaattctaaaagaggattccaagaatgtcataaatggatggtttctccatggatgaaggaatggtttattcacttgctgataattccagcctaaaccagttgagatcatattgaa

SEQ ID NO: 681642 - DNA, 134 bp, Homo sapiens
tccgtgacatctcgtgtctcacttgacgaagtgtaggctcaggaaagatccacattaagttctgtgctatctagcctggctgctgctccactggctacatcgctgggcactgcctttgggttttattgagcgtg

SEQ ID NO: 681643 - DNA, 171 bp, Homo sapiens
tacaactaccactacagatttattaaaatggctaaaaatgagaaaaacagaaaacaaaactataccacaagctggtgtggatgcagagtaacagtaactaatacattcctgctaggaatgcaaaatggttttggaccacagtttggcactttcttatagacttaaacatgt

SEQ ID NO: 681644 - DNA, 237 bp, Homo sapiens
tagtgacgtctcatcatattactctatcatactacacagtcaaacactcagaagcaggaaacacataaatgagatagggcacatgaagcctgacacaatgactcctccagatctgaaagaataacaatagaacatcaaatgggatgagtaattagcagtgtccaggaccagagcattaaagttttagcaaagaaaacacttgctcaaagtcaggaagggtaggtatgatgaaggacg

SEQ ID NO: 681645 - DNA, 776 bp, Homo sapiens
tccactttataaaccagccagttaattatttggtagtaagattaaaaacttttaccaggcagacggaaatatctgtgtcagcatgaacagtacattttcttcctagaaggcagttacatggaaaaccaggttattatcagggttatttagcaaggttttgggaatccaaacaagaggagactaatcttaagacctataactcgtccatgaagggctgggggcacacttttctaccaccagaatgccttagcttccagaaagctgtgggactcttccctctccgtctgggtctgggctgagtaccgtacggctcagtcacttcctgagccataccgtcaggccagttgggcctaaaagctggttatctctgggtcacgggttggtggtggtcacagccactggctactaacagttaagggttctgaaggggggcatgtcaattggctcccaggtaccaactaggagacacaataatcctataagtttggttctcccaaacccatctccagtttatcaggtaatatgctctgtaaggttctttccaaccccattaggcacattactatagattacctataaatttcacctaaggtaatactacccttcctaagtgaaggatggaggtttccaacgcttggtgttttttcccccccatttttctggatcaggtgtttctcaccccatgtgggatttatgaaacaaaaaatttctaacatcaccctagaatactttattggatggttcccataccattaaatttcaggattcccttaatt

SEQ ID NO: 681646 - DNA, 977 bp, Homo sapiens
agcggggtccgctccgacgcgcgcccgtccggggctccatccacagcaactgttagccttcattagtcagcttttcctcctcttaccctgcacttcccagaaccaaacgaatgtgaagggggtccatggagggctcgacgtccccggcgccccgcagcggtcacttagcgccgctcgccgccggcctttcgacggtcgacgcgtggatctgctagcgagtactccgacgggccagccgtgatggcgcacgcggtcgctcgggatggggagctggttgacgcctggtcttgagagtccgtgcgacggcagaatcggcgcgttcccgcgtgccctgttgtgcgggaagctgcttccgagttcaatctctatccttgctttgccacctgcgggcgcacccgggagcccaggcctttccagtgccgctcactggggacactcgcgcggggcagcgggctctgctgagctcggacctgcgcacactagccaggccgagacgcccacgtaggtcctgtcgtgcacgcactgattgctggagtcggaatgagcacggcgctactacgctgagggccgatggggagagcccgaagctcagggggcatgcagggcacagccccctggtcggacttgaggggtcctggcgcggcccccatgtgcgtccttccagttccgtgccggccttcgcgttgcctccttacgtggccagtacgcaagttgtcgcagcttcgtgctggagcttgctaaacggccagcttgcccatcttgcgagtagggccctggagaagatgcggccccggtgccaagagtgcgggctccaagaccacgcgagggaaaggaagcaatgaatgaacccaaaggacatagagaggcgcacggggggcccccgagacagtacccaggacaggcaacacactcgggaggaggatccgagctaaactcagcacagcgtccaaacccaagtcggagacaaaagaagccca

SEQ ID NO: 681647 - DNA, 206 bp, Homo sapiens
ccactgctccgtcccagggcattgtcttcagggagtaggagggaaaagaaacggaaataactaggaagaacaagaaatggatttccaggggacaggacaggagcggggccagtagacttacacgaggtcgtgaagttgacagacgactcaggtagtgtgttgagtcagggaatggttgtcctcatgtacatggcatgggtaccgag

SEQ ID NO: 681648 - DNA, 245 bp, Homo sapiens
  misc_feature (5)..(5): n is a, c, g, or t
gtcanttttattttatttttggcttttaaagggaagccggaacagttcactaggttaagaaaggaaaggaaagaagaacagaaaaaacaaaagtttatcagttcccagcagcaaggcaaaaccaccccagtgtgcacctctccctgtgccgtggttctgctgatgtgcccagaactcgtgtttggcgtggctacacggaacacaccgtggttgcaagttttggcaggttgcccattgtggcacac

SEQ ID NO: 681649 - DNA, 161 bp, Homo sapiens
aagtgctgggccctgggtctaccccacgacccctctgcctctccccaggctgtgagctccccgaggacgacgccccctctgcttacaccacctgcaggcgctccagccccggcactggaaggccttggccaccgacacagcagcctcatctctggctggat

SEQ ID NO: 681650 - DNA, 232 bp, Homo sapiens
  misc_feature (69)..(69): n is a, c, g, or t
tgaggctcattttgcagttgttgaaattgtccccgcagttttcaatcatgtctgaaccaatcagagtcnttgtgactggagcagtggtcaattcatattcactgctgtacagtattggagatggatctgtctttgggtaaaggtcagcctatcgttctgtgctgtggagatcaccccatgatgggtgtctggacggtgtctaatggacctgcagactgtgccttcccctcct

SEQ ID NO: 681651 - DNA, 274 bp, Homo sapiens
ggagggtctgactctctcatggcggttagaaactcagctatacacagatctgtcgtgcctcctctgcggcgccaggagtccctcagatgcatgaagaagctggcttgcgaagatcaggactgttagtaagccggttctccaagtgttccccagctcagagattcgcgtagtatctcaaagcccggtgaacgttggcattccttggagagactttagaggaccatccggcgctagaggactcttgatatatggctcaaggattgaggatggcaca

SEQ ID NO: 681652 - DNA, 693 bp, Homo sapiens
tggtgaggaatcgtggtggtgctggtgtgcacagggtttgtgtgggcagcccacaataaagacgtccttcgccggatgaagaagcgctaccccacgatgtgcgtatatgtgtggtcatgttagtgctgcagcgtattctccttatctccatgttccggaggagtcatggatcttctgtgctttgggcattcactttatccttctgctgtagatgtctatccatgcatcgtgtgagacttcggaacctcaagaacaatagctggagaataaaactggaaggaatacgtctgcagaggacaccgatgggcattgtcctggatgccctataacagcaggaagaaggcatcacacagactcactgactatagtcacgcaaagtgaacggaataagatataagttatctgatgcatagaggttgcagcagaaattgagttgcagcttgcccttgtccagacctattttctgcttgcgttaattgaaaacaggaggtgcacagtaccatgccaattatctatgggcaggcatgcatgtattggcccgaagtatttatcagctctgattgtctccagagagaagacctcagaaaccgaaagaaagccaccgcctcctaatgtgtctgaagttcacgtgtgtttattggaaccctcactgggactggttccccgattccttacggggaattatcgcccttg

SEQ ID NO: 681653 - DNA, 155 bp, Homo sapiens
  misc_feature (69)..(69): n is a, c, g, or t
  misc_feature (102)..(103): n is a, c, g, or t
tgaggctcattttgcagttgttgaaattgtccccgcagttttcaatcatgtctgaaccaatcagagtcnttgtgactggagcagtggtcaattcatattcgnncagcctataattcttgtgctgttggtatcacccctaggccctggacggtctc

SEQ ID NO: 681654 - DNA, 174 bp, Homo sapiens
ctggctccactggtgagctggatgatggtgccaggaggcgaacgtctcgtcctgggcaaaggtgatgttggcatggtcatgcaggccaaagatctcaggcatatcatggagtgggaggctcttgatgtaggagaggtagccggtggaggtcgataggtagagcgggatcgtggt

SEQ ID NO: 681655 - DNA, 330 bp, Homo sapiens
gtactgactacgccgctaggccactcccaaattcctggccggaagaaactacatgatataataaatgccccccccccccaatgatcgcccttttttgccgagtctggactgtactgccgtgatctcggctcactgcaacctgcctgcctggggctcccatgattctcctgcctcggcctaccgagggcctgggattccaggcacgtgccaccactcctgactggtttttgtatttttgggggaaacggactttcgccgcgttgaccggcctggtctccagctcctggcctcgggtgatctgcctgccggggcctcccgaggtgctgggat

SEQ ID NO: 681656 - DNA, 501 bp, Homo sapiens
  misc_feature (165)..(165): n is a, c, g, or t
  misc_feature (268)..(268): n is a, c, g, or t
  misc_feature (301)..(301): n is a, c, g, or t
  misc_feature (350)..(350): n is a, c, g, or t
  misc_feature (431)..(431): n is a, c, g, or t
  misc_feature (489)..(489): n is a, c, g, or t
gaattaacccaaatgcccatcaatgatagactggatagagaaaatgtgatatccctacaccatggaatactatgcagccataaaaagaaacatagttacatcctttgcagggacatgaatggagctggaaggcattttcctcagcaaactaatgtagaaacaganaaacaaacaccacatgttcccacttataagtgggagctgaacaatgagaacacctggacacgaggggaacaacatacactggagcttgttggggaggggcgangcaagagattgagggggattgggatagcagtangaaaaatagtgcatgctggggttaatacctaggtgatggattgataagngcggcaaaccattcactgtgggcacatgttttcctatggtaacaaaccttcacatcctgccacaggtaccccagaacttanaaccaaaaaacaatagtgttaatatggtatatttcctccatagtttccatatgattcntagtaggttctt

SEQ ID NO: 681657 - DNA, 230 bp, Homo sapiens
taaggatccctcccttccaccagcactttcattaacagatcttcatcccagtactagcctattatggggtatcatcattcttacgggcggccccacagggaacctatttgctacaccggggccagcttgtcagtactacctagagagctgccttggattccaaatgctactttgcatggcctagctcaatattgttcctacttcctagcagggtcatccttcaggattga

SEQ ID NO: 681658 - DNA, 235 bp, Homo sapiens
  misc_feature (3)..(3): n is a, c, g, or t
gtngatctagaggatccgatttggcgaggcagtctcgagtagctgggattacaggcacgcgccccatgcctggctaatttttttgtatttttagtagagacagggtttctccatgttggtcaggtggtctcgaactcccgagctcatgtgatctgcccgccttgtgctcccaaagtgctgggattactgcgtgagccaccatgcctggcctgtgttcttttactataaatttttg

SEQ ID NO: 681659 - DNA, 208 bp, Homo sapiens
ctcaggtcagatgcagccttctcgagcaaaggccgaccaaggaaaactcactaccatgagaattgcagtgatttgctattgcctccataggcatcaccgtgtgccatacctagttaaacatggctgattcgtggaagttctagaggaagagcagctttacaaccaaatacccagtatgctgtggccacatggcgtaaagccctgaccc

SEQ ID NO: 681660 - DNA, 104 bp, Homo sapiens
tcgctatcatcggcaccctatagattcgcaggctctatgatattaccaaatattccttttctggctttagacaaagctggcttctatggtttaaaactaagaag

SEQ ID NO: 681661 - DNA, 391 bp, Homo sapiens
gctcgcacccacagttgctgatgggagcggctgctatgaaggcttctgacatggcctggagacattttccccatggtcttagaggctaacactaggttccgtgctacttatgcaaatttctgcagctgccttgaatttcttctcaaaaaaatggtctttttctttagtactgcgtcttttcttctgccagataccctaaattatctctctcaagttcaaagttccacaaattcctagggcaggggcaaaatgctgccagtctttttgccaaaacataacaagagtcacctttgcttcagttcccaacaagttcctcatctccatctgagaccacctcagcctggaccttattgttcatatcactaacagcatttttgtcaaagccattcag

SEQ ID NO: 681662 - DNA, 170 bp, Homo sapiens
gccaaagctaagaccttgaaaccagacgagctacctaagaacagctaaaagagcacattttctatgtagcaaaatagtaggaagatttataggtagaggcgacaaacctcccgagcttggtgatagctagttgtccaagtagaatcttagttcaactttaattggccctg

SEQ ID NO: 681663 - DNA, 897 bp, Homo sapiens
agagtcgcgctcgccgatgggaatgtgctcaccacttgaaaatgttgtgcacatgtaacccccgatatgtgcggctacccgggagctgttcctcccaaccggggatgtccaaaactaatggtgttggagaacacatatccctgggcagatatactcggaatatctgcactctcgactagtgggcccaagttccctctctcgaaccgcaagtttactcttcgcggtaatacggtgtgtacaacacgttatactgcgcccccacgttcaaacacattcggcggcattcacaaaaaaaacagctggcctcccccgtacccgccccaatactttcttagggagtggtcaaagaaccaggaggtagtgcacggaccggtttgccaaaatttcggcccccctctcacaggctccggaaaataatgtcgcaccccccagtgcaccactcgcactttcagctgtccacgcccacggatgcacactatttatcttcttctcgccaagcgctttatgatacttctaccgtcaaattattggagggaacagtgtactccctttaggtacaagaaaagcatatgggcacacatcgtgcgtgtggcgccgggaagccggctccggatagagttcaagtccacgaggtccccccacttacagggctccgacagctaccacaacccaaaggttgtagaacaatggttagtacaagtagtcgcaccgtacaccacccgagtggctattagagacaacatttataacactcgccttggctcccattctcatgagggtccctcacccggaaggataaatttttttgttggagatcgttaatagtctgctacgaaacaagtttctttttaaaaggcaaacaaaacaaaagaataacgaaatttcaaccccaaaaca

SEQ ID NO: 681664 - DNA, 429 bp, Homo sapiens
  misc_feature (185)..(185): n is a, c, g, or t
  misc_feature (307)..(307): n is a, c, g, or t
  misc_feature (309)..(309): n is a, c, g, or t
  misc_feature (316)..(316): n is a, c, g, or t
  misc_feature (320)..(320): n is a, c, g, or t
  misc_feature (334)..(334): n is a, c, g, or t
  misc_feature (345)..(345): n is a, c, g, or t
tcttaaacatataaaccccacaggcctgtatacttcaaaaatatcactgtcggccaggcgcgtggctcacacctgtaatcccagcactttgggaggccgaggtgggcaaatcctttaggtcaggagtttgagaccagcctgggcaacataaaattaactttagttttttttgtctctaaaagaanatttaaaaacaaaataaaaaaccactaattccctatatacctcctttcccctgacctcttgcaacctccattctttcactccagcctgggcaacagagcaagactctacctcaaaaaagaananagaaaanaaanaagaacagtctttncaatacccaantcacttcattaaaaataaagacggcaagataatcacttggattgcccaggagccccaactactttatggagctcactgtaggat

SEQ ID NO: 681665 - DNA, 154 bp, Homo sapiens
ctcgtctgtataatgctcgaggtttgcgtcaccggccccggggcacgccctatgaactcaaggacccgctgtggcaaagccgcgtcgaggtactgcgcggcgccaacggtatatgaccaggacgccctggccctgggtggctcggtcaactatg

SEQ ID NO: 681666 - DNA, 504 bp, Homo sapiens
  misc_feature (119)..(119): n is a, c, g, or t
  misc_feature (121)..(121): n is a, c, g, or t
  misc_feature (137)..(137): n is a, c, g, or t
  misc_feature (331)..(331): n is a, c, g, or t
aagagggtggtggcaagggggggtcccccaaaaagaaccccctgtcctttgggcaggagttaaccccgtcccccccttggtggagaacaaaaaagctcagtgggtggtgattgcccccnangtggatcccatcgagngggtggtttttttgcccgccctgggtggtaaaaagggggtccctttctgcattatcaagggaaaggcaagattggggggtttggtccccaggaaacccggcccccctgtggccttcacccaggggaactgggaaaacaaaggggctttggttaagtgggtggaagctatcgggccccatttccatgcacaattnaatgagatcccccggtcctggggggggcaatgtttggggtcctaagtttgggggtgggttcgccagggttgaaagggcaaggggtaaagaacttgcccctaaacgggggtaaagggccccgggggggtttttgggacataaaaaaaattgaaaaaaaacaaattttcccccca

SEQ ID NO: 681667 - DNA, 225 bp, Homo sapiens
gcgtgctgcggaggccccccggaccgccacccactttaccactgaccgacggccggcgaccatgcgacgcgccggagacggaaccccggaccgccgccactttcccactggaacgacggcacggcgaccactgcgacgatgctgacggacggacacccatggaccgccacctactttcacactggaacgacggcacggcgacaactgcgacgtgctgacggggga

SEQ ID NO: 681668 - DNA, 255 bp, Homo sapiens
cgccggatacactgcacatccacctcttggactctaagcggattctcctactcagcctcccaagtagctggaattacaggcccccgccatcacatccagctaatttttatatttttagtagatatggggtttcgccatgttggccaggctaggtctcgaactcctgacctcaggtgatctgcctgccttggcctcccacagtgctgggattccaggcgtgcgccggcacagccagcctgttgcagtgtgcttccg

SEQ ID NO: 681669 - DNA, 244 bp, Homo sapiens
ccccccccccgggggggggccccccccccctttttttttttgggttttcccctttttttaaaaggggaatttttccccccttttttcccccctaaaaaaggtgtttttttttttttggggggggggggggggggggggggggggggatttttttttttcccccccccttaaaaaaaggggtttttttccccgggttgggggggccccctaaacccccctttccccgggtgttctttttttttta

SEQ ID NO: 681670 - DNA, 337 bp, Homo sapiens
cgtgtctccagcacttcagtgaggctgaggtgggcggatcacctgaagttgggagttcgagaccagcctgaccaacatggagaaactccatctctactaaaaatataaaattagccaggcacggtggcacatgcctataatcccagctacttgggaggctgaggcaggagaatcgcttgaacccagaaggcggaggttgtggtgagctgagatcacacctttgcacgccagcctgggtaacaagagcaaaactccatctcaaaaacaaaaaaaggcttctgcaatgacttctaagagttagaaacaggttttgagaggatacgtggcttgctccaag

SEQ ID NO: 681671 - DNA, 146 bp, Homo sapiens
cttctgcattctgaactgtatgctccacgagagacatgtctgtgttagtgtacactgtctcgcggagtctagcgatagtgcctggtacctagcaggaactcgaatacatatttgttgacataatatgaatgcaataggagggtcga

SEQ ID NO: 681672 - DNA, 1702 bp, Homo sapiens
  misc_feature (202)..(202): n is a, c, g, or t
  misc_feature (319)..(319): n is a, c, g, or t
aaacaggggggtgtaggacaccagcgaggcactctgtggaaagaagtagctacacgtcccgtggcgggggggacacctctgcgcagcgcaacaccagcaaggaagagggaagtggtatgacccagcagagctgccgcaggggggagcacagacaggagaaaaggaggggcgccgccgcacacaagcccgtggtgcggggacngacacagagaggctgttgccggcgccaactaactactactccggtgggggggacaaacaagggcagccccccacctcgacggggggccgcagacacgaggcgcgatcacgctgtcgnctgcgggggtgtgtgcgcacagagaagaaagaggcggcggggtagagacgaccaagcgtgctcctcgtcgtgggggggacaacaaccaggtgagtaccctcattggagggcgagctacgccgctgtcgagcagcaggagagtgttcccttccgctgcggccctcgcccccggcgagataagtggttggcgccccccccacgaggaggagagaaagctcccttaaaagaggttggggggagagggaacgcccctcctcgggcgcggaaagatagtgccacccgagtccacgagcggtgcaacccaccagtgggggcgccaacatatggagctacagacagctctgcgtgagagtaagaaggaaggacccacaaagacgacgtcaggtggccgcagcacatggttggtgcggccccacccccccagcggggaaggggggcgcacacacacccacggcgggtgttgttgtcccaccccccccgaggaggggggcgccaataactatggtcaaagagaagaagaggaggctggcgggcgcctcacaacaggtgagactattctccacgagaggagcgtccgactagtggcgctcgcgcgcgctgctcatcaaagaaccacctcccgcgcggagtatgagagagggcgcaacacacaccccggggggcctcccccccgcgggagagggagtaccccgcacgtggtggggccacacaccgacggagtatctctctacacccccgctggtgtgtgtgtgtctcaacacactttctttgctcgctccgcgctggtctcgaacagcactgtggtgtgtgtgtgtgcgcagagagagattatctctcagcgcagagagtgtgtgtgtgcgacacaccacacaggcgggtgtgttctccacactcctctccgacacacagatggctgcgacgcgcgcacacacactctctcacagagcgcctcacactctctcacacacagcggcgcgcacagagcgcgcacacaccgcgcgcccgctggtggggataacacacccacccgaggagcgcccacagagcgggactgtttcccacacaagtgtgtgtgtgagagagtgtgagcgccccgccacctgtgcgcgccctcttgtgggagagcccgacagagagattccgggccacccggagaggcgcccggagatctccccgcacgagaaggagcagaaagagaggagcacacaacccgggtccgcgcgggagatatttttctccacctttcacacagcgaggcacaccttgggcccgccctttctcctgcccacagccccccggcgcaccctgccacgcccccccgcccccgggtggggtcacaagggttttgtgtgtgaaaaaaaggcccttttttttttttcccca

SEQ ID NO: 681673 - DNA, 90 bp, Homo sapiens
ggatttgctggtgcagtacaactaggcttaatagggacatgggtatgacataggccaaggcccaactaacagtcaagaaacaaaaaaaaa

SEQ ID NO: 681674 - DNA, 207 bp, Homo sapiens
  misc_feature (68)..(68): n is a, c, g, or t
  misc_feature (94)..(95): n is a, c, g, or t
cgaggaaaaccgtgtactattagccatggtcaaccccaccgtgtcttcgacattgccgtcgacggcgnagcccttgggccgcgtcttcctttgnnagctgtttgcagacaaggttcccaaagacagcagcaaaattttcgtgctctgagcactgggagagaaaggatttgcgttattaacgggttccctgggcttttcacaggaaat

SEQ ID NO: 681675 - DNA, 174 bp, Homo sapiens
gacaggattccacccgaaggctaccacacaacaagcacagctggcggcagcagctgaaatcgatgaagaaccagtcagtacatgcaaaacagagtcgcgagctgacacaagaaggcacggaaggctatgtccacaactgggtcttcggcagcgttacaggcagttactacgagt

SEQ ID NO: 681676 - DNA, 185 bp, Homo sapiens
aaaagaaagaaagaaagaaagggaagggaatttataaggtcaagttaccagttttgaggttttgtgtttttttttggacctccttcaagtgagaaaataaaaaaaaatggtgccaaagctgtccagatagagataatagaagccaaagagattaaaaggaaataaaaaggcatgattaaaaacta

SEQ ID NO: 681677 - DNA, 524 bp, Homo sapiens
  misc_feature (488)..(488): n is a, c, g, or t
gaggcttggtgggggagggcagggcaggtggacggaatgtcgttctttgactcctttttacaatttgtcttgtagagatcaaaatatgccactccaaaacatgccactttggcatacaattatttcagattcaacagatgcagaaagaagccatctcagagcttcccttatctcatgagaagcagaaacttctgagaaatgaggactgctgtaaatctcctcttctagggaagttttatggccacagagaagatgaagttggcgccaagatggatctgcacaaacaaaccttactccattaatttccctcatatatttactttcccatggtttactgcctttgggagcctaagatttttttttttttttgacttgtcacttctctacgaatttattgttctttgttaagatgcataaacccacattctaaccacctctttgagtttttcatcatatcactgagtttctcctgggtacacgcccactgnacatgctaataaactatttgtttttcccttgttaaa

SEQ ID NO: 681678 - DNA, 213 bp, Homo sapiens
  misc_feature (32)..(32): n is a, c, g, or t
  misc_feature (65)..(65): n is a, c, g, or t
  misc_feature (97)..(97): n is a, c, g, or t
  misc_feature (101)..(101): n is a, c, g, or t
  misc_feature (175)..(175): n is a, c, g, or t
  misc_feature (181)..(181): n is a, c, g, or t
gaggacaccgccaaggaggatgcggccaaccncaagctgggccaagtctgacaaggtctccaatnggttgcagggaccattgtccgtttccctcgtnggtnatggagaaccccttcccccagggggcctgaagtaagaggctgcttcatcctggcccatggcaaagatgggaaantctttntttggaaaggcaagcaggcaaacacggaggag

SEQ ID NO: 681679 - DNA, 492 bp, Homo sapiens
  misc_feature (7)..(7): n is a, c, g, or t
  misc_feature (38)..(38): n is a, c, g, or t
atagacncccgttgctactgattccgatagtatcgtcngcgcgcccttgcgcaagacttcgcaaggagcacttatggccgggggaccaattgaaaccagcgtttttcagaaggaaaccaacgggagcaattgagagattattggagagaatgcccgggacccccaggaagcgaagaacaacactaccacactagaagccacagggaacgcaaacgagttcgcaactaacctgcctaccacagaagtcaacgctatcagagggttacaccggacaacagcccacggcagttgcgaacgcgggacgggtgaacggcgaccagcggacttaacagatgaaaactcggaatacacgcagggcctggatggaccctgttgccgggacgcggcatcgtgatgctcccaacattccccgtagctcctccgacatccgccttgtggactagccgcggtgctacggatcaagggcaaggcccacggtcagccgcattagat

SEQ ID NO: 681680 - DNA, 221 bp, Homo sapiens
tgagacaaggtctggctcttatcacccacgctggaggacagtggcacgatctcagctcaccgcaacctccgcctcctgggctcaagccgttctcccagctcagtctcctgagtagctgggactacaggtatgcaccaccatgcacgaagccttttggtcttttttttttcttttttttttggaaacggagtcaccctcttgtctacaagctggtgtgcagt

SEQ ID NO: 681681 - DNA, 541 bp, Homo sapiens
cctctcccaacccccccccccttttttcctcttctcttcccctcaatcacttgtgcctccttctcaaaaaaaaaaaaaattcttcctcccttttcctccttctttttaatactttccttctatttttctccctttaaatttctcctccccccaactcttttaactcttttttttttttttgcccctctccttttcctcacatccccctctttttattctcctcgtatttcccccggtctaattctttactcctggcctttcctctatatttatatcttcccttctttttttccttattccccctcctctcttcatttctactatacacttactttttcttttttcatttcccccccctcctcttctcgttctattctttctattttccttctctttccaaactatttacctctttttacctccccctaatcttcccttctttactacattaattttaactcttctctccttttctgcctctcctcctcctatttctttttgtccctccctttccctctttctatgccacctacttttttcc

SEQ ID NO: 681682 - DNA, 805 bp, Homo sapiens
  misc_feature (135)..(135): n is a, c, g, or t
  misc_feature (430)..(430): n is a, c, g, or t
  misc_feature (453)..(453): n is a, c, g, or t
  misc_feature (602)..(602): n is a, c, g, or t
  misc_feature (617)..(617): n is a, c, g, or t
tgaggtgtctctgtggggcgttaacatcgggggtgtgcggcttcgccactttgcattttgtcggccatggacctttaggatttctgcggcctcttgaattctggtatcctcgccgcatcggtgactgtcctgtcncggaggcgctggttcacagcgcgagaccgctgcttaccgacaaggatcggcttcggaccgggaaggctcgccgggatgacatagccgctgtgcagctctggccaaggatgaactatacgaggcatagcgatgtactccgtcgaacatcggtatcgcgccaccttagctgtacacgggtcactgtagagagccttgaaacgtctctgtgccaacttgcgcttggggacaaggcgtgtgttatcgactagcgagtgggcaagtggattgcggaggcgcacaaccatagaaaggctgncttcgagttggcggatcgttggntgttgaagaatttgaggaggcccgtgtaaaggggccgcccaggctttgtgttggccgcgcaaacatcttggggtgcttggcccattccctttgtgttactccgctaaaaactatccactaggatagggtgcgtctaggacggagaattncttgctagaacccantcgcgagggcgcagcgaccattagagccccttgcttcgttatcctaccatggtctgaggaccttggggacgctaggctacagactctagtcttcttgacgattcgccacaggtaggtcgatccaccaagggaccgttccctctggagtcacgctggtgtatcgcatgggtcatccatgcgccagtgtg

SEQ ID NO: 681683 - DNA, 371 bp, Homo sapiens
  misc_feature (25)..(25): n is a, c, g, or t
cttgttaaagggttttattccaacnacattcccctggagtgggggaaccattgggcgccggggaaaaaattcaaaacccccccccccctgttggggtcccgggggtccttttttcttttcaacaaactccccgtgggcaaaaaaaggtgggcccagggggaggttttttttttttcccttatggatgagggtttgccccaccccctccccccaaaaaaacctttcccctttttcggggtaattagttgggcgggcggccaacccccccttccccggcttttggggttggggggggaagttttgggcggtccccgtgttcattttttccgggggccccgcattgaaattaaaccccccccccttcccttgga

SEQ ID NO: 681684 - DNA, 556 bp, Homo sapiens
atgtcaaacaatccaaagagatgaggcttggtgacctcgtcgaagcagcactcctgcggcaatagttgtcgcacctttggtgaagtatgatgatctcagtatctgattcgcagtacaccttcatccgatcagatggcctgcaaactatgaccgaggggagtaactgacgaacgtcttggattggataagaacgaccgcctgcacaaacatcgtcaccaccagcacaggcgtcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtacaagtcatcgaaaaagggaaacacccaaaagttacaaacagtggacagccaacacggagatcaggagccccacaggaagtgtctg

SEQ ID NO: 681685 - DNA, 172 bp, Homo sapiens
gtcgccgctgttctcctacagtatgacatcattttaactttactaattatgttgcacatcactatttccaaataaggtcacattctgaggttcctggactgatgtggatttttttttttttttttttttttttttttttttttttttttttttttttttttttttttttggg

SEQ ID NO: 681686 - DNA, 213 bp, Homo sapiens
  misc_feature (176)..(176): n is a, c, g, or t
  misc_feature (206)..(206): n is a, c, g, or t
cgacgtaggacgactggactctaacctggttaccagacgctccctctgaactaacgtgacaccgacacgacaatgacctgttattaccaactgtgccaaggaccggagacataccggagactgacagaccatacagctacgacaacagaaaacactgaccaacactggttccctgncaactcgtggagactgttaacgtaccctgngagactg

SEQ ID NO: 681687 - DNA, 538 bp, Homo sapiens
gcttcctcaggtaaacaccgtatcctacttaatccctctgaccgtacagcctttaatctcgtcctctacggccggcgtagtactcgtcctggtagagattctccaaaatttaagccggggcattctaccgatctcggcatgctcacctttgctcggagaagcttccggtctctttcgattctcttctaagttttcacgggatttttattcccgaactatacagccggatcgcccttaactcgccaccgctggacgtccacgcccggaacaaagtttcgacttaatgtccatcgttagttcacgagaaggacacctcaagctcgaaatttatcaaaagacgcgtggtcaacaaacgggtcaggtcctttatataagacggactccacagtattaaaccggggcattacgaacttcctctcgaggaggagattctattcataattttagcggtcccgttgtaagattaccgtagccggaaactcaacaccccgcttccagtcattcttttaaaaataaaatcctcgtcacggaaaacggt

SEQ ID NO: 681688 - DNA, 221 bp, Homo sapiens
catgctgtaccagtcgaaaggcacatatatccacacatgcacacacagcacacacacaaacgcacagcacacacaaacgcacagcacacacgcacacacagcacacacacgagcacacagcacacaaacgcacagcaacaacgcacacacatgcacacacagcacacacactagcacacagcacacacacaaagacacagtacacatggaatgcacacaca

SEQ ID NO: 681689 - DNA, 244 bp, Homo sapiens
agaggtataagctctccataataataaagagcacgttaataagttaaacaagttaaacattgtaaaaaactgaagctggacagcaatgtaatcccagcacttcggaaggccccagctggaggatcactgtgaacctaggagttcaagagcagcctgggccacacaggcgaagcccatctctacaaaaaaaattttttttaactagccaggtcaggtgtcatgtctgtaggatcttggactcgtg

SEQ ID NO: 681690 - DNA, 106 bp, Homo sapiens
taaatatacataatggaatgctactcatccggagaataaagaacaaaattaatgccatttggagcaacatggatggaactagagactctcatactacattgcaaca

SEQ ID NO: 681691 - DNA, 1005 bp, Homo sapiens
gggccgctgacatgttgagtgactacgcgcggaccagtgcctggtgccccccgctgctccagtgccgcgctgggccttggtgctgggctggtgtggcactgtgcctgcgggccgtgtgctgtgcgagctggtggtgcgctgtggctgggtgcctggcttgcagcccactgggcctgggagactgtggtgtgcagtgtgtacaacatgctcaccgtggaggaaggaacccctaatcgtggcgcactgccgaagcctgcctcctggtatagctgtggaccaactgtatatgatcatgcgcaccttggccatgcttgctcatatgttagatttgatatcattcgaaggatcctaaccaaggttttttggatgcagcaatagtcatggtgatgggtattacagatgtcgatgcatcacatcatcaaaagcgccacatgagatgcaatatttaccccacgaattgccatcgaccagacgttaaatgagggaagaccttccacgcatggcacatggaaagaccctgaacggttctaccgcaacacaaaggaggtaacctgagaggttaaacccgagacaacttattaccttccagactccacttttacatcttcacttgaccggggagctccattctgccctccgttgcggcaaccagcattaatatcaacagggcaaacacgggccaccggtcatacatatcgcactccttgaacgtcctaagaagctacgaccaaccctattgcgggacattgcggtcggccaattaggtcaccctaggggatccccacgtcacgcgcagacagccaacgtagggcgcatacttggaccacagccgtcatttgggcacaggtggactttccggccgcatgattcgggaagtgtcgtggccaaaaccccaacgaaacgtagttctgggcacaccttccacttgggggaccccaggcgaatcgaccgggggttaggacacttcgacgtcgcctctagcagtccgcacagaatggatgcgga

SEQ ID NO: 681692 - DNA, 243 bp, Homo sapiens
tactgatctgcagtgatctaagatcccgacggtatgtgtggtcttctcacgatactgtgaaaggtagtccttgtgttcattcgggcttgtctgtatatttctaacgtggaaaaccccggctcatctcaaacatgaggactcccagcgcccaccagtccacgctgaacccgtactcctctccccgcaggatttcgggggcgatgtaattcggggttccgcagaaagtgctcgttgtgtcaccag

SEQ ID NO: 681693 - DNA, 286 bp, Homo sapiens
tgccctgtcacacctgtacaccacaccttcatgctgcagggtctccctcctcaagaagagggtggagtttctttcccagagccagctcagtttctccctgagcctgattctgtacctggtgaatgctttgctggttgtcaatgtcttcacagactcagcctgccctcctcatctgagctggcaccctttacgtttaattactcaaacctctttcttttattcctagtgttgagtgaatgctcatggctgagggtaagtccggggaacaccatacctaaagaatctg

SEQ ID NO: 681694 - DNA, 491 bp, Homo sapiens
ggttgtcaggcagcgctgagcagtaatgtgtcctactcacctgctgtttatccagcaccagacctcttctaagaactttacctgtttcagctcactgaatcctcacaacacccattgtacagaagaggaaactgaggcagcgagtggttaagtgacttctccgaggttacacagctaggaaatggtggcaacagtaagagcccacgaagagctgcggttggtagttcattctggacagccctcccgtgaaccgtccctgtactggcacttgttgctggggactgtcgctgtcctctccctccccgggccaggtgtgtcctggagggcagggaagcgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccg

SEQ ID NO: 681695 - DNA, 1125 bp, Homo sapiens
  misc_feature (505)..(505): n is a, c, g, or t
  misc_feature (520)..(520): n is a, c, g, or t
ggttatgtgccgctgtggctgctcgtgttgaatctagaaccgtatccagacatgggactggcaggactgagcaaaatgatgcttaccgaatccggagatcctgaggaggaggaagaggagataggaggaattattggatcccctaacaacagtgagagagcgatgcgagcagtctggagaaatgtgtaatagggccctgggagcggttagagctctagtgatgagcgtgtatccgtctctggatcacagtacagaagaggattgcacggtaggagctctttgaagttcttgcatgcgagggaccattgcagtggcccacaaactctttaacaacttgaaataaatgtgtggacttaattcaccccgagtcttcatcatctgggcatcagaatatttccttatggttttggatgtaccattgtgtttcttatttgtgataagctagtaagttcatcatgaagcatcgatgggtttggcttaggctggtagcttctatgtaattcgnaatgattccatctanataaaagttctatgatctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaacagaaaaaaaataaaaaaaaaaaaaaaaagcaaaagaaccaccggacacaaatattacaaaaaaagccacaacacagcacatgatatcaccaagaatacgatgaaataacactagagcaagccagagaatgacgtggaccacaaacatagaagtcatcgcagtcacctttaacgaaaagccaggatccctagtagctatacactacagggctacgtggtttgataacaccatgagagacagacctagtagttctataagaaattgcaaccgatgatacacagacaatcagaatacctgctatatatctaatgtgtgctagactagttaataagtaagaataaaacataagagctaagtagtcataattcgattacttaatataagtaatataagacaatagaaggatataaatcaaatagtatactacaacatctcgttgcaacagatacaa

SEQ ID NO: 681696 - DNA, 453 bp, Homo sapiens
atgccgtctctgcgagatttccagacacggccacatctcaccttctccgtgctactgcccggacccagctacctcctctctctggcatttattccacgggcttcctccccgccccctgggcatctacccttgcccttccctcttccccgatccacccatctgtcctcagcgtggcagccagagagattttttaaaaaattcaagtcagccgggcgcggcggctcacgccggtaatcccagcacttggggaggccaaggcgggcggatcacgaggtcaggagatcgagaccatcctggctaacacagtgaaaccccgtctctactaaacatacacaaaactagctgggtgtggtggctggcaccggtagtcccagctacacgggaggctgaggcaggagaatggcctgaatccgggaggcggagcgtgcagcgagccaggatcacaccacggca

SEQ ID NO: 681697 - DNA, 261 bp, Homo sapiens
tgctcgcatcactgcacagcgatctcagctcaaaacataccctttggcgacacccttctcaagtcaatgcgcagcactacagtctaggtctggccgtcttcaacaaccaccttgcaatagcagtggtgcactctgctgcaaacctgtgagtggaactctagcttccttccattcctgccttgcagaaactggtatccctcctttgctgagcttgtgagtgggatcctgactttcttctccaccctatagtagaagcagcaa

SEQ ID NO: 681698 - DNA, 311 bp, Homo sapiens
atgggaaaggagttgtggccaaaatccccatttttttgcccctcaacgtttgtgggtcagggctggggtggcagagggaggccttccccttatatttgtgttgttatccagggctccagatttcctcctttgcctgcccccttgccccctttcccccttatttttttccttttgggctccccagcccagttttggttttttgtcccctcctggggtcatccctcccctttgactttgattatggcaccagaaccccagggcctggcccagtggttttcatggtgttctttaaaaaaaaaaattcgcaccca

SEQ ID NO: 681699 - DNA, 105 bp, Homo sapiens
tataatataaggagatctgtagggagataagtatagagaggtagagttgttaacgtgatagtggtacactggataagtggcgttggcttgccatgactagtgaga

SEQ ID NO: 681700 - DNA, 138 bp, Homo sapiens
  misc_feature (105)..(105): n is a, c, g, or t
ggcggctgagctcatattctctccctggttctactgactcgtagttggtaacttgtaatctgaatctctcttcttctgaaaaacattagataatgaaaagagatngccaggcaaccttatgaaagacgaaatagcatc

SEQ ID NO: 681701 - DNA, 126 bp, Homo sapiens
tcgaccgtggtattttataggttgaggcgtcaaacctaccgagcctggtgatagctggttgtccaaaatagaatcttacgttcaactgtaaatttgcccacatcaaccctttaaatccccggtcga

SEQ ID NO: 681702 - DNA, 985 bp, Homo sapiens
ggaggtgagtgagcgggcgaatggagagagaggcgtgtcatagtatactacttcaccggcttgcttgtagtgcgtacatgaccatggttatcggtgtgaatccggaggagtatcaggaaacatactgggcgcggatgtcatttggtcgtgggtgatcatcatgtcgtccatatacgaacctctcattttgttgaggcgttaggcactatgcacgaatgtctgcggccaaacacagcaactacaagacagcaatgcgtgaccaaggtcgtttcaacaagcgtcctaggaaataattcgttgccagaatttgggctggtcggagaggggcagataagtttgaagtgttcagtacacattcctcattaaagcaaacagaattgcgaggacggggagtctaacccagctacatgtccacagcggggtgtcaaaagggatagaaatagtagatagctctagctgggtaggggctcctatttcgtaaagaggcgtgcaaacatgtagactgtagggaggctagctagagctattaggctaagtattgcctcattgtaacctaatattattgaaaatgactatagatgctaacatgcccttgaatagaagttttgaggccccaaagctgatccttcggttcccttgttacctcctataggggtgcccaatgttattgggattagagcaaatatgcactaggtacacttgccgtattgtgccacgtgtgctaacgtataaaggatgtgtacaggctcatgaagaggaagggacccaccttcgcaagtaccgggtgttggggcgcccgttgaaattgaaggcgtcgttagatatgcccttgggcttttggattaactctttgacgagaggtctttgagtagccttggttacacgtggtagatttgggtcccctgtttcgggaaaacaagggggcagggaaagataggaaaagtccgccccgctggaaatatgccagggggaaggggactccggg

SEQ ID NO: 681703 - DNA, 206 bp, Homo sapiens
  misc_feature (57)..(57): n is a, c, g, or t
acagttttaacaaagaaagttgatagtctcccgtgtatatcgggagctcaggattanagcttcccagccatcccatagcattccttatctttttcctgtcttatgctatttagcaagctttttggatttactgtcttggaaaggcttcttgtctttgtattctattacacattcttgattgtgtctttattttatatatatataga

SEQ ID NO: 681704 - DNA, 1189 bp, Homo sapiens
gacccacgacgtccgcggacgcgtgggtcgcaccacgacgtccggacccacgcgtccggagacttgcctgatcctctggcccctggtcctgtccgtcttctccagcatggtgtgtcgtgaagctcccttggaggctccgagcttgggagctgttgacagtgacactgatggtgctgagctcccgactggctttcagcttgtgtgtgacgaccctgaccacgtttcttggagctagattaactctgagtgtcatttcttcaatgtgtgacggacgccgggtgccggttcctggagagacacttccataaccaggagcgagtaccgcgcgcttctgaacagcgacgtggcgcggagtacctggcgcgcgtgagcggagctggggcggccatgatgcccgagttacttggaacaggcacgacatggacctcctgggagcagaagcggggccaggtgggacgaattgacatgcagacacgaactaacgggggtagcgtgagcagcttcagcagttgcacgcggctgagtccatcctcaccgtgactggtgtatcctgccaaagacccatccccatgcagcaaccactaacctcctggtctgctctgtgagatggtattctatccagtgccagacatttggagtcacggtgggtcccgagaacaggtcaggcaagcagaacaggctggaggctggatgtcagcggggccgtggatcccatcaactgagcacaactgggggaccctttcccaacaaccccatgggctcgactgcctagcacaaacaacctcccttccgcaaagtcggcgcaaagcgttcaaccaacattggccaccaggtgcgcaagcgaccgccagacagcgatcacagagaggcccgcactcacagagcaggaacatcgcgacacgcaacaggatacatttcaaacatgtgcgacacgtatgcaccacaatgactctgacaagtggccaataaacgtggcgacaacgacatggctgaggagacagtgtgtcaatccaataggcggaccacggcctaggacacactacgtaagtacgctaaatgacacaaagagacagacactgtgagacgattcaacaacaaagggtcatccgtaacaagaagaggactttacaaatttaacagcaaactctttcccacatggtgagcagtcacaatacacacggagactaat

SEQ ID NO: 681705 - DNA, 1132 bp, Homo sapiens
gaaaactacccctaaaagccagaatgggaacggaaaagactcatatcaacatgtcgtcattggactaggtagacttcgggcaagtccaccacatactggccatctgatctataaactgcgggtggacatcgacgaaaagaagccattgataacatatttgagaaggaggctgctgagatgggaaagggctccttcaagtatgcctgggtcttggataaaactgaaacgactcgagcgtagaaactgtaggctatcaccgattgatcactctcctatgtcggagaatcatgagaccagcgaagtactatagtgactatcattgatgccccaggacacagagagctttatcaaaaacatgattacagggatcatctcaggtctgacgtgtgctgtcctgcatggtagctgcgggtagatggtgaagtttgaacgctggtgatgctccagagaatgggcagacccgagagcatgtccattcgtaggcttatagcactgggtgtgaaagaattaatagtcggtgtaaacaaaatggattaccatggagtcgaacgtacagacagaagagatatgaggaaatagtaaaggaagtcaggacattaccattacgaaacattggctacagacccgacaacagtacgcatggggtcgtcaattactggattcggcatggtgacaacatggctggagccgagtgctaacatggctcggtcccacgggatggcaaaggcacacagaaagggatggacaaagcccagcggagaccaacgcagatggaagcactggaaaggaaatacaaccaccaaatcgtccacatgacaagccctagcacaaggcaaactccaggaagcataaagatggaggacagaactggcacagagacacataggaaacagggaccaaaaacacgatagggaccacctaggaccagacagcgaaagcgacaggaaacgaagaacgaacaaagaaatgaaaaaacaggggaaagagcggaaagaaacaaagtcggaaaaaaaacaagcaagagaaaaaagacaagaaaaaactaaggaaaacaacagaaagcaaacagagaagaaaaacaagcagaaaacagaaaacagagtagtaagactagaaccgacccacggcaaga

SEQ ID NO: 681706 - DNA, 825 bp, Homo sapiens
cacaggcagcgcctgactgtacagcgcacccggggacgccaaggacggcgcggtgacactgacgcggaccctgagctagacagataacacgtgcgccagctggaacggcgagcgagccgacgggcgagtgaggggcgcaccatgatcacctcggcgctggaattatttctcttctggatgaagatgaaccacagcttaaggaatttgcactaacacaaacttgacatgcagttgtataatagacttctgggcagaaattatccgagtccgtagacaaaatagaggttttatacgaagatgaaggtttccaggagatcgagcagttatgcagccttagtggcatctaaagtattttatcacctgggggctattatgaggagtctctgaattatgctcttggaagcaggggacctacttcaaatgtacaatgataaactctgaatatgtggaaactatataatagcaaaatagcattgatcactacaccaaagaatgtagtggaaaatgcagatttgctgaaggagaaaaaaaaccaattagacagagatatggaaggcatcgtaactaaacatgtaccagcgatgtctagatgatcacaatataaaccaggctattggcattgctcttggaaacacgaagaactgaccgtactatgaaaaaaccatactggagtccatgatgtaccacggcatatagaagtatacgcttaaggccttgatgtctttttgcgcaaacaaagatcggcataagtctaagattcagtataaactacataaatgcgaaactagtacaccagttgacgctattacacaccacacaagaaat

SEQ ID NO: 681707 - DNA, 693 bp, Homo sapiens
cggcgtaattacaaatttctggtttcttccccctttcgaaccgttagaagggataaggatttttgcgtacttgctgcagccgcgaaattttcaaaggccagctattacccgtaggcgttagccgccgaacagatagaatataaagattatttagagacatcataatcaaaagtacaatttccgcctcaaagatgtcctcacgtccaagttcagcagtgcctaattcagcatcactcagtgaggaccagagcagtgatagaagtaaatttcctaaggcagatgacttaattgatgaaagagatagaaaactgaccgaactatactgcgtatcccgcttgaaccagctgctagagttaacagatgaaaacaaacttcggaaggaaatagatgcatttttaaagaaaaacgatatacgaaggggtataaggtttgacgaggcgtcactgccgaagctcctacatacagctgcgactcccataacaaaaaagaaattgaaggatgtaaatttaataaatgtacctaaccagaggctatccgattctaaaatgagtagggaactgccagacaatagcgaaaatgtatcagtcaaatcagagagtcattttgttccaagccacgataattcaatccgtgaaaatatggtggattctttgaggccagctgaaaagacaggaggtatgggaacaaaaggcc

SEQ ID NO: 681708 - DNA, 187 bp, Homo sapiens
  misc_feature (50)..(50): n is a, c, g, or t
  misc_feature (90)..(90): n is a, c, g, or t
atacatatacgaatcgagctgtgtaccccccgatagtccgaagtaccaanttctactccatcgctagcgcagtaaaacactcaccaaganctcaaccctgacccccatgcctcaggatacccctcaatagccatcgttgtagtatatccaaagacaaccatcattcccccctgtcgggctagtcggg

SEQ ID NO: 681709 - DNA, 720 bp, Homo sapiens
  misc_feature (459)..(459): n is a, c, g, or t
ttgcaggggctgtcctgtaccttgtaggacagcagccctgtcctagaaggtatgtttagcgtatgtttagcagcattcctggcctctagctacccgatgccagagcatgctccccccacagtccatgatcgaatcaagaaaatgtctccagacatgtcaaatgcctcctggggggcagggtttctcaagcacttttaagcaaaggtgagtattcatacaaagaaatttaggggggaaaaagcattgtttaaataaaagctatgtgttccgtattcagacaatattttagctttaaaagtaagtagagggcataaaagatgtcatattcaaatttccatttgcataaatggtgtacagacaaggtgctatagaatgtggtaaaaggcttgattggaaacaaggttataaaatagtaagatagtaaaatagcttatgaagaaactacagagattgaaaatngtgcatgactcatttcagcagcaaaataagaactcctaagtgaacagaaatttttcgtacctagcaagtgttagttctgtgttaacaatagttacgctattaaaacgtgtgaagagtaaagaaaactaaaggcaatgttattatagtccacacaacgtgattatactaaagaattattataaggtataattgtataactgtgtttactgtcctgggtattaggtataaccattttgaaatttccatttggactttctatga

SEQ ID NO: 681710 - DNA, 131 bp, Homo sapiens
aatagtcccaggtgatagcattctgactttgaagattactagaccactgatcactaagaaactaatattagctagaccatatgatcactaagaactcactttgactgataaattatgactgataaatttga

SEQ ID NO: 681711 - DNA, 301 bp, Homo sapiens
cgaggatcccttatcgtgttgcctattacaaaggaccagtcctgacagtagagaggaggcgcagttacgggacagcacttcaggagacggttggttttcgtttacatgttgggacactccatttttctgtttcctgaaataaattcacacgtactttgtgctgtctgaactgtaccaggaactcatcggaaatctcaatatagagcttcctgttaggttgggctgagagttgtgcgatagagcttggtggccattttcaatcaggtgatcactgctgaaagacgacacgtcctctttaact

SEQ ID NO: 681712 - DNA, 684 bp, Homo sapiens
gactcaacccagtctacgtggagaggatcctccgtgctgagacagggtcacatttgccgcctgcgaggactatggtgtccccagtatactcttatcctgtggactcgccctgcagtaggtcgagcacagctggacgccatctcggagaaggtggatgtgattgccaagcgtgtgctggggcttctagacaagatctggtatgagctttacctcaggatatgctgagatggacgaactgagagaacgctatcatgacacggtctggaaggccaccaagtacaggaatgtgaggaacactccttcggatggtcctcagtggacagcagcaaggacctcctgtagctgagatgatgtcggccttgggaccaataggaggtacgggaagcggatccagaatggtggtttccagctagggagaggatgtgtcgggcatgtgtgatgatcgccaatttgatccttgtgagcattagaaaccgactgtacacgaggatcagaaggaggcctggggaccgatcgggaacgcttgctgaacggcaactaagagtggaaacaatctctgactgcagcacaagtgcatttgtgatccaccaggaggcacgtatatgtcaaattggctggggaagcccaacccatctaacctcctggcactctggaaaggcattctccgggtctggctcctcacag

SEQ ID NO: 681713 - DNA, 643 bp, Homo sapiens
gccttgtgtatgcgcgaggccatgccttgtcggctgtgatgggatgaagaaactggatcgaatcacctcaccatggttgtagacatctctgtgcagtgatgatgatagagtttcctcgctgacgtgtgaccgtttacaaccatgaaatcctaggaaccatgcatggaaggtggaatattctagtaccattagatccaagcgaagacaacgttaactttgaaccattcgtcgcgaacatggaatattatcctcgagttacgtgtagaaaaatcctataaattgagaggatgtgcttgaagcactgaaaagctcgtagcgagtcagagtggcaacagtcgcactaagtcgtgtcatctagtaggcggatcctcccgatccattcaacccagtctgtgctgcaggaacctcgtgatgataacaaatgtgtgacatataccattggtcaaccacgtacaaaataggaacccagatgaataagatctccatacatatctctagcattgcagctgtagcccgggataatttaaagaattgggatagcgattactcatgtgcgacaagatggatgctgtggtgtctgttgcatcgtggcgacaacgaaaggctcgcttgttaaggcactgcaggcaagggtgcagaggaa

SEQ ID NO: 681714 - DNA, 551 bp, Homo sapiens
gctccagatccgagtcggcagaagatgggattcatgtagattcaaccaaaggctccttgttttaaaagaaaagggcccataaatacttccgaccagggaaatatgatgagagccaattgactgcgtaccacccaaggcctggatgcccgatcccatataatcccctgttgcccaccgaccgagcgtccagcctattttagactggaaaaatttgctgttgctgagtctgattgtatttagccgttgccctggatagaagttataccaaggcttattcccgacgaggtgctgctcgatttgctttgccaaaattagaagaggccccaaaagattatgaaagagtattaggactaggaccccataactttggagccaccaatggactccgggaaatccctcaggctttagcatcccaaggaactcatatcccaaggaagctgacatagtgattaagtccaccgaaggagagcgaaagccaattgaagccccaccgaataagccgccggccctttcagagaaagatcgggggaatggatttttccaagagggga

SEQ ID NO: 681715 - DNA, 156 bp, Homo sapiens
ggccagctctcacggatatacaactaaaatatctgtcctatatatccaagacttcttgagaactgaatcccactctgatattattccagcaattgtcactatattatcataattttcttccctctctactggatcatagtaatcgttgagaagctt

SEQ ID NO: 681716 - DNA, 441 bp, Homo sapiens
tatgctgggctacgcgagatccgatagacgggagatgatacaggaatattactttacgctccacctggatgtcccagtagcctcagcatccaggtgtgtgtatacattctcggacaagaatggctgacatggggactggacggttttcgaaaaacccagatccccctgatggtttagtcctcatccctgacctcaagtggaaccaacagcagctcgatgacttgtacttgatcgccatctgccatcgccggggcatcagatccctacgcgaccttactccggagcacttaccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccg

SEQ ID NO: 681717 - DNA, 301 bp, Homo sapiens
ccctcccgctcacgtgctcgcgatgtactctctgctggccccatgagaagcaagcacatggtctataagcctccaccggaggggactcggttgtgtgttgtgccaccaatgtggccaagacgtcgcttaccatccccggcatcaagtacgtcgtgcctggtagaacagtcatgacccgctactacgaccgcgtcactggcgtatcctccttccgtgtcacctgggtctcccaggcatcagctgaccagcgagcgggcagaccaatacggcggacaaaagtacgggcgcccaagggtaccga

SEQ ID NO: 681718 - DNA, 122 bp, Homo sapiens
atttttctttctgatgaaggaagcaactacagacagcttttatttatttgttcaaagtgacccagtcaattaatgcaaaagaaatcacagcactctccatactacttcaaacaacatacaac

SEQ ID NO: 681719 - DNA, 843 bp, Homo sapiens
tattggggttcacgcgcctcgtgcgaactgtcttctgggtggcccttaatgtcttgtgctctaaggtgctgaggggaaagacgcagggaggtcgtctggcctgacactatgaagggaagtagagaaatacgagttcgacggtgtgagcactcaacgcggcgtgaaacagcagttgctgggagaaatgtccgcaagaagtagtgaatggagcacccgttatgagacacaaattgatttaaatgatgaattagaaaaagcaaatggtgtatctcaagggagaagggtggaaaaaatccatggaaaactcttcagagtagactatcattcgtattgcgtgtcatatgaacgaatgccagtgaatagtatgaggttgcagtccaggggtggtgcagtggtgtataatgccttcaggaatccaggcttcccctaatgtttctattctgccatccatttgtgagtgcctttggtcctcgtgtcaaaagatggtgcgttcgcttctcagctgttcacgttatcatttcagaaaaacgacataggtgccggacaaaatggtaaggtgaagcggtcacgtctactcccctgcagagagttataagatgttgaccagtagttctcttgaatttattgggagtagactgtatcatatgcgccttcggtgctggcagctggaatatagggttactggattcgaaaggaggtgtggacgaagtggggttgcacaaagtttaagggggctattgtctaacgaaattggaagtgggtcttggaaagggaaaattagaattcggaggggaatggaattttaacaaacagggggtttgtaaaggggggagatgatggggg

SEQ ID NO: 681720 - DNA, 288 bp, Homo sapiens
agccagagaagagagatgagagaagagtagtgggtgcagaatcactcgttgggtcttctatgcacagtcaagattgagggtttaactttgagtgtgatgggagctcactcaaagtacaagccgcgaatcttgagctgcagctatacaagcaggcccggtaatgggcctccacgatgtccctgccataggctctgtctgctccacatatcacagtaatatggaccctggtggccctgggaagccgttggaacgccaaccaaaggggtgcccatctgtccccgtgagggt

SEQ ID NO: 681721 - DNA, 250 bp, Homo sapiens
  misc_feature (188)..(188): n is a, c, g, or t
  misc_feature (228)..(228): n is a, c, g, or t
  misc_feature (236)..(236): n is a, c, g, or t
tcccgcagttggggctggcgaagacggaggtaggacacgtactttgcacacctaacaccaggttgaaggtacagaaatttcacagcaaggcaggatcacatttagctgccccctaaagtagtggggcaaggtggagcggggtagaggggggagctcgagaagtttccgctggcagacatgctgtcttnggcggatcttttcacatgggcaagggaaggcttttagttncgaggatntgttcggctcaggc

SEQ ID NO: 681722 - DNA, 113 bp, Homo sapiens
tcttgtcagtctgacaagaaagggaaagtcaggctgggcgcagtggctcaagcctgtaatcccagcactctgggaggccgaggcggatggatcacgaagtgcaggaaacaaga

SEQ ID NO: 681723 - DNA, 680 bp, Homo sapiens
  misc_feature (648)..(648): n is a, c, g, or t
  misc_feature (680)..(680): n is a, c, g, or t
gacacatgcatttcctatcgtgcctctgactttgtgggtatcacagagtgttgacaggcttgtgagcacatcctggcacgcccgaaaggacaaaccatatcatggggaagcagtttggcctcaaaaagcagctttggagtgaggctgaagtccctgctctgacttcactagctctgtgaccttggatgtcattctctcctgagctttggcttagttatctgtaaagcagggctaatgacatcctccttgccaggcttataggcagactagagctggcaggaaaaggccagccacagagcacaggatttgtttttgaggatccatcactcccaaggccttttagttcttggacattccatcactgagcctattggctatagtgtctgtccccatcgaggcccctgtccctgtactttgcttgcttgtctagcaaggcccattgggatgacaggacaaggacagggacacacgactctccttgttttcaaggacaaaacaggaaagtctccctgactccaaacaggatcacttttactcaacgtttttatttattggcccacccatgaaaggaatctgcccacacttgcccttatgatctaggcctttggtggcctgaaaatagaaaatttatttctaagatgaacaatntatttttatcttaatagtgttgttattctgan

SEQ ID NO: 681724 - DNA, 99 bp, Homo sapiens
atgattatgaatttaaaaataaataccaattatggaaatagtactaaaggcttgcgcgcatgaaacattaattggtttaaagtccctttataaagagtg

SEQ ID NO: 681725 - DNA, 267 bp, Homo sapiens
gcctttttattttcccaacccccccaggggttttgaggggtttttattttggggccctctctagaaaagaaatgctccctcttgtttgggggggcaaaagactggcctttttcctcaagggacttccttttcccggggtcctcatgggatccaggtgaaggccgtttttttttgaggggcccttttttctccggtttttttctttgtcctccgctgcttccccccctccccttttccttaggggcctccctccattaaccccttggc

SEQ ID NO: 681726 - DNA, 696 bp, Homo sapiens
gaacaatgatccagtagtacaagaatctaccaaattaatactcatcagttaagtaatcataatgactattagctgataagaactagtgattagtgccacctttcagttacatgagctcccagaggttataccaatgggcatccactctgacatctaggccctgctacttctcacatgacaaataactagtgccctatctcaatcatataccaaatctctccctcagtatacgtaagccttctcgctcgattcagcgtcagattcgttgtccgtcatagcaggcaagctagcaggtggagtatagaaccaaaaccaacatacgcaagaatcttagcatagctccgtcaattacccacataggatgaataatagcagttctaccgtacaaccctaacataaccattcttaatttaactatttatattatcctaacgtactaccgcattcctactactcaacgttaaactccagtcaccacgaccctactacatatctcgcacctgaaacaagctaacatgacgtaacaccctataattccagtccacccatcctcgtcccataggagagccatgacccacacataacccggctttttgcccaaatgggccattatcgaagaattcacaaagaaacaagtagcctcatcatccccaacatcatagccacgcatcacctccttaactctacttctaccta

SEQ ID NO: 681727 - DNA, 235 bp, Homo sapiens
gactaccctgtagccctacacctggcagacgctcagtgaatagtatgggatagaataaatggcttcatactaggggttacttgatttacgatagagtctatagcagggatgagagataaagactagaccacggcaagctgtactatcatagtatactacatactacaacggtagtaccctagtatcccacaaaatgtacaggctgggtaaccgtagctacgacatatcgtaaata

SEQ ID NO: 681728 - DNA, 743 bp, Homo sapiens
catagccctcgttagtaacagccatactcatccaaaccccctgaagcttcaccggcgcagtcattctcataatctgctcacggaacttacatcctcattactgattgctgcctaggaaactcaaactatgaacgcactcacagtcgcattataattctctctcaatggacttcaaagtcttactcccacgtaatagctttgttgatgacgttctagcaacgcctccggtaactctcgtgcttacccccccacgtattaaactactgggagaacgtctctgtgctagtaaccacgttctcctgtatcaaatatcatctctcctacttacagtgactcaacatacttagttcacagtcctatactccctctacatatttaccactagacacaatggggctcacttcaccgcaccacattaacgaacagtaagaaccctcattcacactgagaaaacaccctcatgttcagtacaccgtagtcccccgattctcctcctatgcctcaaccccgacatcattaccgggttttcctcttagaaaaaaaagaaataaggaatcatgaatggacagaagactcgaagcagctcaaaggccaaggggggggcgcgccatggagggacctctaggaggcccgcagatgcgggagctagccgccgtgttttgtggaacagggtggggccatcagagagcccgctattaagagggagcgcgagcaacctggctgacagacatctgcgcctcaca

SEQ ID NO: 681729 - DNA, 881 bp, Homo sapiens
  misc_feature (178)..(179): n is a, c, g, or t
  misc_feature (209)..(210): n is a, c, g, or t
  misc_feature (215)..(215): n is a, c, g, or t
  misc_feature (222)..(223): n is a, c, g, or t
  misc_feature (249)..(249): n is a, c, g, or t
  misc_feature (286)..(286): n is a, c, g, or t
  misc_feature (288)..(288): n is a, c, g, or t
  misc_feature (293)..(293): n is a, c, g, or t
  misc_feature (297)..(298): n is a, c, g, or t
  misc_feature (306)..(307): n is a, c, g, or t
  misc_feature (314)..(315): n is a, c, g, or t
  misc_feature (351)..(351): n is a, c, g, or t
  misc_feature (386)..(386): n is a, c, g, or t
  misc_feature (479)..(479): n is a, c, g, or t
gctcccttatcccttcgctttcgctcgtttccgtcgaggccgacccctgagttgtgagtctggggtctggttggtgaaaaagagcccttgaagctggaagacgggagaggacaaaagcatgtcttcccttcctgggtgcatggtttggatgcagcaacagctacagtggagtctgaannagattgcagagctgcaacaggcagtggttnnagganactgggnnatctctatggaggaacttcggcattncatcgatgaggaactggagaagatggattgtgtacgncnacgcncganngcagctanncagagtnnagagacatgggtaatacagaaagaatctgaggtggntcacgttgaccaactctttgatgatgcatccaggncagtgactaattgtgagtctttggtgaaggacttctactccaagctgggactacaataccgggacagtagctctgaggacgaatcttcccggnctacagagaataattgagattcctgatgaacgatgatgatgtcctcagtattgacttcaggtgatgctgggacgcacgcacacgtccacaacagaccagaacgtccgagaaggcttctggctggggcttaacggaaacgttccggggtcacagaatgtccaagagaagcttctcggaatgctgttcgacagcgcagacgacagacccacggactctggccctaataggcaacctagacacacctgtccggacgcatccccaaactgctgacctggacattacgcaagcaatctcgggcagcaccgaacctaagactggacaccaacgcaactactgcctcacaaagagggctcggaaccaactctcgcacctcgaccccggaagcacacgcgccgacaaaga

SEQ ID NO: 681730 - DNA, 1504 bp, Homo sapiens
tgcagacactgaccttcagctgcctcgtgtccagcgccatggtgccctccaggacagtcttcgtgtgggggaaactggaagatgaccgggcggacagcacgacgtctggggggagctcactcgagcactctgacacgcggccaaggtgccggccgaccaccgagggtggtctggtgctcccccactatgggcctatatcgacattcggccacgggcacacacgctaagcttccccaaaggcattggctggtgacattggccgcagcacacgggctacacacgaggtgaccctacattggggcgcatttatacctggggtcagcctcaggcccttggggcatcttgatcacacacgcactgtggtggacccccacctgatggggtggaccaccttggggcgaacaattccacgaacggacgacaaagggcaaattggtccccacggggagaccgctccaagaactgacaggcctggcatgggcgggcacagaacaggttgggccacccaaagatgctccttggcaccacgaccgaggaccacaccagaaagaacaaacatccgggcccggtggcagtgggcgggacaacgaacagccatcagcacttccaacagcgtcagcaaacccctggggcgccctccacagttggagaacagggcgcgggcacacgcgcacacgacaccgacaccaagcgggcccacactccgcaagctaacccgcggggtcaacacagcacgtgggcacgcccacgggccacggcaacccttgggcaccaacatgtgcagcccctgtgttgcggaaccaatgtgggcaaagtggggcaaacgcagtgggcacaccacccccaaaagcagggccccgaggaaacgtaacccgacgaacgaacagccacccccagcaagcaactgcccaagcaagcccccaacaggagtcacatcaacgcacggaggccacccagacagccagcccgggacaccacacaccagcggccggccctaggcaccgcgtgagccacaacccctgaaaaagaaagacgagcaaagaacaaacaaaggaatgatggacacaggaccccatatgagtggaatgcaggcaaccccacacgagccccagacacgggggcacaccacacaaacggacaagaccaaatgggagccacaccaatagtcacaaccccagctagaccaaaacaagacacaagagacaaacagccaaaaaggcacaccagcaacgacgcagagcaccacaccacaggggcaaccacaggcggcaataagagtctacacaggaggagtaacagcacacacaaagcgggagaccaacggtctctaccaaaagggggcgttcatgcagggaagacacagctgacgacagtgtcctctttcacgaccctatatcccaggagagaaacaggaaagacagacgaaacgaagagacaaacagcacggacaccacgaagacagcaaacacacaagccacgaagaggaaggaaacggcggacacag

SEQ ID NO: 681731 - DNA, 455 bp, Homo sapiens
agtcatttgccctgtgggcctgtaaagcaagattgattgattataatgatgcctcggttaatgttctgaaagatgcatccttaggtgatttcactgttatgctaacatcacagtttacttacacaaacctagatgatataacctactatactcctaggctatatggtatagcctattcctcctaggctacaagcctgcacagcatgttactgtactgaatactgtaagcaattgtaacacaatagtaaatattcatatatcaaaacatagaaaaggtaatgcattgcactatgatgttactagctacaatgtcactaggcaataagaattttcagcttcatgataatctatgggactaccattgtatatgcagctcattgttgacctaaacattgttatacagtgcatgattatacttggcaatatttttcccaataaagagagatcagtgctat

SEQ ID NO: 681732 - DNA, 474 bp, Homo sapiens
tgcttaccttatgcactcacaataagttgaccctgtagccagattagtttgaattgtgagggtccacttatatgcaggtttactctcaatagaacgattacactgagtgtgctacctctccgcgcctcccccttccagctcctccagctcttccacctctgagacagtaagaccagctcctcctacttcctcctcagtcctactcaacttgaaggccatgacgagtcaaaaccactcctacttcatgacacagtacatatgttttccttatgattttcttagtaacagttttcttctctctagcttattgtacgaatcgagtatgcaatacatgtgacacactaaatatgtgttggtagactgtgctaggtcatagcttaggtgtcagtaaggtgaccagtagactattagtacttaagtctccgcgggagtgaaaacctctatgtggattttctacagcacaggaaggttgct

SEQ ID NO: 681733 - DNA, 1406 bp, Homo sapiens
  misc_feature (648)..(648): n is a, c, g, or t
gtttcctcctgacttccccgccgtcgtcgtcgacgacgatcatgagggtaattcgtgcacttgcaggccgggcagtgcggtaaccaaatcggggccaagtttcagggaggtgatcagcgatgagcacggcatcgatgcctcgacggagtgacctaccacggaggtacatgacgatgctgcgagcgtggaacgcatcaaacgtgttactatcacattgaggctcaacgtacggccaatgtacgtgtcgcccgtcgccgatgctcgtggatctaggatgcccgagagactcattggcactccgatgcctgtctcggggcgccgttcggggcgatgagtcttcgcgggcgcggacaaacttcggtgttcgggctcgagaggtgcgtcgcttgggaacaaaggtgcgagccaaaggaggcacgatacactcgaaaggcagcgtgaggatgagtgtgacatccgagtgcctgggactgtttgtcggatgaacacggtacgggcgtggcacggatggcttggttgacccttgctcatcgccacgtgcgttgttgccgcgctcgaattcgcgaccattctcctttgagtggtgagcgtgcgtggagcatggagcggtgctgggtgcgactcgcgggtaagggcgcttggccctcncatttctagccggaagagggggtcctccagcggggcccgtacgctcccccaccggggccacacaattgcgcatttccgacgttcatgggcaacgccttggtgacgttggtgttgcggtgggcacattttggaccccggaaatttaatcgctttcaaagtagcaaacgcaagttcgcggtgcggaagcattggcacccctgaacgaggattgacccaggcccttcttccatcccaagtctcaaccagggccacggcagtcgggtgaggaaaaaattaccgatgacggaccgggaacgaaatccataaggcgtagggcaaattgcgtaaggttagacctagaacaggttcttgcctcccttgagggaaactttattctgtaggccatgccggaggaattgccgctcaacaacggctctggacaacttacccttcccctacttcttacattcgtggtggacgccactggaagaccttaacgcacgtgccgttgggcctcctgggattagtccccagtggatcgtatgtgcagcggctacatctcgggcgccgatgtgcagtgcggggagctttcccgcgcgatggggtccccggggacgtcggcacagctgttgtttgtccccagttgtccgtgtcaccgttctcggtgcggggatagaatggcgacaatgtcgctgcggccggggggcatctccccacgcggacagtgacaccactcctttttcaacttttcccccgtcgattttaatgggtcgcttgga

SEQ ID NO: 681734 - DNA, 229 bp, Homo sapiens
  misc_feature (10)..(10): n is a, c, g, or t
  misc_feature (32)..(32): n is a, c, g, or t
  misc_feature (37)..(38): n is a, c, g, or t
  misc_feature (105)..(105): n is a, c, g, or t
attaccattnaatactttaattttattcaagnaaaannggaatcatatatttgacatgagaactaagtatttcatatcgttaaattagtttgaattagatatgcnttttattatgtatcaggaataacttactttctttaacatttatttgtctttacatttatttgaataactatgtaatgagtatctgtttcctacatttggtaatataggtatacattaataatat

SEQ ID NO: 681735 - DNA, 192 bp, Homo sapiens
gtcgatcaccggacccagacggccctgctctacaacgaagattaaaacatccagccaggcttggtgactcatgcctgtagtctcagctactcaggaggctgaggggggaggtcaaggctgcagtgagctgcgatcactgcactgcactccagcctgtgagataacgcgagatcttgtctctcaaaaataaga

SEQ ID NO: 681736 - DNA, 995 bp, Homo sapiens
gggcagcactggagatctcgccggctttacgttcacctcgagtgtctgcagcatcggctccgcttcctctcctaggcgacgagacccagtggctagaagttcagcatgtctattctcaagatccgatgccagggagatcttggacttctcgcagggagatccacacgtgtggaggtcgatctcgttcagcctcgaaaaggtctcttcgagagctgctgtgcccagtggtgcttcacagtggtcatctatgaggccctagaggctccgggcacaatgataaggactcggctatatggggaagggtgtcgtcaaaggctgatcgacgcaccagtcatataaaatctattgacgcctgccgcatgggttaggccagaggcgaaacctgagacgctcaccgagatagcatacgacgaacgacttcgaccagaaactcgattggactcgagcactgggactggaactcatgacagacattagacattgctacagtggcgcgatgccggaaacggcacaactccgtgtgagtcggttgttcccacgttggtccctggggcttcggcaaaaataacctggagtttgtcgccgggtttcagcgacggatacgtgggcgagatccgcgcaccccatgggtgacctccgggccaaccaaggatccggaccggctggacacacctctgggagagcctgggcgcgcacacactttccctgccacaagggttcgacatcttcttgggcgccaacgactcccctgccgggcgacggaatcgccgaaggacgttggggccacgcagttccaaacacatggggacccgggggatggtaccgtcccacatgggccataggagggacgtaggccaaaaaggccccgtggggacacaacatgcccaacgggggaacgtggtttacccactgggagaaatccgcggtccacacaatgtgaccggggcgacgcgaccacggacccgtagaaacaattccaaggggagggaacaccc

SEQ ID NO: 681737 - DNA, 308 bp, Homo sapiens
agaccggagctgggactaagacagtgtattgagtacaacaaacaccaagacctctccgacctgcccatcatcgattgtggccccctatggtcgttggtgccccagaccatgatatcggcttcgacgttgtccctgtctgcttattgtataactccctccattccaacctggctccctcccacccaaacaacttatcccccctacccggaaacagaccagtgactcttggaactgtccacgtgcagatttccacaagtcaccactttatgaatctgtatccatatgccgagactcggggtaccgagctc

SEQ ID NO: 681738 - DNA, 250 bp, Homo sapiens
ttcatgccatgtcacattgcccccaatgattttaccattacacctttcaccattccccaaacccagcagcctgtgctactgtggggcttccagtctggaatgtccctaccaggaactttctggtttatctgtccttctcctgcaagtgactgagtcccatcgctgcctctgctcccattcacccctagcttggcacagtccaagagaaggggcccaatccagtaggtgttgaatgaatgactgtggacta

SEQ ID NO: 681739 - DNA, 390 bp, Homo sapiens
  misc_feature (72)..(73): n is a, c, g, or t
  misc_feature (370)..(370): n is a, c, g, or t
aagcttcaaaggactctcttggtagggttatttaatgctgctggtaacttgaagttgaagccaatgctcatnncccattctgaaaatcctagggcccttaagaattatgctaaatctactctgcctgtgttctataagtggatcaaaaaagcatggatgacagtataacagttgcagcatggttgactgaatattttaagcccatttttgagaactactgctcagaaaaaagattcctttcaaactatttctgctcactaacaatgcacctgggtcacccaacaggtctgatgggagatgtacaagacgactaatgttggttccctgcctgctaacacaacatccgtttctggcagccctgggtcaaagngtaattttcaacttttcaag

SEQ ID NO: 681740 - DNA, 299 bp, Homo sapiens
ccccttttcaagggtttggggtgaccccataaacattttttgttgaggatgtccaatcaggggtttcaaggcccaggctcaaccccccgtggttgggagggttccctccagtgccagtttttcaccagggaaaattgggcaaaaacaacgagggggcccacctggggaaactgtagccccctccccctccccccctcccttttgcaaagcctgggtttttaaacagcgggggggtttcattcccctttaaggtttccttttaacaaaaggtttgggggtaaaaaaagttttaaaatcca

SEQ ID NO: 681741 - DNA, 1004 bp, Homo sapiens
gggtgatactatgtaatacccatgtactatgaaggatcaagtgtctaccgtatttttcattgtccagtccctattcgacagaggtcttgtaatgaattagcctataatagtgcccagataccgtcctcgtgaatacatcggttaggagcgtgacgtagtacatggactaattattgcttacaaaaccctcttgtccgacacttatggatggaaacaagtgcgtcgacttatgcgggtaacttagtgatctcgtcgcagtctgattcggttggcaaggctgccgtgcggtgtgcttgattgtcgcttgctcatggtcggtcgtctttcacagacgtatcaataagacgtagttgagcattatagttgaccattgagcgtaaatcacctggagttaccaaagcattatttggaccatctgtattgctcaaaagctattttggtcattggtattcagcagcgttgaaattctgtggtggtcaatgcgcataatatgatatcacgcaattatggttttcgaggggtcaagcgcatgcttagcttctacctatatgacgtgaaagttccctcttatgaggcggatttcctctcttacttggactgttagtggattgcatcaattattgcgcacctgcagtcaatcctcgttaggcattcaggggtttcgttggttttccttcgcgtaattgctacggtctggggaggagcatcgcttctcagaaatttaattttctaccctgaaattaacgtacttcgtagactgttaccttgaatacgggcacatacttggggtcccattcgtgccagtgtgggagatttttctcacgagttgactcccatgttgttacaacccatgttcaatcattagtatattcgtgtgaatctgcaaatatggcttggggttccttattttttgttaggcttgttgtcctaagaaccattgtgttgcactacttaattttttggggcacttgtagaaattgcctgctaggaattggttgatccgt

SEQ ID NO: 681742 - DNA, 183 bp, Homo sapiens
gcaccaccatacccctaggcctggagatgtggttgtctttgcccagggcaggtggggtcctgaccacagcctgcagtatctccgggtgttttttatttcactcttaggctttaaagtttagacctgccccctcctctctccctcttgctctcttgctcttgctctatcctcttgcgtagacgc

SEQ ID NO: 681743 - DNA, 369 bp, Homo sapiens
  misc_feature (297)..(297): n is a, c, g, or t
gggcgcttgctaggaacaatcgtgcccaagtgttttgtggatgtgtgttttcagtgctctcaggtatacacctaggagtggaattgctgggtcacatggtaaatctatttattgaagagctgtgaaactgtttgccacagtggctgccccattttccagccccaccagcaatgcatgaagattctagtttctccacatcctccccaacaccagttatttcccttttcaaaaatatagcctcagggtgggggacactggggcaggtgggcttacacctctaatcccagcattcgggangctgagtgagagaattgctgggcttaggagctcaagaccagccggggagacatagtgagaccctgtctctcc

SEQ ID NO: 681744 - DNA, 409 bp, Homo sapiens
  misc_feature (34)..(34): n is a, c, g, or t
  misc_feature (59)..(59): n is a, c, g, or t
  misc_feature (182)..(182): n is a, c, g, or t
  misc_feature (238)..(238): n is a, c, g, or t
  misc_feature (384)..(384): n is a, c, g, or t
gggccttgctgaccccacaagctttcgttctctncagtaacttgttacccagcttctcnaacatcccagggccccaatttgccctgcctggagttccccctggttcttaggacactctaacaagcttcttgtccaacggggtctcccccattcccaaccaggcccttgcacaacaaccccantccgtaaccttctcccctgtaccctgtgccaagcctagcacttgtgatgcctcccnatgccgagggccctctctcagttctgggaggatgactccagtccctgcacgccctggcacacccttcacggttgctacccaggcggccaagctccagaccgtgccagacccaggtgccccagtgcctttgtctatattctgctccncagctgccaggcccaggaggaaata

SEQ ID NO: 681745 - DNA, 374 bp, Homo sapiens
aggctggagtgcagttgcgtggcctgtactcactgcaacctccacctcccaggttcaagcagttctcatgtctcagcctcccgagtagctgggattacaggcggtgccaccacacctggctaatttttgtatttttagtagagatggggtttcaccacattggccaggctagtctcgaactcctgacctcacactgatacgctcacctttgcctcccaaagtgctgggattacaggtgtgagccaccatgcctggcccttaatttttcttttaaaggcaaaaataaaacaaataaatatttatgttccataagattaagaacagtactgtgataccgttccttctatcaaacaaaggaaaaatataaaaaatca

SEQ ID NO: 681746 - DNA, 376 bp, Homo sapiens
tttgcagtgagctgagatcatgccactggactccagcctgggcgacagagcaagactctgtctcaaaaaaaaaaaaaaacaaaaaacacatgttaacactgtgaaattatattttgaggtaccctttgatcctagcactttgggatgccgaggtaggtgggttgcttgaagcccaggagttttgagagcagcctgggcaacatggtgaaccccgtttctacaaaaaataaatggtggcagacacctggagtccttcctagctactcaggaggctgaggtgggaggattacctgagcctaggaggtcgaaattacagtgaactgtgattgcgccaccacacttcagcctagctgacagagtgagactctagctcaca

SEQ ID NO: 681747 - DNA, 944 bp, Homo sapiens
ggactcgtgcgtgacgcgaaggagtcggaacagagaccagaggaccgcactcgggtctgacaagatggccgggctgccccgtgaggtatcatcaaggaaacccagagttgctggcagaaccagtgcctggcatgcaaagaccgaagccaggatgagacgcaacgcccgtcattgacatgtggtcattgctggccctctagggattcccccttcgagggaccggagccttgaaaactggaaactattcgctatccagaagaagtacccattgggcgagccgcctaaaagtacgtatcagtgatcagggagtaggtcatcctagagtgtagacaagttgggaagaatatgtttagctattgggaatgatgacgtgtgtccccagtagtgcagatccgcgagcagttctgctatcgatccagggcctgtgtcaactgctcccagatccagatgatgccattgagcaaatgatagtaggcgcgagccgtcggaaggacctaaggaaagcccatcggcgcatagaaaacagggagagcatggactaagggtatatgccggtgaataagatttcaaattgatacgatccatcgaacgtgtgcgttcattctcctggtctggcaaagagttcctccctcctgggttcggctctaggggacagcagcctagacccgatgccgcactcagaagaggcagagattcttcggccttgcgagtaatgccgtaccatccgagttggcctgagtcgcggcacagcagaacgaggcaaacgttacccggaacggggacgggtaaagggggcccccggtatataacggcccacggaatacacgcggaaagagggggcacgcgggcaacaatacaacaagggaggagcagaaatggagcacagaaaacagaaacagaataaaaaagaaggaggaaacatccaaggcgagacaacacgctcc

SEQ ID NO: 681748 - DNA, 123 bp, Homo sapiens
agtccccatcaacgttggatgccttcctctaagtcctttaggatgtgatagctcatcgctgtccgaagtgtcatacaccaagttgttggcaaacatactcctgaggcaccgcacggactccag

SEQ ID NO: 681749 - DNA, 240 bp, Homo sapiens
tgggaaatttgtaaccaacactcacttaggctgcatcaacgatcggaaggagcagttgaggcagctgttccgatcccttcaagtgcagaagaaagcctctagctgacccccagccggaagaaatgaggccctggcaggtgccgccctggcctctagcagcgggatcccagcacagtgcaccagtcttcaccttcctccagcatggcagctgttttactggagaggcagcctcagcttgac

SEQ ID NO: 681750 - DNA, 394 bp, Homo sapiens
  misc_feature (42)..(42): n is a, c, g, or t
  misc_feature (64)..(64): n is a, c, g, or t
  misc_feature (331)..(331): n is a, c, g, or t
  misc_feature (336)..(336): n is a, c, g, or t
  misc_feature (340)..(340): n is a, c, g, or t
aatctgacgagggagacacagttgacgccaaagggctaacangggggagcgtttgaggaggccngtggctgcctagcaagggtcctgggccagggatttccctgcctgtctgctcttgaagccctgggtcctggtctctcccagctggaaaacacggttttgtagatgtaggacccaggcgcagtggggctggctcatctcagccgctcagaaccacacagactccagcccacccgcagttggctcatggcttccaacaccgcagcaaggctgtgtgtagaaacagcttagttatcacagacatctcttagaattgcagataataagccgnagagnaccnagtgtaaaagtgactgtaagcgaatgcagtttgtggttatagtatccgtaagag

SEQ ID NO: 681751 - DNA, 337 bp, Homo sapiens
tggtgcaacaataaggaagggtccccaggttggggagagccccaagtagagaacaataatgaatcaattagtgtatgaagcaattgttagagacagcgtaatcacaaacaacctgcgggcactatgacctcattccacacgtagcacccttcagcaggaccctataaaactttcgtccagcccttgcctcttggcaggtagccccttctctgctgagctgcccactgcaacatattttcacacaggatcgagtaatgtatgaccttctttaactaggaaaatctcggtgggtggctttaccacctgcaaaactgaccctaggtagttgctacccaca

SEQ ID NO: 681752 - DNA, 201 bp, Homo sapiens
ctcaggaacgctgaatataaccgaagaaaatatattagatcgggacatccatatctggtaaacatatccttcaaacctaagaaagatgcataggctgggtgcagtggctcatgcccgtaatcccagcactttgggaggcctttaactcacaacttaaacaactgtacaagtggtcttcttcaaggcaaccatcatactttg

SEQ ID NO: 681753 - DNA, 168 bp, Homo sapiens
agactggctcaactctagagtttcagagagttagaggaggtggagagatttactccggccatggatcatatgcacttctaccatcaactccgggtttggcagtatttttataaatggagttgggacctgggtgacactcagcctctcttccccttttcctatgttgca

SEQ ID NO: 681754 - DNA, 288 bp, Homo sapiens
  misc_feature (18)..(18): n is a, c, g, or t
  misc_feature (247)..(247): n is a, c, g, or t
  misc_feature (259)..(259): n is a, c, g, or t
ctgcttgtctagctctgnctctgagtagctgggatacaggcacccaccaacatgcctggctaattttttgtatttttagtagagacggggtttcaccatgttggccaggctggtcacgaactcctgacctcaggtgatccacccccgctcagcctccaaagtgctgggattagaggcgtgagctaccacgccctgcctgcccttctaacttaagcaaaaattcacattgcagcacatgatgccaganaatagcactganagtcaagaaaatagccagttgcggagctg

SEQ ID NO: 681755 - DNA, 1173 bp, Homo sapiens
  misc_feature (295)..(295): n is a, c, g, or t
  misc_feature (297)..(297): n is a, c, g, or t
  misc_feature (438)..(438): n is a, c, g, or t
gccacaacagagagagtgagagaaagatgcataccaatgaaaaggtgaacgaggtggtaagttctaagtgacatagaatataggcaatcagccttgcttatgtctgaaatgccttccaaaatatctgtacgttgcacgtacgagatttgtacagaggactgatcaccatcctagtaaacatggtgcagagggtcaaacaacagactgcgagagaaatcatccatcatctcaccatcagatatttcacccatacgtaggcatgtcaatgtagatcacttgaaatgcataactaatntnatcagtcagtaaccttccatgcttactatgcgctgcgttctcgtgagagcgtacgcccgagtgtaataatgaatcactcagcacttgtccattacccttgcttgtacgtgtttgtgctttacctatggatcgatgctcccnttcaggggagataggaccgtcgtttcctcgtccattgaagtcgcaatattagcaagctcgtgcaagtcagttccgtgtactttcaaggaaagactggtagagagagtacatggcggaagagcactctgcacggaggactcttggaatgcgaggttcctgatcacacttcatgtatcgataccaactaggtcacctaatgcaacgtttcagggacttttcaaatggatcctaggcttggatccctgttccctgtaccttctcagcaatacacaggatggagcaagagaattcccgatggttcattgggcgaccttcacttaacattcgacagaggcgctaaagtggtggtgccattaaaccttttcactaaatcttcgaaaaatttggttgctggccttccctttctggacatggttttttattgctttccaagaattttcaatggaagccttttgctggcctctggagcccacaacttggcttaccagtgtaatacgcttcttgcggcaaaacgaagaaatcgttcgggaacagcattactggacattgtggggctccgatcgtaaattgtgtggaggttgccccccagggaaatttggcggacaaacgctagttccgtgaacgtctttcacatatgtgtttctacgggggaacatctacaaaagttaattgtctggcacctaggtgtccgcaactagacgacacaaacaaccacatatgcactcaagcgtgcat

SEQ ID NO: 681756 - DNA, 150 bp, Homo sapiens
gttcatgatgtaatgctctcccccattttcctatgtatgtggcttcctgtgagctgaattgcagtgattgttgtctttcttctgggatctagccacctagcgagtctaccaggctctgagctggtactgggtattcatagatgcgtgttt

SEQ ID NO: 681757 - DNA, 227 bp, Homo sapiens
ttgcccctgacttctgctggtcgtctctagacggactccccctcggggctccttagttaccctactacaattgtgctgggcgtgctggtctgtgcctgttatttttatgctcctctgcgaggctgaggcgggagcatctgctttgaacactggagttggaagttgcatgtgagcacgccactgcactccagcctggcaactagacgtgagactctgtctcaacaaac

SEQ ID NO: 681758 - DNA, 127 bp, Homo sapiens
ctgacctagcagttaccttcgcgtatataaagcagatgttagatcttcacagacttgtgttcttatcagcctctccttttgcttaatgtctcaataatggaatggtcagggtttatgataccgcgaa

SEQ ID NO: 681759 - DNA, 440 bp, Homo sapiens
  misc_feature (57)..(57): n is a, c, g, or t
caaaaaaaaaaaaacaaaaaacaaacctcacagccccagaggctccccagtcctcancagtcttgtcagcctcagaacctgcagctaccttctctaggctcaacaagcacattttcctttgcccatcattcccttaaaaattctgccttggccgggcacagtggctcacacctgtaatcccagcactttgggaggtcgaggcagttggatcacctgaggtcaggagttcaagaccagcctcgccaacatggtgaaaccccggctctactaacaatacaaaaattagccaggcatggtggcacacgcctgtggtcccagctacttgggaagttgaggcaggagaatctcttgaacccgggaggcggaggttgcactgagctgagatcgcaccaccgcactccactgcagcctgggcaacgagcgaaactccatctcagaaa

SEQ ID NO: 681760 - DNA, 278 bp, Homo sapiens
taaattctcgtggcacagggagttaaggatctggtgtgtcaccacggctgctgtggctcaggtgcagtccctggcccagacttcacatgccatgggctttgccaaaataaaataaagtggaaaggtgaaagttctcaataaggaaagaaaaaaaatcataggccgaggttgctaatatctatggtaagaatgaattggctgtcaacttgtgaagaaaaaaaaaccctcgtgctagcttggtggtcacacctcaaacggcaaaagttacagccacggtg

SEQ ID NO: 681761 - DNA, 258 bp, Homo sapiens
  misc_feature (28)..(28): n is a, c, g, or t
  misc_feature (74)..(74): n is a, c, g, or t
  misc_feature (81)..(81): n is a, c, g, or t
  misc_feature (139)..(139): n is a, c, g, or t
  misc_feature (160)..(160): n is a, c, g, or t
  misc_feature (256)..(257): n is a, c, g, or t
cgggtaagagacagggtctagctttttntccctgagtggaatacagtggcatcatcatagctcactgcagcctnaaattcntgggctcaagcgatcctcctgcttcagcctcccaagtagcaaggactacaggcatganccactatgcccagctattttnttttattatttgtagagacagcgtctcactgtaatgcccagactggtcttgcactcctagcctcaagtgatcccctgcttggctctgaagtaccgnng

SEQ ID NO: 681762 - DNA, 350 bp, Homo sapiens
agaaaccccgggtttttaaaggggtttttttggggttttaaccccttttttaaatgggcccgcccccgggggttcggcctttgggggccccccccgggtttttttttaaggggaaaaatactgaaacttttttggttggttggttaaataagggggggtttacttttgggccggttttttaagggggggggggttttcccggttcccccttccaattttttttggttccctttttaatttggtcttggtctggttttaaagcccggggaggggggtggcctttttggttttgccaattgccaggttttaccccttttggggcaggggtaacccttttctttggcccccca

SEQ ID NO: 681763 - DNA, 325 bp, Homo sapiens
  misc_feature (13)..(13): n is a, c, g, or t
  misc_feature (18)..(18): n is a, c, g, or t
  misc_feature (60)..(60): n is a, c, g, or t
  misc_feature (67)..(67): n is a, c, g, or t
  misc_feature (95)..(95): n is a, c, g, or t
  misc_feature (303)..(303): n is a, c, g, or t
gatttcggcacgnggtgngggcgcgggcaggaggacggcaagacctatttataatatagnctcgaantcggtctccctcagatcccccgcgaganggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaagggggaaatttcaatgtgtctcctgcaaggttntggtccccctaaggcaatcccg

SEQ ID NO: 681764 - DNA, 190 bp, Homo sapiens
gcgctccatgacatctagaggtggattccactgatgaagagcaggcgactagattggagaggaagatcatgctggctgcaaagaagggactggacccatacactgtactgccccaagggagcttcaggcaccaggaaggccctaatttagtcccctccatttccacaaggagattagtaggctgcatctt

SEQ ID NO: 681765 - DNA, 220 bp, Homo sapiens
  misc_feature (157)..(157): n is a, c, g, or t
tttacaaagcttcagaaaaggattggtgaaggcagcagatctcttacctgggagatgtagggatgtaagaaactgatctagatagttagttacttaggcctcggaacctggcctttaatcatccgcgagcaggactgctctctcggggaaggcgggnagggaccatgttaattacccacaagtgtgttgactcaaagcctttgtcattacatctgtactg

SEQ ID NO: 681766 - DNA, 704 bp, Homo sapiens
acccatctatcatcatcatcacctcatctccctcctttctctctctctaaagtatatacatgcgggtatgtggagtgtgtatatattcatttgatgtgtgtttatatggtgtgtgtgtgtgtgtattccgaggcagatgtgtgcatatatacccaaactttcctgagtgaccttgaaatgtaaatgggtcagtgtgaagctaaagattatagaaccaccttgaattcctttataaacagtatttctaagataagatcagcactaagtctttcaaattaggttgactgtgtatagaacaacgttgcgttatttaaagtgcatctagtctaatgcaatcaaggagtaaattgatagaatgaaccagttagcattagatgggaagaaaatagttcgctttgtcttgtagaattcgatttcatgtgtgagatttttcgtgtgcgcacatatggaacatgaatagaaatatggcccatttcaatatgcaaattcagccactatatagttgtactctttctggtagctaataataataacattgtgaacgtcaagatctgattgcgaaatatgaaaagaagtttatcctttcctgtgttaataacacctgataccgtataacttccctgtgtttgattcttgggggacattcatgttcacacgttctgtcaaagcaatctattattcttggtttacctgatggatcatgg

SEQ ID NO: 681767 - DNA, 418 bp, Homo sapiens
attgtccagctcgaagcccaagactccaggcaatgcggtcgccagcgctcgatcttgaagtcacaggcatgtcatttcgtgcgcacacatattttcatagatctcgcttcgcgatatgggcacgcccatcctccatgtataatgccctgcttccggataggcgtcttgcatgcagatcaggtcaagcaatgcactgtcccaagtcctcttcagggccgttcatgattcatcgcctgtgatcttcttcttgcagctttgcacagctcgagatgcatagcgcatgttctaacctttttcctttttaaaggggcccttctcctcaaagaagccaaccctcttccaggacccttcccacactggctacacacaaactcctccgggtggtacgcgtggcccagcgccaccaggtagcggcccc

SEQ ID NO: 681768 - DNA, 1438 bp, Homo sapiens
caaaccttagggctagggtagcgaggcctgcggggggtttagaatcggcgaggctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681769 - DNA, 1684 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggaaaaaaaacaaaaaaaaaaaaaaaaaaaaaaaaaaaaaaaaaaaaaaaaaaaaaaaaaaacaggcgcgcgcgcgcgcgccccgcgcgcccccaaaaaacctttaaaaacacacaccccgggggggcgcggggccgccccagagaaggaagagggaaaagagggggaaaagggggtgttcccttagggaaaaccggggggaaagaaaaaaagggggggggtctctcccccaaaaaaaacaag

SEQ ID NO: 681770 - DNA, 1806 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcaaaaaacaaaaaaaaaaaaaaaaaaaaaaaaggggggggggaaaaatttcccccggggggccccaagttaggggtccccggttttttggtcccagggggcccgtataggggggccgtatttaaaaggaaaggacagggcccggccgtttataaacacgtccgtcactgggaacaaagctgagcttgggaccctttgaggaaaggcccttaactttctgggggggcgcacatacttcgacaaatacctaaagggaatttaacggctccaggaaaattaaaatttccactgtttagggggtgaccaacgctgaattgtggggtgaaagttggtcacgattgtttacattcgggcttattattaattagga

SEQ ID NO: 681771 - DNA, 964 bp, Homo sapiens
  misc_feature (134)..(134): n is a, c, g, or t
  misc_feature (620)..(620): n is a, c, g, or t
  misc_feature (667)..(667): n is a, c, g, or t
ctttccatctctccccagacgagccgtgagactctgtggaccggtagcagggagcagggtttctacagctgctccccactttctcggacccggtcctggacccagcccccgactccgacagcggactccaccantggagtgaggcgagacacgaagtccgtcatcacattcgctgtcgccaggtccggctacggcaggttaccgtccagcatgtgctaggaccttgacgcgccttcatccatctgagtctggttgtacgatggctgtggtccgctgcctgcgtgtgatctaacccgtgcgtgtgggctcttgggccatcaagctccttcatgcgtgctcgtcttgcccaatgtcgtgctcgcggttcgcgctcttggcccatagagcctgggctccaggccgtgccgatgggacctggggcctatcccgtttggtagctgtggcttgatcagaaacttgccgttctaatccgccagattgaggcgctgaacaccgtccggagcaccagtgctttgcttccttcgtttgggcctgcagccgttgcgtgcccctagcccggatgccgctcctgcagggattgcctagaaccccaagtcgcatgacagcgctagacatccagncgtagtatgcgtctcgtaccggggcgcactgtgtgcgagcccgaaanttccggcgaccaggcatgagcacgtgcccgttgcgagattcccgggccgccaagcattcggcaactcaccagagcatggcacgcacccttcccagggcgctcgtggcgctcgcgacgcagtcctcttgccatggcccaggcatgagctggtgtcagtggcctaggaacttgacgtttcccagcactggtgacgcctgactggggatgtgtcccagcgcggcagctcccgccgtgctggactttccaagcttcccgtaccccagagtcgccggtcagccctggtttggacagggcgtg

SEQ ID NO: 681772 - DNA, 1516 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcaaaaaaaaacacaacaaaaaaccccgggggcatataaggggggggggaaaagggggttgaatgggccagggaaaaggg

SEQ ID NO: 681773 - DNA, 1585 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcacaaaacagaaaaaaaaacccttcggtgccgggcgaaacccagccttgggaaagcccagggcccgggaagccatgggggcggcacgggggaacgcacctgggtggaaggcctctgcccaacggccccccgggggggccctagggccg

SEQ ID NO: 681774 - DNA, 424 bp, Homo sapiens
  misc_feature (41)..(41): n is a, c, g, or t
  misc_feature (63)..(63): n is a, c, g, or t
  misc_feature (74)..(74): n is a, c, g, or t
ccctcctactagacttggcctttaaatcaaatagttgaacncttcagtgcccagatacggtanaattatttaanaaaagctattttgatttttactcagtttctcagtgggtaggaaagtgtcatatattaaaacttggggccaggtgtggtggctcatgcctgtaatgccagcactttgggaggccaagccagaaggatcacttgaggtcaggagttcgagaccagcctgggcaacacggtgaaaccctgtctccactaaaaagacaaaaagcttagccgggtatggtgacacacacctatagtcccacccacttgagaggctgaggtgggaggatcgcttgaacccaggaggctgaggttgcagtgagctgagatcgtgccactgcactccaccctgggcgacagagtgagacttcatcttg

SEQ ID NO: 681775 - DNA, 356 bp, Homo sapiens
ggaaatttgtttacgtattgaatctctgaatgctctatgaaaggaatagcatgaggtgctcgttcgaatcagatgttactgctaaaatttacatgtcgtgatttgaatagtgttgaagaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcatgaaaggactggacatgaa

SEQ ID NO: 681776 - DNA, 1468 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcaaaaacgatctcagcctccagcttgacctt

SEQ ID NO: 681777 - DNA, 1605 bp, Homo sapiens
  misc_feature (1590)..(1591): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcaggtacctttgggacaggagccataacaagtcgcagtccaacaaaacaccacacacacaaaaagggggggccagaacccagggcaagcacaccactttggacggccacaaggctaaaaacgggcggggcaccgaggaacacgggtgggagcaccgggaagcaccaaacagaaaaggggcctccggcgcaaaaaaaaanngacaaacacacacc

SEQ ID NO: 681778 - DNA, 1106 bp, Homo sapiens
  misc_feature (190)..(190): n is a, c, g, or t
  misc_feature (197)..(197): n is a, c, g, or t
  misc_feature (227)..(227): n is a, c, g, or t
  misc_feature (237)..(237): n is a, c, g, or t
  misc_feature (239)..(239): n is a, c, g, or t
  misc_feature (264)..(264): n is a, c, g, or t
  misc_feature (335)..(335): n is a, c, g, or t
  misc_feature (618)..(618): n is a, c, g, or t
  misc_feature (1106)..(1106): n is a, c, g, or t
taaggcagtatgtcgaccgaggccgtctgcgagcctctccgcacgctcgcgcagtctccgccgcagtctcagctgcagctgcaggactgagccgtgcacccggaggagacccccggaggaggcgacaaacttcgcagtgccgcgaccaacccagccctgggtagcctgcagcatggccagctgttccttnccctgcntggcagccctggtcctggcccaggctcctncagctttagncngatgttctggaaggagacagctcangaggaccgcgcttttcgcgtgcgcatcgcgggcgacgcgccactgcagggcgtgctcggcgggccctcacnatcccttgccacgtccactaccttgctgggcaccggcgagccgcgggctgtgctgggcgtctccgcgggtcaaagtggactttccctgtcccggggcccgggaggcagaggtgcttggtggctgcggggagtgccgccgtccaagggttggaaccgagggctacacggttcccgcagtgtgcgactggcttgcgtacccagagtccggctcaccgacgtctccctggcgctgagcgaggctgggccccaacgtactcacgggtatctatcgctgtgagggtcnaggcacggggatcgcatgacagcgagcgaccgctgtggagggtccaggtccacaggggttcgtctttcgtctaacgagaagggcgtctgcgccggctatgcggtttctccgttttcctggggggccaagaaggcctgttgcccgcgattgaggaccacatctggcacccggagcaaggttctatgacggcgtaccttgggggggtattgaagcccacgtgttaaattgcttgggcatgagcttgagcgagaatccggaaacagcgggcagggtattaccccagatcgagaaaccccccagagaaagaggccgtcgtataccggagacacaatggaagtaggggttacacccccggggtggtcacggagacacatcgtgtagtaggtgggaggcccgcagcaagtatcgcaccacataataggagtcacggatataggctcgtagaagcgacaaatcagagtaaacatagtgtcctgggttaaccaccn

SEQ ID NO: 681779 - DNA, 1362 bp, Homo sapiens
agcgggctcccggctctcgcctcactagtgagcggctctcggtgcagcgtggacagtggcgaacactggcctgcgcccacgagagcgcgcgacgctgccctggaacgggacctgccatccttggccccctcagtctgcccactctggtgatttccatgcgtgctctcctggcgcgctgcacggatgccctctgtggcctaccaggccacggccggcgagctggcagctagtcgtccaggacctgccaccgtcgtcgggttccgtccagcgtgagttgactgctgggtgctgcggtgagcctgtgggttctgcctgctgcctggctttgcttcaggctagccccgcgcatactcggtaggcgacctgcgtggcttgtctcggactctgacgtgtccactgacacgccagcaattcctcggggggttgactcgaactcacagcacccacgtatctgcgttacaggccctgtgcaatgaacaccgaaataccctcgggctagacggcgtctgcacctgactttaccccatggcacatcgagacttgagccccacagctggtggcataacgagctctcaaggtccccagtgactccacgccctgttactggcgccggctgcttcctaaccgtagccccacgggaaggctcacgcaactgtacctttcctgcgcacgctttctgccacacccccagacactatacccagcgaaggcgcagcctctatccacctggggcacccatacaatggtcccaccgtcacgtacttccccgtacaaggcacgcgacgtaaatacgcaactagacatgcagccggattcggcgggaagccacggcagttactgcaggaagcatacgcacaccgcgctggcagacgccaatgagcacaggcggcttcttatataacaccaccttggttgacccttctgcaacggccttaaacgccacgacctactcgcctcaccctctgggcagcacaaacgccttttgctcggcaacgcactgtgcacttgcaaaccagtcggcccgcgcagcctttgacaccctttgcacactatacacaaggggctcattgcacacgttggtgcagcgtgtgcccccgcgttgacacttggctccccgacacgcacacgagacacacatatgggccaccatccggctgttgggaacctttgcacaccttctcctaacctaagacgtctggtaggtataacgaacgcccgctggtgacacccgtgggccacaccgctttggacagccggttgtcaaggccgacatgacaaccatgccacaccacaggcctactttgaaacgactgtggcgcctttcacaagtcttacagaccatggtgttgcgagacacccatg

SEQ ID NO: 681780 - DNA, 903 bp, Homo sapiens
accacacattatttacgaaactgtctttcctctctaaagcccttactaaacaaatctgtctctaaggtttcccaaataagtctcccgcaaattgagaataaccaatgctccggctaaatcaacctcgacccccctcggggttatacccccgccctcttggccctttaacccccccccctctcctgctagtaagatcgccgtcgcccacaggcctttgattccgccgtcgttttccggctcaccccagggccctttccttttcgggaaaaccgctgctttactataatctccggaaccccgcatattcttagtaaaacccgttgggcaacccgctccacacttcccgggcgttggaccccaatgagaagcattcaatacgggagtggataaagaccccctcttttcccccccccatgggctcgaaccccctaaacccgctgtgttccccctattagaggccccccctcgggccaacccgcataatatttgaaaatctgcggcacggccccttaggaaaactgggactattatcaccccgcgaatatctccgcggcggaaatctaagcccccaccaagacagccattgtcttactgcgggcaagagttttaacaatgcaaggaaagtttggggaacaccaatactaaaaagtgggacaacgcacttgtgtggacaccccgcgctgggaattgtccccacttgtgttgatgagatggaggagagggaagtgcttctctcaaacgttaggcctccttctttatttacgccctcaatagaaggggataacccgccttaatagtgtcatcagaagaagtgacaacaccgttctgcgttctcgactttctacccaccagtgtggaacaattttatccccaaaacaaattttacaaaacaaaaaacataac

SEQ ID NO: 681781 - DNA, 1422 bp, Homo sapiens
  misc_feature (1393)..(1393): n is a, c, g, or t
  misc_feature (1403)..(1403): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaaganggtatcattnggagacgaggccacattcg

SEQ ID NO: 681782 - DNA, 470 bp, Homo sapiens
  misc_feature (75)..(75): n is a, c, g, or t
  misc_feature (422)..(422): n is a, c, g, or t
tgatggcgctgatgacaccaccatgcccggttccagcaccgtgtcgatgtcctcgcgcagctccagccccgcttngcggccatagtagtggctcaaggtgccgaacgagtggccatagccgaaggtgcggtactgcagcaggtcgtggcgcaggaagatctcgttcagttcccgagcgatatcgctgcagcgcatgccggggcgcaccagtttcagcccggcttcgtgcacttcgacgttggcctgccacaggcgtaggtactcgtccgggcagtggtcgaggaacagcgtgcgctccaacgcggtgtaatatgccggcgatcatcgggaagcaattgaggctgaggatctcgcttttcccacccggcggctggtcacccgggttatgcgccccatcggtgttgaacccggactggaaccangtccaaggtgttatcagcgccattcaggggatcctctagaagtgacct

SEQ ID NO: 681783 - DNA, 1475 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgcgctgctggaagatggggagacttaatcttggtgatgcctggacagagaatcatgcaacatcaaagacacacccgcggtatggtggcatgtgttggacctgacccaagtctgaggcttagcaccagaacgtccttgggggcgggcctattccgtcaaaaaaaaaaactcggtcttgggggaaaggtaagcgtctttccccttaggattgcttgttagcctcatcacgcaaaaagaaagaaaaatca

SEQ ID NO: 681784 - DNA, 317 bp, Homo sapiens
cgctggtcacttattgttggcccaggtcaggtctcccaaaggagtgcccagcaatcgctttcagagtctcctgcagagtcaccatcaagcagacctcttcctcgggaggccgtgtcgccaccccaaccctgtgacttctggtatcaccatctgctgtcacgctgggctccagtctctgtgcgatggcctcaacgggacatcaaagcatagctaccagtttgaaggtgccctcaggcttggcaggaaccacgtggacaaaagtcttgtagagcacagcacccttgggcagcctggtgatcagatccacagcctccgtg

SEQ ID NO: 681785 - DNA, 1421 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgcgctgctggaagatggggagacttaatcttggtgatgcctggacagagaatcatgcaacatcaaagacacacccggatagtggatggcaaagtggtgtctgagaccaatgacaccaaagttctgaggcattaagccagcagaagcagggtaccctttggggagcaggaggccaataaaaagttcagagttca

SEQ ID NO: 681786 - DNA, 334 bp, Homo sapiens
  misc_feature (1)..(1): n is a, c, g, or t
  misc_feature (230)..(230): n is a, c, g, or t
naaaagggataaagcaggctgctcgtagtagtgatgctcaggttctcttccacgctcacgctatgggagtatgtttttttgatctttgagtataacttgctgctgctcattctttgggtacacactgagtttatgagctgtaacactcttcgtgaagctctgcagcctcaatcctgaggccaccgagaccatgaacccatgggaggaatgagtaactccagacgcgctgncttaagaggtgtaatactcactgtgaaagtctgcagcttcactcctgaagccagtgagaccacaaattccaccaggaagggaagaaactccaaaaaagtctgaa

SEQ ID NO: 681787 - DNA, 103 bp, Homo sapiens
tgtcccagcttgtcagtctccaccatacactgaattggtagcttcctggatacctgtagcccacgggcactagctaagaagccagccacaccaccagaggcaa

SEQ ID NO: 681788 - DNA, 122 bp, Homo sapiens
gcgcgccatgtatcttggcatgcccgtatgtgtgtggacgcggtcaagatgtgagagaagttcaaaacatggtgccccataggcagcatacactctgtacgggggacatctcgtgctttttt

SEQ ID NO: 681789 - DNA, 390 bp, Homo sapiens
atttatctggtatcttagcttattcttagtctggctaaaggttgtcaattttgttgaacttttcaagaaaccagtggtttgtttcattgattgttcattttttaaagtttcaatttatttgttctctgatctttattagctctttccttcaactaattttgggtttggtttgcttctgcttttctcatttttttaagatgcatcattagaaggtttatttgaagttcttcctttttttgatgtagacagttatagctataaacttccctctttgtactgcttttgctgggtttcggtatgttgtgtttccttaatcatttatttcacgaaatttttcaatttccttctcaatttcttcattgacccactggtcgttcaggagcgtattgt

SEQ ID NO: 681790 - DNA, 409 bp, Homo sapiens
  misc_feature (1)..(1): n is a, c, g, or t
ncccctcacggtactcaagccggggggacagagactccgtctcaaaaaaaattattaagcaacttatacacatgtgttcatagcaacactttttacaatagctaaaaagtggaaatatcccaaatgtcttatcagctgatgaagggataaaatgtgatgtgtctgtataatgaaatatgattcagccataaaaaggaatgaagtattgctatatgctacaacttggacgaaccttgaataaatgagagaagccagtcacgaaagggcacacattatatgattccatttacagcatatgaaatatctggaataggaagatccgtagagacagaaagcagatgggtggttgccaggggctgggggagggagcaatgtgcgaattactgcttaattgatctagggtttcctt

SEQ ID NO: 681791 - DNA, 623 bp, Homo sapiens
gttgtggtttgttagagggtattgtggaaagtgtcatagggatgtcccgtgtgttgtcccatctgccctccctgtttctccacaacagcctggggttgtccccgctgggctcacgcgttcgtgggagctcaaggccaccttggaggaggatgccagcgcacttcctctctcggagtccctcagacatctccagatgtgccagacaaataggagtgagtgtatgtgtgtgtgtgtgtgtgtgcacactgtgtgtatgagtgcgcataatctggtgcctgggatcgtgcatccgaggggccagggacaggcttggtgtgcagagggagacggacctgcgtggaggcttatgaacgcttctcccttcttgggatctgccctgcccatactgagcctgtcaatagtgcctggtgatagcccatcgcagattctgaaacgggccctctgtggactgtctctattatctgggttccgggaggcgagagaggagtgaccgggctctggcactgagatcatggaagatgggacccctgatactcgttgcaaccatgggtggttagtgagagcctcatatggctgctgtggaacatctgtgaaagagcgttaatccactatgcgaaattacc

SEQ ID NO: 681792 - DNA, 238 bp, Homo sapiens
  misc_feature (26)..(26): n is a, c, g, or t
gtgtcatccccttcgtgccagctctnattccactcaaatagctgcttgtcaaggagggcaggagcactgtttgatagtaagaaatattccttctggaggttgtctcaaccagtaagacccctgtcctaacaagggacacactctgggtattcagtccacacggactagggaaaagggacaggctttcaacaagggggccaaaggatcaaggttctaaaggattctgattcttgacgaa

SEQ ID NO: 681793 - DNA, 109 bp, Homo sapiens
ttaaaggatagaagtatcacgtgcgcaaggcataggcaagtatcggggcatcaggcaagtatcggccctgcaatgtgtgtctgctgtgagaagcgtccacttgagccgc

SEQ ID NO: 681794 - DNA, 945 bp, Homo sapiens
  misc_feature (386)..(386): n is a, c, g, or t
  misc_feature (416)..(416): n is a, c, g, or t
  misc_feature (427)..(427): n is a, c, g, or t
  misc_feature (468)..(468): n is a, c, g, or t
  misc_feature (522)..(522): n is a, c, g, or t
  misc_feature (556)..(556): n is a, c, g, or t
  misc_feature (560)..(560): n is a, c, g, or t
  misc_feature (562)..(564): n is a, c, g, or t
  misc_feature (619)..(619): n is a, c, g, or t
  misc_feature (621)..(621): n is a, c, g, or t
  misc_feature (642)..(642): n is a, c, g, or t
  misc_feature (647)..(647): n is a, c, g, or t
  misc_feature (649)..(649): n is a, c, g, or t
  misc_feature (670)..(670): n is a, c, g, or t
  misc_feature (677)..(679): n is a, c, g, or t
  misc_feature (681)..(681): n is a, c, g, or t
  misc_feature (686)..(686): n is a, c, g, or t
  misc_feature (732)..(732): n is a, c, g, or t
  misc_feature (738)..(738): n is a, c, g, or t
  misc_feature (740)..(740): n is a, c, g, or t
  misc_feature (743)..(743): n is a, c, g, or t
  misc_feature (748)..(748): n is a, c, g, or t
  misc_feature (755)..(755): n is a, c, g, or t
  misc_feature (760)..(760): n is a, c, g, or t
  misc_feature (771)..(771): n is a, c, g, or t
  misc_feature (781)..(781): n is a, c, g, or t
  misc_feature (784)..(785): n is a, c, g, or t
  misc_feature (793)..(794): n is a, c, g, or t
  misc_feature (853)..(854): n is a, c, g, or t
tgcctcgggtacaagtccgggccatatgtccatctgtcaggggctcagggaatcttacccagccacctgtcctgggatggaggggtcagctatccacccccttggtcgtcatagagaccgccattcccagtcatggatgaagatatttgggccaccagggctccctggcccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaattgtttttggaattctgtctctnggaaagctcaaagccaggctagcctgaggntggcgcagggntctccttccggtcccttcgatctccttgagaattaagagcnggcagctgctgatggtgtttcccaacccccctcatttcccaagaaacccccagnttcaggtcctcatggggaggggagggcacgtctngatncnnngggaacttcgctcaggagggcctccctttcccttctccctcagagttttcactgncngtctcgtctttagaaagctgntttgnanttccccccgcccccagttggnaccggtnnntntaccngggatatacggattttcctcttggtgcaggcttcttatgccgtggntatacngngcnggaangagaggnctcangggagagaccngtgtggaacnccnngggggttnngcttggttccttaactaggtttgtgcgtgcccacctttcctgcctgggttgtgcccccnntctccttggcaatggcgggctcctggcctcctttccacaggtgtgccatcccgtgcttggccgttgtggtcttccccgtgccttggtctcg

SEQ ID NO: 681795 - DNA, 845 bp, Homo sapiens
ctgggtaacatggtgttggccccactcccagatccgggaccccaagcctggctgtagccccgtgagcccttgccctcagtccctgcggagccctcagcttgtgacaatccctacgtcccttccgcaaaccgtgtgggccctcgtgagaacccacatgaagcggctgttggtgccagtggggaagagtgggagttcgaggatgacgatgccttctaccgggtggccgccaatgtcttccagcagaccagtctcctgcccggagggcctgtggctggtgggtgtccgaagtgggagacaggactcctgcctggatggccagctcacactgcctagaccctgcgccatgtccctgacagacaggggagttgatgagctacgtgaggcattgtgcttgagctgcctgggtgggtggacttgggtctcttggcgggcctgggcagttggctctgggcccagcggactgtgtggcacttagcctaccactatacctgtggcagtgacgcgaggcagactagctcaccgcaacagcgagggacaatggggcctgactggtcgagggtccccaagagacagagcgaaagtgatggcgatgttatgaccttgggggtcgccttcaatttgtaggatctgattaccctttcaccggaagggaagcaggatcgctcatccactgcgtatgccctcttggttccttgatgtgggggaagtcattggccccaggaaccaggccagtggaaccaaagagggctcgtgattggtcaagggtttgtgcccacggtagcctcagggcccttggtagaaaatgggcccagggtaaggggggtgcctccctccccttggagact

SEQ ID NO: 681796 - DNA, 276 bp, Homo sapiens
accatcatcagtttgcagcgttgcatgtcagcaaaaatactccaggacattatcatagtctctgacagtcttgatgcagatagggggtgcccatcttctgtgctctgtggtacatatctagtgtcgccaaagtagcgtgcacggtacagcaagccttccttctgctgcttctccttccagaagttagtaccggaggtaggcgatataatcatactatccacattccgctcgactgttttgaggctggagcatgatagtactcttcggaaaaagtgt

SEQ ID NO: 681797 - DNA, 271 bp, Homo sapiens
cgggggggcccggggttttttgtcccccccctaagaatccccattgccccctttgttttttcccgtccccgggggccccgggggttttttaaacccggcgggggtttttgggggggggataaaccctgtttttggggcccccccccggttaaacctaaaaaggtcttttttttttttaaggggttggggttgggtcctttccaccccttgggcctgaaaaaatgaaaagggggactttgggatccttttttccattaaatttttttcccca

SEQ ID NO: 681798 - DNA, 307 bp, Homo sapiens
agtgtaggtagatgttaagcaggcaagcgtgatcctggtgtctcttactagagaaggtggcaggtttcctcagccttttaccgtggtgctggctttcccctctccccactgtcctcacagatcacagcctcaaactgaaggtgtctggcttcataactagcaccaccttcaatctctgcctgtggaaagtcacctgccatctttcgaggtccagctcaaacgcgacctggtctggcaggccttctttgatgtccagcccacgtctttctctcttctgaagtcccacgacccttgaaattgccccggg

SEQ ID NO: 681799 - DNA, 1722 bp, Homo sapiens
  misc_feature (264)..(264): n is a, c, g, or t
  misc_feature (515)..(515): n is a, c, g, or t
ggcaaagcttcgcaagttcagaagcacagttggacgcctgaatgggcgctcaggtagccgagacgagcgggtctgcctgaagaccaggacttcgtggataggatgccgaagatataccaggacataagaagttaggggcgcagaggcaggaccgccgggtaggacaggcgctagcgcgctacgcagggctctctagtctctctctccagtatccgtctgtcgaggcgcctcacaataggatggtcttcactcgttgatcagganatcggctatggcagtgaacgcgacggtagtaccggatgtgagctgcgagagagaacggacacgcaacagcgagcaagtaatggatttcacacgagattgtccgtacgtagtggttcgaatacctcttgcatgtggagagtagagcgaaatacaggaagtcatacatcgcccaggaacaatcaacgcacatatagaatatcagttttcacggttctctaggcgccggagtgcggcgatagctccttgaccgntggatcgggatcaactcacgtcacgccaagggggaaaccgagaggcacacagggcacttacaccaggtgccttaggatgttagaaacacgtgtgccagcaacggcaagcgattgcgccaggaggatgtcgaaccacgtaacgcgcctataagagtcactactccgcaacctcccactgtcacgtagcctggtaccgcgagttgaccggtccccttcgagcttgcgaggggcccaattcgaagcgcattcaacgcgaagacaacaaatgcatgaggaattagaacgaagctgttcggggaaaccttgggcggctcttcctatatctcattccatcgtggaactcccattcataccttgggacttttcttccaagggaaccgcaagagccccacccatggcaccatcacggagttccccttaagagggtccacccggtagtaatcccgttccacccgtgacggattgttctggggaagtagggagcaatcggacagcaaggcttacgacccaccaaggccaaccaattcgacatggcccacgggcttggcattagtttacacgcgttacacccacacatggggctttggcaccttggtcactattaaggaccaaggcacgatttcccacaacgcttacattttgacgcaaaggccaagtggcgaggcaagcgaggcgatcttgcgaggctcgacgccggatcgagttgacacaaacggtcacagcacgctcagttcaggaaacatatgtcgaacaggcgcaaagcacatctagtggacgagatacagaagaagcagacgaaatacattgctgagcacaatcacgatcggtacacaccaaacactctcggcgaaacacaaaaccacgcggcgacacaccatgatatctcaccaacacgtaggtacacagtcgggacaccatcaccacacccaccgacaccgagtagccaacgagggggtactcacaaaagagtctggggcgcacgcaccagccgaacaccaaagatggaggcaagggcacccatggttacggcacagcaagggcaggacgtggacagagttagccagtagtgtgcgagtgtacattgtgagtggggtatataagcgagcagacagacgaccacagtacacaccatgcgagcgaaaatcatagacagggcacacaaggagcaacggctacaacaagcgccacccacacagagagccagtag

SEQ ID NO: 681800 - DNA, 99 bp, Homo sapiens
ttaaacattacttttcatacttgaaataaacatttagttttttaaaaaataaatgtttatttcaagtatgaaaagtaatgtttattttttaaaaaacta

SEQ ID NO: 681801 - DNA, 1122 bp, Homo sapiens
agcggggagagagaggatccagcgctggagagtttttttgtttgtattttttttaatggagtccatggctcctgggccccgaaatgtctttatgctgacgaaggagtattcggcggcattctcacaacgtggcttcatggatgactagaacaccagttgattctcgaagagtcacctctgttgccgggagaatgattggggctggctgcatgtcaagaggaacgattcattcttctcccatgtcgtggtgaagcttcggggacaaggggggtgtgtaattcaggtgcaagggagaccttggggttcggggggacatttcccattccttatctgctcgatggggaatgggggggccgctgtgaggtttcctgtcatgggtgagctatctctcgaggagagggtggccctgtgggagacgttaacagtgtgtaagctcttagggctcagggacccttcttagagaacggttgtgtgtggaaacatcctagttgggtgtcaacacttacgtgagccagacaatagctagtagaactgtagccttggcgcgctaaaagtgtgtctgtcgcgttcccacaggggtgtgttctacagcagacagtgtctaggtgtgtaaaagtgaaacgcgggtttgctgtcccctattaacctaggatttctcgggggggatgaacgcggtggaattctaatacggtgagtggttgtgaccaaagacctattgggtagcgcggagcgaatagaacctcgtgggggtttgtgcggtaaaaagatatggccaataacacctttgggtggccggggtttgttgggggagaaacgattggtgatttgggccgatatacagctaagcgatatagaagggggagtggcccggtcttatagaacaagcgcgccctaagatattttgagccagcgaaagggatcgtactggaggcttgtggcaacagccctcagtgcgatgtgcctattggcaccccttttttgagcagggccgcgaaaatgtttaacccatgtgggggtctcacgtgccccagaaaggggggcgacaatttgaacataggttggcaattatccccccattcgctaggaaaacgagacaaaggttataggacggggggaacactt

SEQ ID NO: 681802 - DNA, 364 bp, Homo sapiens
agcggatgggcgcgggggcagccgcccggcctctccggcgcgccccctcgccgggggtgttgacgccccccagcccctcatttcccaaagctccggtggtctgcctccttgtcccgcgcgcgctgtcagaccgatagagcggacccgatagccggatctggagacccgatcggtccttccttttcaacatcccggagcccgagtagatgaaagaacgtgctgcatggagccccaggaagttattcggagtaacaatgtaattgtgaagatcctgaatatcatgatgatccaatcgcgtgacaaagaaagagaaaataaagatgtccaacaagaaagtgaactgaaagtataacaaaacccaaga

SEQ ID NO: 681803 - DNA, 851 bp, Homo sapiens
  misc_feature (17)..(17): n is a, c, g, or t
  misc_feature (20)..(21): n is a, c, g, or t
  misc_feature (609)..(609): n is a, c, g, or t
  misc_feature (666)..(666): n is a, c, g, or t
  misc_feature (723)..(723): n is a, c, g, or t
  misc_feature (733)..(733): n is a, c, g, or t
  misc_feature (740)..(740): n is a, c, g, or t
agcggaatgcgcgcggngcnngaggcaccggctagagctgggagcttgcggaagggcgcccctgcctggtcttgagaggtcgaaggtctccaggaggcctccgcctccctctttttcattcacacaccctagcctcacacgttaggaggacccccccaacagaccgtgagctggtgccgggagggtggaggtagatgtacctcacctccacgctaccacagaagagcgaaagctgctttctcagccaccggagagcacgaagaagaagaagatatactgggcaagttctagaaggattctaccattttcttctttaccatgaacaaacttgaaaattaatgggtaatagttgcatgaaaacttttgaacgttttttcttatctctgaggccttctatggagaattaataggaggttgaatgtgtgcatggataaaatggatcatcttaaaggattgaagttccaaaaatacatcagcaggactggacaggttttatataatgagatttctattttagcttgacttctacaactctgaataagctataaactgagctatacaaggtactaggaaggaagtttctcttctaaaatattctagttgcatatnatatttttcttcagatctttgaaaaagcatattttgtcatcaagttcctacaaaatnagactattagacaccaacttttagtgtataaagtaggatagaaagcagcaatctatnttatactggnaaacaantttaattaaagaaacagtcaccaggaagttaagaagagtaatctctacataagcactggctgagatggcagaagcttctgtggatgcctcaactctgcctgtaacagtgaa

SEQ ID NO: 681804 - DNA, 103 bp, Homo sapiens
  misc_feature (91)..(91): n is a, c, g, or t
tacaaaacatagctcatcatcccacatcatagccaccatcaccctccttaacctctacttctacctacgcctattgtacaccaaccccggncattcaacgcct

SEQ ID NO: 681805 - DNA, 845 bp, Homo sapiens
  misc_feature (17)..(17): n is a, c, g, or t
  misc_feature (20)..(21): n is a, c, g, or t
  misc_feature (644)..(644): n is a, c, g, or t
agcggaatgcgcgcggngcnngaggcaccggctagagctgggagcttgcggaagggcgcccctgcctggtcttgagaggtcgaaggtctccaggaggcctccgcctccctctttttcattcacacaccctagcctcacacgttaggaggacccccccaacagaccgtgagctggtgccgggagggtggaggtagatgtacctcacctccacgctaccacagaagagcgaaagctgctttctcagccaccggagagcacgaagaaggttattccagtcccggggggaaggtgggggtggtagggagaatgcgaagataaggcagcagacggaatgcgggcgctgcctcgcgctgcccccgtgcctggggagccctctcccttcagaaaggctagacctccgggcccggcatccctgagctcttacttgctctggatttgtgatcgctttttgctttttgctcgctctctcacagtagattccttgatacttttctttccggctcctctttctttttccggatgaccgagctctgctttctttgcttgccccattacttcttaaatagatcattgttctgtcacggaaactgctgaacaattcgctctctcagagcccttcgtagtttcctaaacggggccccaanctgcactactctccccatccccagagctcagtggtgcgaaagcgtggctcccccgtggcgctagatagacctgaagttcatttacacactgttaccatacagttggtccatcacagaatattccttcgaactgctggactgcttttccttttgacaggtttgaatgctccatttttactcccatttcacttgttgaaatgg

SEQ ID NO: 681806 - DNA, 300 bp, Homo sapiens
gtaaacttcctattatcattattttgagaagtctcactctgttacacatgctgaagtgcggggcacaatcttggtcactgtaacctccatctgtcaggttcaatcgattctcctacctcagcttcccgaacagctgagattacaggtgtacgccacccgcccggctaatttttgttttttcagtagagacaggtttcggcgatgtgggccagactggttttgaactcctgacctcaagtgatctgcccgcgttggtctctcaaagtgctgggattacaggtgtgagccattgcactccgg

SEQ ID NO: 681807 - DNA, 1411 bp, Homo sapiens
aggggccaccacaccttaagtccgtgtcatgcccggttggccaccccgtttctgggggcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681808 - DNA, 1403 bp, Homo sapiens
cgcgtacaactaggctagtacgaggctggtgttaatcggccgaggggacgcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681809 - DNA, 122 bp, Homo sapiens
aataacagaaaaactgttagtggttagaatttttaagctttaaaaaaccatgaatttgtattggttttaattgcacaactaaaataatgttgatatatacttaagcttaaattaattccaac

SEQ ID NO: 681810 - DNA, 1402 bp, Homo sapiens
  misc_feature (42)..(42): n is a, c, g, or t
atatgctagtagggctggtgttaatcggccgaggctctctcnccggacgcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681811 - DNA, 148 bp, Homo sapiens
gaccctgagcactctaagctcctataacctttgaaacccgctctctacaatactgaccctctctgtgctccatgatgttctcaaatctctctgatttagtccttcatttaataaacattttcttttcttttttttttttttttttttt

SEQ ID NO: 681812 - DNA, 1226 bp, Homo sapiens
  misc_feature (1165)..(1165): n is a, c, g, or t
  misc_feature (1186)..(1186): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggctaggagcctnctaacccttttaccatctatnccacagataggcactatgattaatagggaagatgaaactt

SEQ ID NO: 681813 - DNA, 1177 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggaccgacgtcgacgcggccgcgaa

SEQ ID NO: 681814 - DNA, 1389 bp, Homo sapiens
aatttggctaggtacgaggctgggtgttaatcggccgaagctgagtcctgtcctttctctctccccggacaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681815 - DNA, 339 bp, Homo sapiens
gaagtgttcgttcaagtggtcaatgttatgtatattttacatttaaaaaaaaaaaaagtctaggcgcagtggctcacacttggaatcccagcactttgggaggccaaggcaggcggatcacctaaggtcgggagtttgaaaccagcctgatcaatatggaaaaacgccgtctctactgaaaatgcaaaattagccgggtgtggtggcacgtgtctgtaatctcagctgcttgggaggctggggcgggacaattgtttgaccccaggaggtgaagatcgcagtgagctgaaaatgcaccattgtactccagcctgggcaacaaaagcgaaactctatttc

SEQ ID NO: 681816 - DNA, 940 bp, Homo sapiens
gcacaaggtgctggcttggagcgggtcctcgagtggcaggagaagcgcataccctactctgactccactgcaatgctgaaggggaccctgcgctgccaatgcctgagggtgaccccctggtctgcagagctgtgcgatgcgatccagtgtgccgttagcacgctgttcatgcagctgatccctcaggagctggtgctctatgccttgggccccgcctgttccggaactcctctaggttgtgcactggtttccactttccatcaacagagcagtgcgactcgctgcaggagggcttcttgctcgctttcatgggccatcgggcattctgcgggtggctgctatgctgttccccccgcttcatccccctggtgggtgtgggctcggctgcacttgcttccttgtgctcgtcccgggacagcaccgatccttgcgtgggccttcatttgcccgtacggagccgtacgcggacttcccgcctggtgccatccgggcgggtcctcctactctcgcgtataggcagggcagtgggaccttggtggttgtcaatttcatggcccggtgcgcaggatccgtcatggagtaaggttgtcttggcactgtatttggtcgtcatgggctgtgccaggagccccgggcctgtgcccgtgcgttcggttcccaataggtggcttggcgtttcccacgtctcgttgccatcagggggaggagcctgaggtccggcaccttgcggccacggaagctgtacatgttgcttcattccggggggagctggttgactacctggtgctcggttcctggagtctgcgctggtccggtcacttcccagggcccggagccttgaaagcgtgccgtctggcactggttccaagacacctgttgggctttccccaggccagggcttttaggggcggggtttgcacagcgccgggcgctctgggga

SEQ ID NO: 681817 - DNA, 1376 bp, Homo sapiens
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681818 - DNA, 1314 bp, Homo sapiens
  misc_feature (18)..(18): n is a, c, g, or t
  misc_feature (63)..(63): n is a, c, g, or t
  misc_feature (113)..(113): n is a, c, g, or t
  misc_feature (125)..(125): n is a, c, g, or t
  misc_feature (131)..(131): n is a, c, g, or t
  misc_feature (154)..(154): n is a, c, g, or t
  misc_feature (157)..(157): n is a, c, g, or t
  misc_feature (192)..(192): n is a, c, g, or t
  misc_feature (221)..(221): n is a, c, g, or t
  misc_feature (238)..(238): n is a, c, g, or t
  misc_feature (252)..(252): n is a, c, g, or t
  misc_feature (267)..(267): n is a, c, g, or t
  misc_feature (274)..(274): n is a, c, g, or t
  misc_feature (277)..(277): n is a, c, g, or t
  misc_feature (311)..(311): n is a, c, g, or t
  misc_feature (316)..(316): n is a, c, g, or t
  misc_feature (326)..(326): n is a, c, g, or t
  misc_feature (328)..(328): n is a, c, g, or t
  misc_feature (349)..(349): n is a, c, g, or t
  misc_feature (360)..(360): n is a, c, g, or t
  misc_feature (366)..(366): n is a, c, g, or t
caagcacaccctgatgcncaaggccatccgagggcacctggaaaacaacccagttctggaganactgctccctcatatccgggggaatgtgggctttgtgttcaccaaggagnacctcactgagntcaggnacatgttgctggccaataaggtnccngctgctgcccgtgctggtgccattgccccatgtgnagtcactgtgccagcccagaacactggtntagggaaagagaagaantactttttacaggntttaggtatcacaantaaaatntcnaggggcaccattgaaatcctgagtgatgtgcagntgatnaagactggananaaagtgggagccagcgaagcnacgctgtgaanatgctnaaacatctcccccttctcctttgggctggtcatccagcaggtgttcgacaatggcagacatctacaaccctgaagtgcttgatatcacagaggaaactctgcattctcgcttcctggagggtgtccgcaaatgttgccagtgtctgtctgcagattggctaccccaaactgttgcatcagtaccccacattctatcatcaacgggtacaaacgagtcctggccttgtctgtggagacggattacacctttcccacttgctgaaaaggtcaaggccttcttggctgatccatctgcctttgtggctgctgcccctgtggctgctgccacccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttttaaaaaaaaaaaaaacaaaaaaaaaaaaacacatgtgtgtggcggcgcgcgcgcgcggggcccctccgagaaagactttccgaaacacccattgcgcggtgggggcgcgcgggggccccaggagggtaaggtgaacacgagggggccaaagagcgggttctcccatgaggggaaaacgcgggggcaagagagaaaagaggggcggggaattctctcccacacaaaataaaagaagcccgccggggggaaaccggagagcggttctgcggaacaacaaactcccgagagagggagaattcgcgagagaggcacaataagaggggagctttatataaaagacgggagagccacacagggagagaacctgagaatatacacaatattaagcccccgggattggtggtgggggataaaaagaaaagataataatataaaataataaaaatataaatt

SEQ ID NO: 681819 - DNA, 457 bp, Homo sapiens
  misc_feature (220)..(220): n is a, c, g, or t
  misc_feature (294)..(294): n is a, c, g, or t
  misc_feature (313)..(313): n is a, c, g, or t
  misc_feature (370)..(370): n is a, c, g, or t
taaggaatggagttattttctaagagtttctatctgtgctgagctcaaaagaatgcccactctccataaataaaaagtaaacaaaggaaatgcatcagaaagttggaaaatagtttcatcatgcttctgaagaaatttcttgatttcttggtcatcatgacctatacttgaagtgttgccttcttcggtttccttttgaagaagctgctccagaacccanacaggtagaaaatgttttcatagcgtgacactcataaatggcttggtccccacaaaaaaacaacaaatcccttnaaaaaatgggtaaaatatnatccaaaaaaaatcctataaaaaaataccaaatttccggccaaaccaaaaaatttgnaaatatttaacaccttctgtcatcctgtcactggtgaacaagggggaaataaaaaactttcctttattcaaagaactttaaaaaaaa

SEQ ID NO: 681820 - DNA, 1045 bp, Homo sapiens
  misc_feature (880)..(880): n is a, c, g, or t
  misc_feature (900)..(900): n is a, c, g, or t
aataaggctaggtagaggctgggtgtgaatcggccgaggcgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaatctcaggacctcgccaagatcatggcagacatccgggccaatatgacgagtggtcggaaaacgagagggtnacaagtggtctccgatgggngcccacggtccccccactcgggagggtcgggaaagcacaggagaacacatggaacggaccaaataggctgaaccagggggggccaagaaagagacaacgaccgagaccaaacagaaaaacaccaggaagacacacagaagtagac

SEQ ID NO: 681821 - DNA, 997 bp, Homo sapiens
  misc_feature (926)..(926): n is a, c, g, or t
aatttggctaggtacgaggctgggtgttaatcggccgaagctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaatctcaggacctcgccaagatcatggcagacatccgggcccatatgacgagctggtcggaagaaccgagaggagctagaccagtactggtctcgcgattgggggagccccggggtccccacggtgtggggtnggctggaaaacccaagggagacccggggaaccggccaaataggcgggaacggggggccgccccaagggcag

SEQ ID NO: 681822 - DNA, 650 bp, Homo sapiens
agcggagtgtctcctccagtcgcaacggccagacctgacctgccagctccgggcgtggggtgaaatctcttgattaacctagtctctcgatgatggcacctccgtcgagtctttgccgaggttccgcaggcccaggcgtggtacctggatcgttcaagctcactgccgacgtatcagggaggatccggtacccccggcgaaggtcaacctgggagtgggagcatatcgcacggatgaactgccatccctgggttttgcactagtagtgaagaaagtggagcagaagtattgctaatgacaatagcctaaatcacgagtatctgccaatcctgggcctggctgagttccggagctgtgctactcgtcttgcccttggggatgacagtccagtcactcaaggacgaagcgggtaggaggtgtgcaagtctttggggtggaacaggtgcacttcgaattggtagctgatttcttgagcgcgttggtacaatggaacgaaacaacgaagagacacacctgtctatgtgtcctcagcaatccgtgggagaatcagaagtgctgtgtttaccgctgctggtttgacagacgttcggtcctatcgctactgggatgcacgacgaagagaggattggacctccagggcttcctgaatg

SEQ ID NO: 681823 - DNA, 1339 bp, Homo sapiens
  misc_feature (42)..(42): n is a, c, g, or t
atatgctagtagggctggtgttaatcggccgaggctctctcnccggacgcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681824 - DNA, 225 bp, Homo sapiens
atttacacttccgcttctggcaagcctaaataatttgcctgtgatttttaataaaaaccggatccttccctcatctctcatccaaagcttcatcctcttattaattctaaggacacttttttgaaatggaaaacagcacagaggtggagcagaatacaggttttgggttatttctcttaacagtcctaacccattaaattgtccttgggaccaaggaagttttgg

SEQ ID NO: 681825 - DNA, 245 bp, Homo sapiens
gacgtagtatttgtctgtgtctggcttatttcagttaacatagtctcttccaggttcatccattttgttgcaaatgataggattttattcatttttatggctgaatagtattccattgtgtatatacactatatttcctttatccattaatggacatttgttgattccatatcttggctgttgtaaatagtgctgcaataaacatgtgagtgcaaataaaaaaaaggaaagaaaaagtcgacgcg

SEQ ID NO: 681826 - DNA, 259 bp, Homo sapiens
cccggggcccccccccccaaaggggtttggggatgggggagatttaaaaatggccttttttttttccggggggttttttaaaaaaatttggcccgttcccgggttttggggagggcccctttttccccgcattttaaaaccctaggtaaagggtccccctggggggtcccggtttttaaactttttgggtggggccccccccccccccggggccggggccccgggggggggggggtcccaaaaagtttttgggtgggga

SEQ ID NO: 681827 - DNA, 1705 bp, Homo sapiens
tgggcttgactcaggattaaaaaacgggaacggtgaaggtgacagcagtcggtgggagcgagcttcccccaaagttacacaagtggggccgaggacattgtgatggcccattgtggtggcttttcttaaaatagctcattctccaaattattgaaagtgcattgtgttacagggaagctccctttgccattccataaaagccaccccactttctcctcataagggagaaagtgtgcccagattccttcttccacaagtctccaccaacaggggaagtggtagaatagcattgtgctttccggtgtataaaatatagtgttaagtgcacaacatttctcttttaaactcctctcgcccttaatatatactttttcttcatatattgtgtgtgttataaatatctgtgtgcaatgtgagattggagactcttctcgtgggggccccccctacatttccccccctatatatttgtgtctccccccccaacctcttgcagaaattgtatatgtataaaagagacatatatggagactcactccccgtgtgcagaagtgtggggtagtgtgatggggcaacgcccacaggggggctataaaacctgtgtctacccacccgtgacaatgtgatggagaaaacccccacgtagtgtagcaaactatactacaaacggtgttgtcacacaaccaccgccttttttaatacagaatacacacgagacaagcacaatcataaaacacagaaactataaaaataaaacaatatatcatactaacaaaaacatataaatattacctacacaataataacaatagatcactagaacatatataaatcataaataaacatgaatatatacaataatatactcttaatcttatatctatccgctgacgaagcgcgacgcaaaccaaatacacaagacaatcacaatatatattaacaatactacaactcaacacgctacacataatcatatctcaaatactaactcttcttacttcctactccatcctcactccatacaacactacccaacaaactatatcatacgtcttttcctccatacactcacacacatacagctaaacatcaacaaatcaatcccattcgcacgacagtacatcaccactataactacaaatactttgcatacctgcatactcacatataatataaataacttaatccactgccactactataataaccactagactataatataaatcaacaacactcatctatctattatactcgcacgcacacacatcagaccaataccaataacaacgcataccaacaacaacatcctgtctttcttctataataatatacattacactatagatactgtacatgcacaaacatatatcatattcgagtataccaaatatcagtacacaatactcacctctacacatgaatatcactaatatacttatcattaacaactatcttataacacatgtcaacatctctagacaccatcatataaaaaatagaaaaatactactacacatccacacaatctacaaatacaaaactcgatctaaatcaatagtacacttcacaaagaaaataacaaaaacaccacacaatatatacaataacatcaatacaacaagaacacacacaaacataacacaaacaacataatacactacacacacaacatcaatacacaaaaaaacaaataaacaaaaag

SEQ ID NO: 681828 - DNA, 401 bp, Homo sapiens
cgagctttagtgcggacaccgcgatcggcatagcgcacgtacagaccaaaactccatgggctcaagcgatccgtcccaactcgagcctcccgagtagctgggattacaggcgcccacgggcacaccccgctaatttttgtattttgagtaaagatggagttgcaccgatgttggccaggctggtctcaaactcctgacctcaggtgatccacccggctcagcctcccatagtgctgggattacaggcatgagccaccatgcccggcccaatttttgtatttttagtagagacacggtttcaccatattggccaggctggtctcgaacttctgacctcggatccaaccgactcagcctcccaaagtgctgggattacaggtttgagccactgcgcctggacc

SEQ ID NO: 681829 - DNA, 395 bp, Homo sapiens
gcctgccagagtgtggtctctggacactatgggcacacgactcctgacaactctgttacttgtcctcctggaattgggatttgaggtccaggggacccaacagccccatcatgatgacatgcctagtccgacctttctaacccaggtgcaggaatctatctccagatactgggagtcagcaaagacagccggccagaacctgttcgagatgacatacctgcccgctgtacatgtgaaactcagggacttgtacagcggcacaccagccatgagcacttacacaggcatttttactgaccaagttctttctgtgctgaagggagatgagtaacagtctgaccctccatcagtggacggagagagaccactactcccctgatcacccatgttcatct

SEQ ID NO: 681830 - DNA, 106 bp, Homo sapiens
tctgaaggttatttcgaaagagatttctgatacacagaataatggtgactttcttcaaaaaggatattaatttgcttcccccagtttaacagggcacggaagatca

SEQ ID NO: 681831 - DNA, 129 bp, Homo sapiens
atggccggtgaagagtgagcccagcagaaccacgccggcacagtcatgccgtcaggaaccagctacaacaaagtgttcctggccaagggtaacatccccgccgagagctacaccttcttcaccggccat

SEQ ID NO: 681832 - DNA, 409 bp, Homo sapiens
gacctctctctgtggggcacctggcctggcttcctccaggactcttcgccttcagtggctggaacttcctcaactatttcaccgaggagatggtcgaagcgcgaaagaacctacctcgcgccatcttcatctccatcccactggtgaccttcgtgtacacgttcaccaacattgcctacttcacggccatgtccccccaggatgctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcaccc

SEQ ID NO: 681833 - DNA, 257 bp, Homo sapiens
  misc_feature (3)..(3): n is a, c, g, or t
ccnggtcagccttatattgcaccagctctttgggccttcaaccttcttctttccttgcttgttcccagaaccgggtggcttgagttccacacggagttggagcggcttgccttgccaaggacatacagaccaattgtcttacatcaagcacccagtgttccctggagcaattaccttgattggagggcagctacaacaaagtgttcctggccaagggtaacatccccgccgagagctacaccttcttcaccggccat

SEQ ID NO: 681834 - DNA, 115 bp, Homo sapiens
  misc_feature (21)..(21): n is a, c, g, or t
  misc_feature (36)..(37): n is a, c, g, or t
  misc_feature (39)..(39): n is a, c, g, or t
ggtctgatctagaggatcccngcgctgcgcaatacnnanggagggcagctacaacaaagtgttcctggccaagggtaacatccccgccgagagctacaccttcttcaccggccat

SEQ ID NO: 681835 - DNA, 313 bp, Homo sapiens
tgtcacaaccttgttccacaactaagcttggtgcctttctgaatcagctcttgaacgcttcagtcccataatggaatgcagatgtttcaccaaattatccaattatggaataagtagtgacttgggacagtcttcactaaagttaatgagggcagcagctgcgtggtgctgcacacgttgattgccttggtcttccatggtctgcagcacagctgagatcagcttctcatgacatgtctttgggaaaccaggtgccaatatctgtagccatcttgtcccaatggtataacaggctgcataccttactcttgga

SEQ ID NO: 681836 - DNA, 861 bp, Homo sapiens
caatatgtcggacccacggacgccgaacaaagtggtgaggtacatgcccccgaccgagtcgaatgtaacccggccttggaccgaccgactgccggactacatgagacctgctggagcatgatctctcaggatgtgcggcctcatgcttaagctgacctggtgtgctctgggtcgctgtctacgtgcgtccttcatcagtctttgccaaaatctcgcgagctcggaggacactgaaccaaatgatcgcagtagcttcatgctgtccatctctgccagtggcgactgtcctatcgtgcgagaatcctcagcccatgacgcccccattggggatcccagccatataagggtcgccgtgtgggaccctgttctatccagcataggcctgggctgttggctgctggacctgctgtcttcacctgtcatcctgggaccttccctgcaatgatggtcgtctcggctgcccccacgctggtacgacgggcacctggccgtttccctaggcgacacctacgcgtagccctcctgccctccttccctgcctgatgcctgccgggaacacccccgccactcttcctaccgcgtatcatccgctccacgtgaaccctggcggtcactaaaagttcgccactcctgcgcaaccccacgcccaaccctcaccaacactccgcgcccgcccgccaccaacacattcgtaaccacccgcgacgaccccgcccacgcgtccggaaccgacccccactcccaaaacgcacccacccatgcgcgccccccacacgcagcccacgaccgcctgaccacattcgcacggcacccccccacccagccgtctaaccgacacgcacccctcccacacctcctgcc

SEQ ID NO: 681837 - DNA, 373 bp, Homo sapiens
ggcagagtttcatcatagaaaaagaagccagtggctgtcatgcgcagtcgaggccatgtgtgtgtgtgggtctccagagagagagatttcctataagagttacagtacttgctgtgcgaatctggctgattaaaaggccagttgaatatcctggcatttaggcgagtaacatgtgctcgtcacaacgtacaatgtctgagacaatgaatacgagtagatcagctgcatatcttcatggtctcaagtacctccagtttaatgtaatacaatgtagtgcatagcagtatctcattcacagtgcgacttctgtccaaatacttgtgcaacagcacgttccgaccatggagacgaactccaggtgacattgtcatta

SEQ ID NO: 681838 - DNA, 129 bp, Homo sapiens
cctctcagctgatcttttgccgtaagatctatttcaagataaccttattctatcatattgttttacttaatattggtcataatcgtatcattcaagattaagtctgggtatatttgcttatgataaaga

SEQ ID NO: 681839 - DNA, 1196 bp, Homo sapiens
  misc_feature (320)..(320): n is a, c, g, or t
  misc_feature (818)..(818): n is a, c, g, or t
cgtttgcgtcacgtctgtggtgtgctcttctttctcattgtcgtactttccctgctgcttcacaattgtgctctctttctttcggcggcccttgttctcctgagccgatcagcaacacttttctttcacgcgcttgcgttccctcttgtgggtctcccccgtccggtccccgttttatttggccctcttctgtccaccttcccttgctaccgattggaagttttccccgacctgcgcattttgcccctctcttatatcacaggctctgcccgggtatcacgatttgaggattgacattgaaggattgaaatggggtgtanaaatgcggtaccccacccggaggtccacgttgtttaaaaaggatggataatttggaccgaaggaattggcgccagcccccaattgagaagatggtaagccaagtgttataagagagactttttagaatgaactccctaagcccataatatctttagaaacccagtgggaacgcccggtgtcttgtgttacccctggagatggtgtaaagatgcccttggacccagcttctgaggccccggtgatgattggtttcacccccattggggtttcccccccgttatgatccccaatccgcgccatggaggtttggaacaatataaggagagacatttgtccgggacaccacacagcgccaagggcctccaacacgtccatattaaaagaggcgcacaagagaggcgcgcccaccgcttttgtgtgtgtgtggcgccaccccccctagggagagtctctgagagagaagataccgagagagagccttttcccaagagcttacncgtgtggtgggaaagatattgatatataacacccccaatatttatccgccccaagattcacgcccaaggggacaccgggaggctccacgcccgaggagccctatttaattagccacgctgagggaccacgaagcccgcctgaatgctgtatctattcaccacgaagacccaagagggaggtctccagagattggaagaaaatgatgatgatgcctatttaaactcacccactgggcggagtaacacctgctttgaaaagacacttttcactggagtgaaaagaacacataaaagtggagacccaagatgaagttcacccacgctgatgacacttcccaagagattagctcaccttttctcctaggccattataattta

SEQ ID NO: 681840 - DNA, 1161 bp, Homo sapiens
  misc_feature (76)..(76): n is a, c, g, or t
  misc_feature (100)..(100): n is a, c, g, or t
  misc_feature (108)..(108): n is a, c, g, or t
  misc_feature (217)..(217): n is a, c, g, or t
tcaaccagaaatcttcatgatacgaccacatctacaacgtgatcgtcacagcccatgcatttgtaataatcttctncatagtaatacccagtcataatcnggaggctntggcgaagctgactagttcccctaataatcggtgcccccgcatatgggcgtttccccgcataaacgacataagcttctgactcttacctcccgtctctcctactcctgnctcggcatctgcatataggtggaggccggagcgaggaacagggttgaacaggtcgtactccttccctttagcagggcaactaggtcccagcctggtagcctccggtaggacctaaccagtcttctaccttagcacctagcagggtgtactcctcgtatctttaggaggaccgattacaacttatcattcacacacgaaattatcaagtataaacaacccccctggccattaacccaaataccaagaagcccctacttacggtctggctccggtcctaagtcacagacagatcctactatctacctatctactacccagtacctagactggctggcatcactaatgactactaacaggacccgacaaacctcaaggaccagcattcctatcgaacccgcccggagggaccgagaccccaatacatattaccaaaaaaactatatcttgataataatcggtcaacactgaaagttatcattcttatcctaacagagactacgcgaacaaaaactccccataatcgtaagcctcactcactccgcgaccaaaaaagaaccaatttgagataccctaccgcaaaggacccgagccaagacaacaccaccgcgcctcccaagcggacagcgcagtgaccaacccacgaataaatacagcaggagaataacgaacaacagacacaattaacaagcggaacagaaacacacaaaccccacgggaccagaaaatacaagaaccgcaaacaccagaagaaacaaaagcaaacgaggaaatgaaaccaagaaatctatactccatgaaggcaccaagactaggaaaaaagatataaaagcgtaaaaaaatgacagtacaaacacgaaatcacgcgtgacaacggccaaagcgcgacaccaccttcaaactaatcaaatcaaatgcaacaacagaaacacgactagaaaaccaat

SEQ ID NO: 681841 - DNA, 351 bp, Homo sapiens
ggtcgtggcgcccgtccgtgatgactaccgcacacacacgtgacttatggcgccggttctccttgatgaggcgctcgcaggcaaacttgagggctgagaggtgccaggtgccacctgcaatccactcgaggttctcgacagcctccttgaagctcgacagggagtcgatatgttcgtcgtccagctggatggactcaaaggtgcccttgtggctgtactgcaccacgcccacacgcgtccctgtctcggacttgtggtccttagcgatggcacccagtctgtcgaccactttgatgacgaaggtcttctccagtgagaacttggtgcacccaatgctctagaagctgtcga

SEQ ID NO: 681842 - DNA, 293 bp, Homo sapiens
gtcgactaacctaaccacttctctccttcaataaggcctgcccgccacccaataccctactctccttcacaatttctctgcacatctatcactccagtgtttaattgctacattttaattatttcgccactatggcctatttattgcctacctcccttatcttacctcatttgcacacactatatagactttttctctattgtgttaatgactatgtgtgtgttaatcccatgtgtacctctgtgttgttgtttgttttgcactgctttgctttgctttatcttggtcgacgc

SEQ ID NO: 681843 - DNA, 173 bp, Homo sapiens
ttaaaaggggcttcaaagctactgccaaatgtttgaacaattgtgggccccttcaaaacgggggttttttaaaaaatttttatttttaaactggtaggttcccccaatttaaaaaaaaccccttgaaagggaaaaaaaccatttttgtttttttgaataaataaaccccccca

SEQ ID NO: 681844 - DNA, 807 bp, Homo sapiens
ggtttcagcccctagctggattccagccatggctgcagctgctccacagcccttttcaggacccagaacaaccgcagccgcatgttcccaggattggttgatccgttgtatatattgcatctgtcctctggctcgtacagcgagtataagaagaaacaacaagatgtgcgttggttgtcctagaagccaagcaaaataggatgttgaagaaagaagactattgcaggccaatgaacgagaatcggaagtggatgacgagaaaatgtagcctgaaaatagtcgaccaagccacaggttggacctcccgtgccactctcagattttcaatgaaagccagtgatcgcggggactatgatgccttcgtttgaagccagagaagatagtaatgcgagtgtagtgccattcgttaggctatgacagtgcccacctggattcagataggaagcagaagtgtcatagcaagagcagcaagcgagtgaagccttgaagcactgtgcttttaagcatcctgaaaagatgagtctccatgtgctgttataaaatagcagaattgagctctgcttcgagacaaggaaataggcattaagtgtggaacataatagatcagtggggttaacacgtgcaaacagtgcatgaatgaagtacaaagattcaaaattgtgagcattatggtgagtaatggtgagggagaactggggatattaccataagatctatgttaatagagtagatatcgtagaaatagtgtggttggctggcaagccttctggtattcacaatggattgtacaagaaaagaccttccttc

SEQ ID NO: 681845 - DNA, 181 bp, Homo sapiens
  misc_feature (1)..(1): n is a, c, g, or t
  misc_feature (45)..(45): n is a, c, g, or t
  misc_feature (62)..(62): n is a, c, g, or t
  misc_feature (75)..(75): n is a, c, g, or t
naatttgggaacagaaaaaggacattagtggaaaaagtggtgaanatctcccaccgtgaaangggttctctcctnttttgtttaagcgcaatatgttcattttaaattagttaaattatttaaatatatttaaacattatttaaatgtattaaattaataaaattggttattttgtgaaat

SEQ ID NO: 681846 - DNA, 624 bp, Homo sapiens
attctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaatgtttttattaaccttgcttttattggaaaaaatcaagcaatatttcgttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaa

SEQ ID NO: 681847 - DNA, 120 bp, Homo sapiens
tcatgtcttacgtctattcggattcgttaaccactgcgcacgacgggaactccgcagctgcatcttagattcagctccctggtcctggaaatttccacgtgtctgtgccgcgcagcaact

SEQ ID NO: 681848 - DNA, 343 bp, Homo sapiens
atttctgtatttagcaaagaagaaaaaataccttatctcatccaggcttgggtagatccatttaataaagaggataaaagcaaagcgccgtttaccgttattccgccagtatcacgattagaaccttcgcaagaaaaaatattacgcattattcacaccaaaggtgtgtcattgcctgatgatcgcgagtcagtcttctggctgaatattaaaaatattccgccatcagcgagcaacaaagcgacgaactcgctggaaatagcagtaaaaacgcgtatcaagctgttctggcgaccagcaaatatccgccttattcccgaagatgctgcgccgaaagtgaaat

SEQ ID NO: 681849 - DNA, 752 bp, Homo sapiens
gaggatcccccacatctcatctgcaccatcacctcatctgcgaaatcacacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttca

SEQ ID NO: 681850 - DNA, 170 bp, Homo sapiens
gccttaggtttgctggtacgggacgggactcgttgccctcgtctgttactgtacaggactgcgtgggctgggcgggcgctgcggactcggctgatggcgggcaggatagttcagacggtttccatttcctgagcgtctgagctgttagtattcgttcgttttgttcgtcc

SEQ ID NO: 681851 - DNA, 291 bp, Homo sapiens
cctcaagactcagtacatgagtcacctccccatagacgcttcccctgacctctgtgttggtctgctctagctctcataagaaaataccagagactgagtggcttaaacaaaagacatttattctctcacagtgctagaggctggatgtcaagaccaaggtgttcgcaggattggattcttctaaggctctctcttggcttggagatggccctggttggtctctgagtgcaggtgtcctgcgtctcttgtgtgtcagatttctctatagacactgtagatcgatgagggccc

SEQ ID NO: 681852 - DNA, 1065 bp, Homo sapiens
tgggacaccaaggtttttcccccaaaaaggggacccgttttttggaaaaaaaatttgggcccctttaaaaaaccccccctggggatacccgggcccccttggggggttccggggtttaaaaaaaaaaaaaaaaaacgacacacacgagagaaaattactccccaacgtggctgttggcggcgcccacacctcaaaagcggtgggggggggacccttgcaactataataatagtcgctatcaccgctacaaaaacgataaaaccaggggatagtgttgccctgtgtcgccctcgtgagttcttcttttgagacgccatgtccccccctagggctgggttccccccctactacacacactctctgtctgtattctctctctaacagtccggagtcttctgcagatccccttaaacaaacctcatcctggtgcgtctcgttccaaaaacagaagagggtcgccccccagaagagattgccgctgttgtcgatcaagacaacaacccacgtcatccagagtttgtgtgagatatatataaacgctgctgcgccgcgccataatgggtggtgcttcttcatcacatctccctctgataggaccaccctccctcatatataaaccaggctttattcttcaccaccgcaacaacaaagaaccctcctctaaaataattagagaagtacgacccctgaagaatgggtgggaggaaaaacaagcgcccccccacttgttgggtggggaggtgaaaaaaaaaagggggcctcttttaacaaacgggggaaatataccaccccagagttgggggggtggcagcgcacaatctgtgtgcgcccaccaaccggtgggctcccctggtataagaggaaggtcttcccacggacgagttcacttagtggtgcacgaccaacaagaagagacgtgttgttgttgaaaaaaaaccctccgtggtggccccaggagggggcaaacacatgatgtggggtgcaacaacaagaagagggcgtcctctagaaagaagaggggcgctctttaaatcttggtctcgccacaagcgggtcccataatag

SEQ ID NO: 681853 - DNA, 116 bp, Homo sapiens
gcactcatctccttggatctgggccagttgcttgcagtagcgacctttggtctcctccaggctgttctccagtgatgctttcattgctgagctggggactgcacgctcattctcca

SEQ ID NO: 681854 - DNA, 179 bp, Homo sapiens
  misc_feature (54)..(54): n is a, c, g, or t
  misc_feature (95)..(95): n is a, c, g, or t
  misc_feature (146)..(146): n is a, c, g, or t
  misc_feature (152)..(152): n is a, c, g, or t
cagacccgacggccggcccagttccacgaacccagcgagcccaagcgacttctncgcaccagggaagccccacccaccagaaagccaagtatgcncagcaagcgggccaaagccaagaccaccaagaagcggccacagcgggccanatccantgttttcgaaatgtttgaccagtccca

SEQ ID NO: 681855 - DNA, 86 bp, Homo sapiens
atggcgctgtcgccgtgacccggaaatcctcgcggcccgcgagctgcggcgcggcaccatgcagttgctggtgtcatcagcgccat

SEQ ID NO: 681856 - DNA, 372 bp, Homo sapiens
cgactatgacttagttgcgtccaccctttatagacaaacctaacttgcgcagaaaacaagatgagattggcatggctttatttgtttttttcgttttgtttggttttttttttttttgggctggacccaggtttaaaaaccggaacgggtaaaggtaacagcagccgttggaagcgagcttcccccaaggttcacattgtgcccgagacacttgagatggcccttagtggttttttaaaatagtctatcccaatttatgagatgcttttgtgccgggaatgtcccttgcaatcttaaaagcaacccaatttctctctagggagatgggcaagtcttctccaagttccaggtccagagggaatcctctagagt

SEQ ID NO: 681857 - DNA, 223 bp, Homo sapiens
tgtacaatgcacaggaagtaattcagcagttcattgatgtcccgagtgtcgcagtcaagaaacgtgtcttgtgtttaactagggatgaaaacctgatcgcaactgaagtttggaacacgtgtgatcggacagcaaatgtcgcaatcctgttttctgggggcattgcttccatggttcatagcccacccttgctgaccgtcatcattcctttcacatgcaacca

SEQ ID NO: 681858 - DNA, 343 bp, Homo sapiens
  misc_feature (247)..(247): n is a, c, g, or t
tctggcaaacttgatccctcccccccgaccctagaggaaaaccctctgtcaaacaggcagtagtatcttccacacagcgccgctatgaaaaagagcagagctcatgagggcttagcagggcgcctcgccctcgcagtgctggaggccactgatctcccctgaatgcggagccgcagtgcctcctggtgaataacaggtcatcccagtgccctggtcaggcatctgacactggctggcactcaagtgnggagtgaaattaatcctgttacccggaaatggcttttgataaattaaatacagggcagagatgttccctctggtggacagatagcaggaacctgtt

SEQ ID NO: 681859 - DNA, 123 bp, Homo sapiens
tctataccttctgtaatgagattttctccaggttttctgtgtcaaagatggctgcaatgggcagtggtgtcagcgatgatgtttttagcagctcccgacatgaatcagtaagtaagatttcca

SEQ ID NO: 681860 - DNA, 170 bp, Homo sapiens
atggacgaacagatagagatagacgttaacggacgagataaagagggtacccaaaaggcaccgcgaattaaaattccctagaggcgccagacaacagaactgaggaggtggaaatgtatttttctttttctttcttttttttttttaaatttgttcgttccatattcggg

SEQ ID NO: 681861 - DNA, 391 bp, Homo sapiens
tcttcggcacatgcgtggtttggtgtggtgctgcaggtgtgcggatgggcatcggacagtcccatgtccttccttttcaaattggagatactcggtttggaggctcttgactcctttggggtccgcgtggactctggtcgtctttctcgtactctcgttcgctctcttcctctgggaggtcccgcatcctctgtaattccatgctcctcttctttcaactccagctctacttccagtttagttcaccttcttgctgccttctcttcttttaccttccctgtttttcgccgggactttgaggtttcccgtttctaagtggggttggtcggtctcatctctaggatcatctgtgaatggtatctcgtcttcacggatgaagatttcttcttcc

SEQ ID NO: 681862 - DNA, 231 bp, Homo sapiens
acaagggtgaccagactcgaattacagcactatgaagtggtagaccagcattagctctagaaagcaggcaactaacttacagacagaatacagcgtacacagatctcataatctacaagatctcctctcctcccaagcagtaagctcccttcctccttccaggattcaattactccatgccctctttataaaaaatcccaaattcagtcttaccagaagtgcgcctgggtg

SEQ ID NO: 681863 - DNA, 558 bp, Homo sapiens
  misc_feature (191)..(191): n is a, c, g, or t
  misc_feature (223)..(223): n is a, c, g, or t
  misc_feature (280)..(280): n is a, c, g, or t
  misc_feature (309)..(309): n is a, c, g, or t
  misc_feature (350)..(350): n is a, c, g, or t
  misc_feature (377)..(377): n is a, c, g, or t
  misc_feature (380)..(380): n is a, c, g, or t
  misc_feature (386)..(386): n is a, c, g, or t
  misc_feature (407)..(407): n is a, c, g, or t
  misc_feature (428)..(428): n is a, c, g, or t
  misc_feature (439)..(439): n is a, c, g, or t
  misc_feature (497)..(497): n is a, c, g, or t
  misc_feature (510)..(510): n is a, c, g, or t
  misc_feature (546)..(546): n is a, c, g, or t
ttagtgggcactgtgcagctattcacatttaatttcttatgcctaataacaataaattattaattctctaaaaaataagtaaataagtaaaagccacttggaagcaaagacagccatatatccctgtttgttgagacggttgattttacacatatttagcagagtttctagcagcgcccccttgcacactnacaagtgtcttagtgaggatgataaactgtanagtcatcctcttcatagaggaggtagcatctgagcttgtatctaaaaaagaaagtangaatttgccagcttgagaatgggtggctnaaggaagaaagaggctgcttcaggcacagggaatacaaagnacaaaggcaaggaaatagagtgccgtncantaaggnagaacctgggcgcttgagcanaatggctgtgggcagaacttnagctaccactnactagctgcaaatatgtctatacccaagcccgagtgaggtttttccataagtaggaancggcccgttcttntgatgaaatcccatgggtggctttccaatggttttnaaatgcctgtcc

SEQ ID NO: 681864 - DNA, 115 bp, Homo sapiens
gtaccgtagtcaatatgcagtttttttaatcgtactccttcctgacatctccccgttccgagtctccaaagttcattgcatctctctgtatgcctttgggcactcaaggcttagt

SEQ ID NO: 681865 - DNA, 522 bp, Homo sapiens
  misc_feature (4)..(4): n is a, c, g, or t
  misc_feature (7)..(7): n is a, c, g, or t
  misc_feature (20)..(20): n is a, c, g, or t
  misc_feature (31)..(31): n is a, c, g, or t
  misc_feature (35)..(35): n is a, c, g, or t
  misc_feature (42)..(42): n is a, c, g, or t
  misc_feature (44)..(45): n is a, c, g, or t
  misc_feature (55)..(56): n is a, c, g, or t
  misc_feature (60)..(60): n is a, c, g, or t
  misc_feature (65)..(65): n is a, c, g, or t
  misc_feature (69)..(69): n is a, c, g, or t
  misc_feature (73)..(74): n is a, c, g, or t
  misc_feature (82)..(82): n is a, c, g, or t
  misc_feature (92)..(92): n is a, c, g, or t
  misc_feature (112)..(112): n is a, c, g, or t
  misc_feature (126)..(126): n is a, c, g, or t
  misc_feature (128)..(128): n is a, c, g, or t
  misc_feature (131)..(131): n is a, c, g, or t
  misc_feature (135)..(135): n is a, c, g, or t
  misc_feature (140)..(140): n is a, c, g, or t
  misc_feature (166)..(166): n is a, c, g, or t
  misc_feature (171)..(171): n is a, c, g, or t
  misc_feature (175)..(175): n is a, c, g, or t
  misc_feature (181)..(181): n is a, c, g, or t
  misc_feature (187)..(187): n is a, c, g, or t
  misc_feature (194)..(194): n is a, c, g, or t
  misc_feature (197)..(197): n is a, c, g, or t
  misc_feature (210)..(210): n is a, c, g, or t
  misc_feature (212)..(213): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (236)..(236): n is a, c, g, or t
  misc_feature (243)..(243): n is a, c, g, or t
  misc_feature (247)..(247): n is a, c, g, or t
  misc_feature (254)..(254): n is a, c, g, or t
  misc_feature (257)..(258): n is a, c, g, or t
  misc_feature (260)..(260): n is a, c, g, or t
  misc_feature (265)..(265): n is a, c, g, or t
  misc_feature (270)..(270): n is a, c, g, or t
  misc_feature (273)..(273): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (293)..(294): n is a, c, g, or t
  misc_feature (298)..(298): n is a, c, g, or t
  misc_feature (301)..(301): n is a, c, g, or t
  misc_feature (304)..(304): n is a, c, g, or t
  misc_feature (310)..(310): n is a, c, g, or t
  misc_feature (312)..(312): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (335)..(335): n is a, c, g, or t
  misc_feature (340)..(341): n is a, c, g, or t
  misc_feature (349)..(349): n is a, c, g, or t
  misc_feature (352)..(352): n is a, c, g, or t
  misc_feature (356)..(356): n is a, c, g, or t
  misc_feature (359)..(359): n is a, c, g, or t
  misc_feature (368)..(368): n is a, c, g, or t
  misc_feature (372)..(372): n is a, c, g, or t
  misc_feature (377)..(377): n is a, c, g, or t
  misc_feature (385)..(385): n is a, c, g, or t
  misc_feature (389)..(389): n is a, c, g, or t
  misc_feature (391)..(391): n is a, c, g, or t
  misc_feature (408)..(408): n is a, c, g, or t
  misc_feature (420)..(420): n is a, c, g, or t
  misc_feature (444)..(444): n is a, c, g, or t
  misc_feature (460)..(460): n is a, c, g, or t
  misc_feature (499)..(499): n is a, c, g, or t
tgcnagngcggggttttatnggctacaaaanagangcaaaangnngggaatctgnnggcngcggngggnaagnngagctttncccccataancccgccctttgattagaaangggcaatatattangngcnttangggangtctggggggactgttacagaaaaanaaaanaaangtttcngggtcngataatnccngggggatcttttngnncccccccccnggggncngngccngggcttncctnggggggnaanngnttttncaacnggngggaactttcnttggncncnngcgngcnttngggttncnttcccttggcaaagnacnaancncccgnnggggggcnccngggntanggccttggncttnggggnggccgacncttncntgcccgcctttgattcnccccggggcccncccccccccccccccgggggccgncgggacggggggattnccttccccaggggggttttgatgcccagcagcccttggnattcattgttctgccgccccagt

SEQ ID NO: 681866 - DNA, 193 bp, Homo sapiens
ctaattggttcttcgatgacgctggaacaaaactgtagttgaacatctggaggttactgctaatcagacacccaggttaatgattgtagtgcttgcctgtgtatggacaggtgcaagagtctgggctcgttgagacgattcctttgataagccgtctttattatctggggcccgtcatcgaagaaccaattag

SEQ ID NO: 681867 - DNA, 306 bp, Homo sapiens
gaaacgacttgttaggatgattgtagatattgggctgttaagttgtcagttcagtgtatttatctagacgcaggcttaatgcggaggagaatgttttcatgttacttatactaacattagttcttctatagggtgatagataggtccaattgggtgtgaggagttcagttatatgttggggataaattaggtagtgggtgttgagctagaacgcttacttaattggtggctgctcttaggcctactatgggtgtaaaattttttactctctctacaaggtttgttcctagtgtccaaagagctgtt

SEQ ID NO: 681868 - DNA, 510 bp, Homo sapiens
atggttgttatatgtgagtatgttgtcgccttctcttgtgtgattctgtgccagtcatggtggctcaccacggtgggagatgggatggtgggggctgtcaggtggtaagaggggctgtgtgtggagtttctgtgcatgtgtttctgctatggttcctacagccctgaatctctatcacctgaaatgtgttgtgattcaactacagataagcaatatttccgtgttcattagacgcagagtgctggatttgaatcccagccttactactttctggcctcaggacctttggcaaatggactaactactgtgcatgcttaacacagtcaccagtccccagacattaatttgaagaagttttatcacagtgttttgggttttatataaatgtcatcatgtgtaatgatttgatttttaatcaaatcatttaattttaatcaaatcatttaaatcaaatcacgtgcatgtttttattcccactggatgcaaaatgagaagaaagtaaatttaaag

SEQ ID NO: 681869 - DNA, 170 bp, Homo sapiens
ccagtgatttgtaacctatcgcgccttcaatccatgtttccttgatgacgttttctgcaactgttacgccgttgggtaagtccattcatgttcaccgtccacggtggtaaggcttggttaactgggtaattctaacgggcaccaccgcaattggccaaaattggtttggt

SEQ ID NO: 681870 - DNA, 284 bp, Homo sapiens
aaggactctgtggcgccatgggttaatgggcagaagaggaactggaagagcccaagcctgtgtaaagttggattctaggtatgctggatatgagtcgaatcactttcaccttggatcttataagagataattcaaagactttattgaatcagtctctagtccccgaattttatgtttgtaccatgttcgtggctcatgctttcttgattcctggcatcctgtctgatttctgagtttgggctagctagagtcttgtttgtctatcttcttgattccccataaga

SEQ ID NO: 681871 - DNA, 137 bp, Homo sapiens
caggtgttctcgtgtgaatagggtttatgttgttatgtggtgggtgagtacctcattgtgttgtggtacatatgtagagggagtatagggctgtgactagtatgttgcgtcctgtacagtaggagagtgatatttga

SEQ ID NO: 681872 - DNA, 1235 bp, Homo sapiens
aacttagaaatgaacttttagaatatacgatactgaacgtattacagggtaaataagttacaagtagtctgggagttggtgtcaaatatcatctgagcagaagtgtggtaacaattagtggaggtatagatgaaataaaatgatttgcttgtgagtttcgtggttatgtagctggatgatgggtacatgtgggttatattatgactcagttgtctgttaatgttggttgtatgtcatagtggagcattttgtccctataatggatacaaggtttatggaatgagatgacaggatgttgttagttcagggtgcataggaaatcaaggaacttctgattgcatttgaattcgtattgaggaaccatgcattatgtcctgtggtttcgttgcggtttgaaattgagaacgcgaagaacattggcttgggtgggtatggtgggtcaagaacggcagcaattgtgaatgatgcgagattcgtgtttaaccaagttgtcatttggggtccgtcaggatgctctccttggacgtggctatgcaatttcaacttaattcccaccaagggtgaagcatctcataggatgtctccaaatagagggacatttggggcccccataagtgcagtgcaacacaaaacacggggtctccaccttcccgcaattgaagatggctatgcacataggggtccggggggcttctacaccggtgtaatttctgccaaagagactttgtgtaatggaccaattttggttgactaggtgggacaagggcttttacaggaacgatggcgacgtttgtagcgagaattggtatagggggggaacttgaatattaggggaaaacaatttgtgggtagaccaatgtgggagttgggattcggttaagcagtaatactataggttacagcacatcttacttgggggggaaatggaaagccccctttattcggttccattacactatcgcatctataaggcgcccattgggaacccctttaaaggaccttgggtagaaggggctactccaaccggttggggccgcgcatttagtgtaatagggtggggcctgtcgtagggacatgtcttgccacaacatccttttctcacaccccccagaccacaaacacctagtggggagacacgtcctactgactgacctgttacaaccatacatggagcccgctgggaaacaggagacaaacgtgtgtgggggcacatatgggggcaagctatatcttca

SEQ ID NO: 681873 - DNA, 552 bp, Homo sapiens
agccacatgcaacatgtcacttgcctcaatttcctaccaataccggttttaggcacgaatgcacagtaagataagggaagaaaacatggtaggaatgaagtcctaattactatacatgcatcttttctccttgacagtagggagaaaccttttacagatcagttacaaacaaagaataggcaaataaacaattttgtacaagaaatttaacacattctgtacaaggtcttcactttgctgtcatcatttgtacaaactcttcatagtttacttgaccatcaccatcaatatctgcttccctgatcatttcatcaacttcttcatctgttaacttctctccaaggtttgtcatcacatggcgaagttctgcagcactaatatagccattgccatccttatcaaacacacggaatgcttctctaatttcttcttcactgtctgtgtctttcatttttcttgccatcattgtcagaaattcagggaagtcaattgtgccattaccatcagcatctacttcattaatcatgtcctgtaactctgcttctgtgggat

SEQ ID NO: 681874 - DNA, 1545 bp, Homo sapiens
cagcgctgccggcttgcatgagggctgtgagaaggggcctggtgccggtttgtcctaggaaacgggctgcgcagtttctcttttgcatcgtcttttccatatccagggaaggactatgtaaggactcactgaaacgctgttgtgcatacgtcgatcggggatacagtacatacaccgtcatacacaggtaatgccgcttgaagggttaacgtgtgagctacgattcttgttatgtgcctgatttttgttacttgtaccagctttaggcatgcttggagaagagacgtcttgatggctgtggcgcatcggccttttagtagtaatgttcgaaggacgccatatagtgctcagttccaaggaagcaacttggacttctttgagaagagtttacaactcactgatgggtggggcaccaagcctagagagacgacttgagtatgcgtctattgggcttgtgccgccaaaataaagttggctgatttgactagaatgatttggacctttgtcagaagtcatttacagttaccatttgggaccaataggtagtgacaccgaagcaagagtcatttcggggaaaatttgaatgggtggcctaaccaaaatgtgggcccatcgaatgtgtgaccttcctacaaggtggtaaggataaacctccaaagaggagtggcggaaaactccctttgcatgggaggtggtgccatcagttgaaccatgtcaaggagaattttctaccccgtctaaccgggggggccctttctccacacagggaattcgagactcccccaaggcaacaaagacaagggccagagtttctcatgccgatggtgggacgcgcgagtgtgttgacatcgaagggtgaccgcatataaaaccgggtggtgaaacacatgatgacaggggtttttcctaacaaatcgagtctccgggcaatttatttcaagagcccccctatttttgggacacctacagcagtgttgcacaaatgtggaacgaaatgtggccacggacaagcgaagaatcccccccccggtggataatagccggcagaacctcatcgagatgaatccccgccatattatggactgcgccgaccgtacatgggtgtgagaacacaccacaacataaatgaagatgcgtagtgacacacgggacgaagtagcacatcgcgtttgattgaagaacacaatcaccaattataccagacagaagtaccattttatgggtacgccattggtagagcgaaagatgcccccgatctaagcgcacagatttggtggcagcaagaaaaacaacgagcgtcgtggcatattgactgaagagcagggagatccagctacgcacggggccagctcttacggctcacgacagctggatagttgggacaccccagtagttggtgaggaagctcgtcagaagcgcaagtaaaccgggggctccctctacgaagagatactcactgtgatgtcatccgtaagatagggtggaccacacgaataaaggtgtagagacacactaactgcgaaagatcgcccacactgttgagga

SEQ ID NO: 681875 - DNA, 1096 bp, Homo sapiens
actacgcctacaactgggcaggcctgcgctgcggcgctgacgagggcttgaccctgacgaacgtaacctgtcgctgcacgttcgccgactggagccgaaggtcgcctcagttccgttcggtccgcggacggccggtggccggtcgcgcgggctgcgctgctgtgctgtgctccgcgcaagtgctcctgcgattctagtcagcgccgcgtagcctgatggcccggacggagacacgccaggctaggaataacatctgatggcggacataccaagctttggtaatggcgataacgactgatggtcttgagatgagacacgctgtgcgagattgccacagaacctagtagccgcgatgagctggaagagggcacatggatgaacagcaccaagatgctgacttcgactctggcttgggaagacaaccctcggtactctcccttcctacggaggggcaatgtaatgacccgaacggaggaacgaacattcgcaattagcagaacgttagtgagaccacttgagtaccacaaaaagatggtcatgtgggggctccccctcaacgaattatacttggaaagaattggtcaatttgtcctaaatccaattattccagggttccccaaagtgtactggggctttacatccttagaacggagtggagtcgactatcgttagcttgcgtaaccgcttaaaatggttgggaggaaagtgtcccccatgtgctagccgaacgtagccaccaggggcaatccttccgcaaccatggaacaaaatagggccccccggggagggcccccatcctgtagttgcctcaagtagccacgtaaacgggcacgcaaaaaactatgaggagaaacggactttgaggttcctgagaaagtgggctttgaccattgtttccggagtggaaattcacccgggaaatagtagtaggaatggttataacggttgtacttggggatatgtggggatcccgaggaatcatttaagcaggttgggacttggaatttgttgagtacgaacaattaattgttcccgaaggtatgtgggccatttggtttcttggaggaggaattcttctagagacaggagcggaatg

SEQ ID NO: 681876 - DNA, 181 bp, Homo sapiens
cccttgcactccggccgccgagtgcatggctcacagcctataatcccagcactttgggaggccaaggcgggcggatcacttgtagcctcaggagttcgagaccacgcctggccaccatggtgaaaccctgtctctattaacaatacaaaaattagggtgcgatggctcacgcctgttatcc

SEQ ID NO: 681877 - DNA, 809 bp, Homo sapiens
gaggctgtatcccgtgctgttaccctgggagatacttaggcgctcactagtctttccttgcgagattgtggggcggtgactgccagaatccagactcggggtcccaggctaggcaatggtaatcgtggcttcatcatgctcatagcaagattccctcatatcgtgcgctccgttcaccattcgcaccatggtaacccatacggcatttggcagtactgcatgacatgaaatgctgcctcaggtgcgtgaaagctggcaagaggcgctgtggttcaaagactactactgactggtacctgactcgtagtagtgcacatacggaattcatgaatccaaatagggttttgattctaccgttgtactcgaacggcatttattttcgtaatatctatcgctcggatcctcttgatgttccttatgcatagtaaacgatagtctttgatggaagtacggaagttaaaccgagatttgaccactgaaaggtgagtttatgctatacttcattcttccttaccataattccgctttccaacctgaaagtgggaaggttcttaagaaaggggaattcatggtgctagattagtaaaacatgacttttaatgagtagggtcttctttatcgtgtgggatttttactaccttttttcaagaagaaaaattgatgagttttgtataagctggtcagatacaaataataggtgacttcacagtttagtaattattaatgggtactgtgtaaacatttgggtacctaaattatgtttgtgaaaagtaatttaaaattagtatctaaaagctagtttctgggtg

SEQ ID NO: 681878 - DNA, 643 bp, Homo sapiens
  misc_feature (504)..(504): n is a, c, g, or t
  misc_feature (590)..(591): n is a, c, g, or t
cagcacccaagtcacctcttgaatgctttgctgcttaaaaatttattctgaacagatatcctaaaacatctctctccagttcaaaattccacaaatctcaagtggaggagcaatatgccacctgtctctttgctaaaacttaacaagagtcacctttgctccagttcccaacaagttgctcatttccatctgggaccacctcaccctggactttattgtccataatgctatcagcgttttgggcaaagccattcaacaagtctatagaaagttccaaacgttcccacattttcatgtattcttttgagtcttccaaactattccaacccctgcctgttacccagttccaaagttgcctcaacatttttgtgtatctatagcagctctccactcctggtaccaatttgctgtattattctgttttcatgttgctgataaagacacacccgagactgggcaatttacgaaagaagtttaatggacttacaggttcacgtggctggnggagcttcagagtcatcgcggaaggtgaaaggcatgtcttacatggtggcagataagagaagagagcttgttgcaggaaactgctnntataaaccatcagatctcatgagacttattcactatcataagaacagtacaa

SEQ ID NO: 681879 - DNA, 196 bp, Homo sapiens
ggaggttacagtgagccaagatcatgccattgcactccagcctgggcaacaggagcaaaactctgtctcaaaaaaccaaaccaaaacaacaccaaacaaggttttctcactctggaacgtgattacatgcttcattgtggacctacagggacatgtggacagtggacaggggaacatcatccacaggtttatcatt

SEQ ID NO: 681880 - DNA, 245 bp, Homo sapiens
agattcaaaaacgatcccaaaatacatctacaaaagtcatgtccacaaggagcatatacaccaggatctacaaaatacagaaatactgcacatacaaatgtcacacaaactggtgtctaaatccccaggagataagctgatttcatctggggaggtgacagaagagcgtgtagtccttggagttcttggagatgggagcgtgtcccaggcattatacccacttggtggtggagttggcatttgcc

SEQ ID NO: 681881 - DNA, 596 bp, Homo sapiens
cccaaaaagtaggaaagaggataacactgaaaatttggatttctcatgaatagataggtgcatcttctggggtcaattaaaaggagaaaaaatccaatttctccctttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcccggtattttaatatttgttattttttcatgaatagaaatttatgtagaagccaacaaaatacttttccccccttaaaaagagaatataacattttaggtcacaataatcttttggtttttaaagtaagggaaaattttgtggggattatctttttggggggggaataaatcttttattttgaatgtaataagaatttgggggggtcaattgcttatttgttttcccccggttgtccagcaattaataaaacatacccttttttacggccta

SEQ ID NO: 681882 - DNA, 428 bp, Homo sapiens
gcatgcatgtggatcgagaggtaaacaacatcagagacaggaagcaggtgtggtgtttcatctccatagatcactgctggctttgcaaaaaaaattatatgaccgtggtgatggactgcagtcaacttgaagaggcagcagggccagtgagagctgccacgccgcgagtggtctttttgccgcagccgaccaacatagcctctgtacttggtgtgtgactagcatcttggcaaattttttcttctcaatatcctcgctcgggagggtcagaagcagttcatcttcaccggcagacagcagcactccttccctgcctcgtcttggggctgtggctgctcctggctttactggtgggcggaataatgtcccccaaagatgtccacctcctgccccctggaacttgtgaatacttgacgtgattcagcaaa

SEQ ID NO: 681883 - DNA, 1148 bp, Homo sapiens
  misc_feature (310)..(310): n is a, c, g, or t
ggcgtggaggagagcgtgcgggaccgggtgcgagaaggaatacaggagacctagatgatacgtaggatgtgaggatccgagagccaacagatctgtgcacgaaggctcgggcaatcgcgccgctgtcgtgggactatcgagatgacctacagccgagccgcggtctacttcgctgcaccgtccaagggacgggcgacaaggacgtgatgatctagcggcgagctggacatccccgtagcacgcgggggccgggtggtggagcaggacgcgtctagcagttactccaaacgtggctgcagaccaggcaagntcgttttctcatgcactcgaaatgtgtacatccagcagccgcgtgggagaatcagcgggagtgtctcggcgcgcgcgctcagaggtctactgtcgcagtcccatggctgacggtggcgctgacgggaaactggagtactacacggacatcgatgcacgagcagcttcttcctggagctcctggagcagctacggtggtggccaagaaccccaagactggtgcatgcgcaggtctgagacatgttggtggaggaggatgatgtgcaacgtgagatgtccatctgcgctgtgcacagtactctcaaggcacgagtagccgcgggagcccactgatagaagctctagcaaggtcatcaagacatcaggtggaaaccgggccggcggatgcggtgacagaagaaggcgaagtaccacgctcaaagaaccggggcagccgggggacgagggtgtgggaacaggcaccaccatgaaggccgaacgttgaacctggcaagacgaaggaaatgaaagcaacaacccgaggaacgaacaccaaagtgggaacacagggccagaaaaggcgcacaagaacagagacgtgaacacggaaacgaccaaaggggcacgagcaagagcacaagacagagaagaggacagcgcaaacaggaaacgggaacgagaagagagagaaccacaaaagccgcgaataccataacgaaagaagaaaatcggagacccgtaagaaaggggacgcacaaaaaacaaagcaaagaagaaaacacagaaagcgcctctcgcaggagaaaaagaaagaaaagaacagcagaaaacagacggtggacccacccacaggcgtcagc

SEQ ID NO: 681884 - DNA, 116 bp, Homo sapiens
gggcctgtggaagtccccagaagttaattgatgggtttctaaaacatgaaggacctcctgcagagaaacccctggaaggaactctctgcttctacttcaggcgttccagggcgttc

SEQ ID NO: 681885 - DNA, 255 bp, Homo sapiens
ggggccccccccccccccccccccccccaagttccttgggcccacaggggccccccttttcctttttttttcccccccccgtttcccccccccgcccggtattccccccccctccccccccccccggagggggcgtgttcggctgccccccccccccctagaaagaagagaaagtcgacattatatataaaccacaaccaaacactcattttttttttgttggggggggaggggggaaaaatcaccgaagaaaaa

SEQ ID NO: 681886 - DNA, 132 bp, Homo sapiens
gagcattccagtctgcttctttaagttattcatgagaaaaataaaactatgttctttgatactttaccctaactcaccttttttttttttccccatctaggggtaacaaccccgtgcgggggaccctctcta

SEQ ID NO: 681887 - DNA, 319 bp, Homo sapiens
  misc_feature (10)..(10): n is a, c, g, or t
  misc_feature (282)..(282): n is a, c, g, or t
aagcttggcncgaggagtttattaaaaaagtgttagagcaggaacgaaaggaaataaagtacacttggaggagggccaggtgggcatcttgagagagcaagtacacggttttgacctttgacttggggtttatatcttggcatacttctcgggggtgcgtcccttctcccctgattcttcccttggggtgggctgtccgcatgcgcagtgggctgccgacacttgggagggccgcgtgcacagagtgcttactggagttgtgcggggccctcttgagggagncttcccttaccaccttcctaggggaaggtcacacact

SEQ ID NO: 681888 - DNA, 111 bp, Homo sapiens
tggccagggcctcccaaattagggggattacggccaaggagccacctggcccagccccctaaatttataatataaccttcagaaggtacccagacagggtacgacgccggg

SEQ ID NO: 681889 - DNA, 713 bp, Homo sapiens
tgagccccccccccccccccccgtaaaaggataactcacacgtcattatcaaaacgcactccttcttaaaagacattacccgacccctgaaaatacaatatacggccagcttctcatcctacggtcggaggaggcacataggacaataaaaaaaaaaaaaacagaaaaaaacaagaaagcggcctttcccactgaggaagattatagggcgtcgcagggtagtatacgcgtcgggtattaggtagctagcgtattaggaagaagaagtatattattgagacggttacgtcggcgagaagtcctagtggggaacgaatgcctttgaggccgcgaaaggcgtccactctgccgcttcctggagccgttcgtcgatcgcccttaggtgtactacttatacttagactacaggttagcctcgtaaggaagtggagtcgacctcctatccccactaccttactattagagttcttaacgtatctactcctactactattgtagctcttatccctaaatttccttctacttaggcccccacttagaatctcattcccgggtacagatacggcctctaggagtcggccaacgcgtcctagcccgctaacaacccgatcgattatcggtctagggtttcctacccctagtctacggagaccgaatcggccccctaccctaccttccgtcggtcccgggtcgaatccccttataaagctccg

SEQ ID NO: 681890 - DNA, 1034 bp, Homo sapiens
  misc_feature (450)..(450): n is a, c, g, or t
  misc_feature (464)..(464): n is a, c, g, or t
agaagctgatgagatgcacacattgtttacagctagaggtgtgaaagatacaaatcctgtccttgctggtacgcccgataggaattttacagaagctacagagaagtgttgagcgagaagaaaataaatggaaagttgaaggtctcgatgaatcacacacagtactattaatacagatgcgagtcatcgatttacatcttcagagacatcgagctagatgctggatttaagagaatgcgaaaataaggatattgaaaatcgtgagaagtagaactgagaactatttggtaatatgtgaacgtagaataaggcgaagagagtggaacgatctaccttatgttacagaagtcacgagagttgaaggcactatgttaaaatgaaactacatctacaaagacattatgaactgaatcgaaataagtgacaagacaggaagggagctggtgattngcataaggctcaanagtcactggagcttatccagtcaaaaatagtaaaagctgctggagacactactgttattgaaaatagtgatgtttccccagaaaacggagtcttccgtgaggaaggagacaactgtctgtaagtctaaatcagactgtagcacaggttacagcagttgcttccgggcggtaaacctaacaggtcacaaaggagaaagagcactaccaggtgtcagagtgaagtaatggggaagctgtcatttgggatcaaacgaggctgtattatatttgcgaattaaagcttatgtatgtgtcgccctttctatttgtcagaacctggacagaggttggcttgcctaatcctgttgactatgatttaggatggacagcaagcccgtttttacacctcgggttgggtatgtcacaccggcggaaagtagacgtcatccggaaaaaaggtacatgtctattgggcgcacagtcagacacaggcgcccacgcagcggccacgaggaggcggacaaaggagggacgcgtgcccaaatgtggtgcgctggtgggagagacgtacaaagcggggcgcagatgcag

SEQ ID NO: 681891 - DNA, 657 bp, Homo sapiens
  misc_feature (73)..(73): n is a, c, g, or t
  misc_feature (87)..(87): n is a, c, g, or t
tttccagccccatttttgaacactcacaaacttacaactgacaaaatgaagtacagtaagtagctggtgattngcataaggctcaanagtcactggagcttatccagtcaaaaatagtaaaagctgctggagacactactgttattgaaaatagtgatgtttccccagaaaacggagtcttccgtgaggaaggagacaactgtctgtaagtctaaatcagactgtagcacaggttacagcagttgcttccgggcggtaaacctaacaggtcacaaaggagaaagagcactaccaggtgtcagagtgaagtaatggggaagctgtcatttgggatcaaacgaggctgtattatatttgcgaattaaagcttatgtatgtgtcgccctttctatttgtcagaacctggacagaggttggcttgcctaatcctgttgactatgatttaggatggacagcaagcccgtttttacacctcgggttgggtatgtcacaccggcggaaagtagacgtcatccggaaaaaaggtacatgtctattgggcgcacagtcagacacaggcgcccacgcagcggccacgaggaggcggacaaaggagggacgcgtgcccaaatgtggtgcgctggtgggagagacgtacaaagcggggcgcagatgcag

SEQ ID NO: 681892 - DNA, 933 bp, Homo sapiens
attttctcaaaatttaaagagtaaagaaatgaatatttttgggccaggaagtgtggcttatgactataatcccagcactttcagaggctgaggcagtcagatcacttgaagtcagaagttcgggaccagcctagccaatatggtgaaacctcgttgtatcgaaaatacagaaattagccgggcatggttgtgcgcgtctgtagtgtcagctgctccggaggctgagacaggaaaatcggttcaacccgggaggcggaggctgcagtgagcccagatctcgccaccgcattccagcctggccaaaaaagaaaactctgcctcaaaaaaaaaaaaaaaaaaggaaaaaaaaaggaaaaactaattttttaaaagaaaataagccgggcgcgggggctcacaccggtaatcccagcacttggggaggccgagaggggggggaataactggaggtccggaaattggagaccaacctgaccaacatgggagaaatcccatctctactaaaattcacaacatttagcacgggcatgggtgggcacatccctgttgatcccagctactggggagataagaggcctgagattcgatggacccgggagacagagatcgcgcattgcactcagcctgtcactagagcaaaatcctctcagaaccacaaccggaactgttgatctcttacacaaatagccggggacacctaacgggttcccggcgggaaagaaaacgggggtcgcgaggtaaacttcgtcacaattctcttcccaagcaaccgcgagagacaccgcgaggggcccggcgggggggtacgatggggccagggggtacgcgggggaaccccacgacggaaaggggacggccaccgcaaccaggtaggcggtgccaccccgcgggaccgccaggggcgacaggacagctcgagaaagggaacagaga

SEQ ID NO: 681893 - DNA, 134 bp, Homo sapiens
cccttcccacagggagtgaagccgaattgagatatcatgaagcgaaacagagcaatttccagcagtgcatttccaaagcagtatctggagccagtgcaggggattacagtgacgcaattgagacgctgctcaca

SEQ ID NO: 681894 - DNA, 821 bp, Homo sapiens
  misc_feature (26)..(26): n is a, c, g, or t
  misc_feature (61)..(61): n is a, c, g, or t
  misc_feature (102)..(102): n is a, c, g, or t
  misc_feature (113)..(113): n is a, c, g, or t
  misc_feature (126)..(126): n is a, c, g, or t
  misc_feature (160)..(160): n is a, c, g, or t
  misc_feature (197)..(197): n is a, c, g, or t
  misc_feature (226)..(226): n is a, c, g, or t
  misc_feature (229)..(229): n is a, c, g, or t
  misc_feature (241)..(241): n is a, c, g, or t
  misc_feature (246)..(246): n is a, c, g, or t
  misc_feature (275)..(275): n is a, c, g, or t
  misc_feature (278)..(278): n is a, c, g, or t
  misc_feature (292)..(293): n is a, c, g, or t
  misc_feature (303)..(303): n is a, c, g, or t
  misc_feature (310)..(310): n is a, c, g, or t
  misc_feature (314)..(314): n is a, c, g, or t
  misc_feature (341)..(341): n is a, c, g, or t
  misc_feature (346)..(346): n is a, c, g, or t
  misc_feature (357)..(359): n is a, c, g, or t
  misc_feature (366)..(366): n is a, c, g, or t
  misc_feature (377)..(377): n is a, c, g, or t
  misc_feature (394)..(395): n is a, c, g, or t
  misc_feature (398)..(398): n is a, c, g, or t
  misc_feature (407)..(408): n is a, c, g, or t
  misc_feature (421)..(421): n is a, c, g, or t
  misc_feature (459)..(459): n is a, c, g, or t
  misc_feature (468)..(468): n is a, c, g, or t
  misc_feature (485)..(485): n is a, c, g, or t
  misc_feature (508)..(508): n is a, c, g, or t
  misc_feature (589)..(589): n is a, c, g, or t
  misc_feature (641)..(641): n is a, c, g, or t
  misc_feature (653)..(653): n is a, c, g, or t
  misc_feature (662)..(662): n is a, c, g, or t
  misc_feature (669)..(669): n is a, c, g, or t
  misc_feature (689)..(689): n is a, c, g, or t
  misc_feature (753)..(753): n is a, c, g, or t
  misc_feature (821)..(821): n is a, c, g, or t
tttttttcttaatttctccccctcanttctcccctccccccacctcaaacctctctccaantacctttcacccctccccacaccctaacccttccaaaaccncctcctccaangctggcccatggngtccccaccttcccacccactcacgttaccatcnttaccactccacatctttccaactccttctctccacnctcatctatccatctctctatatccaaanctncacatgacaatntcatnccactccagagttagatgtacctatgcanttnccctcaacccaacnntcatatttcnaaacaangatngctctaaacatctaaccctccatctcnccatntatgtatctcnnncctaacnacctccccaantccctcttcccctaacnnctncccttcagnncatttgcacaacnaccactccctcccaccgcaaacgctccccagagcagcncaaggactnaaagccagccaggaaantggaagaacaggagaagctcatntaatggattaccctccacaggattatgttccttgattcctgagagttttttctcttgattttaccccctcagtctatcacngcaagagaaagaggtagaaaagacaaacagaccacaaaagacaagaacccanacatatagacanacgcacctnttgcatntgcatgagccagagcctggnagagaagagagagcgtgcaacaaagagctcagagcaggcaggcagcccaccccctgcagcagtnctgggcttcactggagcccctgcaggaagtccagcagccctgtaatccactcctctggtttgtcaggn

SEQ ID NO: 681895 - DNA, 1142 bp, Homo sapiens
gctgaatgcaggcgctcttggctcggcgcggcctgctgcaatcctgtggatgtgaactgcgccgccgagccaccatcatgcctggtgcacttacagtgacaggcttcggctgcgtggtcaccaaccgattcgaccagttatttgactgacgaatcgtgaccccttcgaggtgctgaatggcagcagagaacaagaacaaaagaagccggctgtgggtgcggcgttgcggtggccctgggtgccaatgagcgcacgctcagtgccgcggcccagacacacactccaactgcggcaggcaacacagctgcgcaaggaagtcccatgaaagacctgcaacgaacccgctgcccgcccacgcgttggcgtggttgcacacagacaagaggagcactgcagccgccctgtggcggcttaacaacagcaaggcatacagcacgagtttggcacgcaagacctgatcaacaacttcagtggttgcatgtgcgacccactcctttgactacgacagacccaggaacaagggcgaccacaccttcgtgcacctgacacgatctctgaatcatgccccactttgcacactgaaacaactctgcggttgaatgcgcagcggtcgaattcctcccgtctgcacttatcatctgcgcttctctgcgctgagcctactctcgacaggtccgtgtcgtgccattcattgcgacaacacgtgtctggagtgtcgggcccggcgcgactgatgacaccttgggcccgctgcgcagaagtgccactatagcattcatccgaggcacacaccctcacctttggcccgggcctatcatgtcactcctgacatgaaatcatacatttaccacgactcacccctgcggccttacacgccccgctactgagcgacgcgttggtatcggcagaggaacctctcagctcctggtggcgaccgtttctcaatgcaggattaacactaatttgtctcgctacgacttcggaacactcccacactcgtagaacgacctgtgaaacttccgaccacgcctatctgctcccgcacccgtcgcagtagccgcacatatccatcgcgacgtccgtgccaccgctcagccgcccgcgccgcccgtgggcccgcgtgcaggtgtgagggcgctacc

SEQ ID NO: 681896 - DNA, 173 bp, Homo sapiens
atgtaccttttacagtggatggacacggagaatttggtgctgcccgatgatgagggccgtgggcatccagcaactttatgggggcgagtcaggtttccccaaccaagaatgcccccttcctcccaggggttaatgggctcccggggggataccgagcttcgaatttctgtaag

SEQ ID NO: 681897 - DNA, 204 bp, Homo sapiens
gggggttttttttcccccaggggggggtccccgggcttgggattaaaaagtttttaaaaccgggggcccttttctttttggccccggttcccccccgaaaaaggttggggtttttttttttttttcccccccccctggggtttttgggttttccgggggggatgtttttccccggggataaaacccggggtcccttttttttta

SEQ ID NO: 681898 - DNA, 482 bp, Homo sapiens
ctttctcgaatcacctagagcttctgcaaacaaaattgtaccagcaaactgtgaaatccacgttatgctcaaattcgtccccttaatatgtcaatcattgttgaaagcaaatacggagtatacaaagcaagtgttatacaggaactgagtgtatcaggtgatgattgccgtgaaaacacagcagcaggataaggacaaccagaatagggattcttgttttatttctaacatatgttcattctataccactgtattcattctataccactgttagtaaaaaacccacgtatcagttgcatttatgtgagcagcctgcaatcatttctctttcttgttctcatgtcattcttcttccaccttcagaagtgtgtactgttgacacatggtgcttcgacactattctcactgcacacagcccctctatggggctccaggtacttctactattgtgcactataataaggcaaggtgctcgaagcatt

SEQ ID NO: 681899 - DNA, 162 bp, Homo sapiens
cgttaatagagaagtttctctgaacgtgtggaacactgtaataagataaataaatttttaaaaagaaaaagtaagcatatatacaaaatgtatgtaatttcatttgtcttcacttatttaatatttataaccatacattaaatgaaaaccaaatcctacaag

SEQ ID NO: 681900 - DNA, 326 bp, Homo sapiens
gttcggcagcgaggtgaactcaggctgagccccggtgcatggctgggaaggtttgagggaagcattctgaggaactcctggctgggcttctgtcccctctggccgtggctctccaaggtgaactcgttcacccttctgccggcgccctgttgacagagcttggacgccaccggggaacttggcagctggcgagggcgtggtcaggctgggcctgcaattctgcctgggctcttgtggcctttgggctttcttttcagaattcccttctcccgtggaggcctaagtggcgcgcggtcccaataaggcaccaggggggttacccggag

SEQ ID NO: 681901 - DNA, 129 bp, Homo sapiens
tctgaggatcccccatacaataaataaataaaaataagcacaaggtcacgtaggcatctcacttaaaaaatcaaaaatctggcagtaagaatgtgccatatagtaaagtcataaagagtcatagctgag

SEQ ID NO: 681902 - DNA, 232 bp, Homo sapiens
gtcgaccataagccagggcttaacttgagggagaagggtgggaggggggtgaggatcgaaaagttacctattaggtattatgcttattaccggggtgacaacataaattgtataccaagcccccatgacacagagtttacccgtataaaacctgcacatgtcatatgtactccctgaacctaaaataaaagttgggaagaaagaaaataaattgaaaaaaagtcgacgcggc

SEQ ID NO: 681903 - DNA, 121 bp, Homo sapiens
agacattggctgtggatcatgcattctaaaataatagttactattcttaggatctgtgtcttgtgttacaccggattctataaatagcaatgccctttgataggttacttgatatgcgtat

SEQ ID NO: 681904 - DNA, 480 bp, Homo sapiens
  misc_feature (8)..(8): n is a, c, g, or t
  misc_feature (31)..(32): n is a, c, g, or t
  misc_feature (73)..(73): n is a, c, g, or t
  misc_feature (110)..(110): n is a, c, g, or t
aactttanatatgagttcaggcttacccccnntctatataatataatataatataatatagaggagttaaaanatattttaagtccagtggtgcccctgatcttaatganatcccatgagagttaataatatttaaaaaatataatatagagaacacattcctgtctgacagctttgaggagagtagtggttctcccagcacagagtttgagatctgagagcgcacagactgcctcctcaagtgggtccccgaccccagagtagcctatctgggaggcacctcacagtaggggccgactgacacctcaaacagcggggtgcccctgtgggacagagcttccggaggaaggatcaggcagcaacattcgccattctgcaatacttgctgttctgcagcctccgctggtgatacccaggcaaacagggtctggagtggacctccagcaaactccaacagacctgcagctgacggccctgact

SEQ ID NO: 681905 - DNA, 145 bp, Homo sapiens
acctggccagcagctgatgagaatggtgggcatcagaagaatgctggaaagaatacttgtcatccaattgtccaatacatccaatggatcatcctttcatttcgtatcaacatacctccagatcatgagctcaggctgcccgagg

SEQ ID NO: 681906 - DNA, 203 bp, Homo sapiens
cgggaagcttattggattggtctaagtgagattttaggggtctgaactaggaggaaactttttataggaatgaagaggagactgaagattccaaaaatatataggacatcaagtgggtaggactcagtggttgattgactgtggagacaatgagagagtgaagagtcaaagatgatggctcaggtttcttgcagaagaaaaaa

SEQ ID NO: 681907 - DNA, 547 bp, Homo sapiens
tttatttttatgtttttggagagaaccccctttatggtgcacccctggtagtaaggcattatgacacccaggcgttccctgtggcccctcgaggcaaaaggtcaccccctttccagggcaaagccaaacccccaactcagctctgggcagggtcccgtctccgaggttgacgggatcagctccatccggggacaaggaaagaggactgacccacaagaccaaagcacctcaaatctaccggctgcagggccacaacggtgggcagcacggtaaagagcgggccagggtgcagggcaaaatgggtccgagtccaaggtccacatcccaggtgtgctgcctggccctaagctgtcctcaaggccagaaccaaataacgaaagaacaaaacaagacacacagaaagacgaagaagagaaagaagaaaagcagacagaccacaaaaacaaaaggaagaaaaagcaagcaaaagaagaaaaagacacaggacatacagacatgccaaaaacaaacaataacaaacagacgaaagaccccgcagacacaggac

SEQ ID NO: 681908 - DNA, 449 bp, Homo sapiens
cctgacttataacaatgctgaatagttcagatctgaaaagcatgcacacgcacacacagctgtgttggccaaagcacactgaggcctgaatcagcagtggtaccggagagtgacctctgaactacactatactggtgccagataaagaagctggtgtgaccttcaaagcttagcaagcggacccacctgaaagaaaaaccatccctgtctgcgtaaggtatgtcagagctgagggcgtggccaggctatttccggaaccatgctcaatccccaaagaggaacaggcgagagaaaaaaaggccagctgccccgggtggggaccaagccatccccctcccccaatcaggcggtgggctcctccccaggtcccatcacagtgatgcagcacttgagaagcaggcacacacagacttgggcccagcggtgagctacctgcccccaacaagttc

SEQ ID NO: 681909 - DNA, 601 bp, Homo sapiens
agggcccaaaaattgtttattacaaaagaaatccaaccaaaatgcttaataatttacaccgggacccgggccccggccataagggcccaattcccgggaaccaacacaatggggcgcttcccgagaaaaaaaaaaaaccccccccaaatctcggagcttggggtaaccagggccatagctgtttcctgggcgaaaatgttgtcccatcacaatcgctaaagccctattcattttttgccgcccggttccacccaaaataccccttgaaattcccaacgagataacccgggtaaaccccctcaccgggggatctgctcaaaaaaacccccaccgactttctcggcttatgccgcccccccttgcgatgtaaatgcacgcgccagcttgagtattttattgggtcacccaaatacgctgggcataatcatcggacaacggtgttcctcgggggaaaatggtttccgttcaaaaatccacaaaaataccacgccggaactataagggataaaccgggggggccaaaaggggggccaactccactaaatgggggtgggatcacaggcccttttcaaggcgaaaaacattcgagcaacctgaaatt

SEQ ID NO: 681910 - DNA, 974 bp, Homo sapiens
ccgtgctccatggggcaacctgtttctccaacgttaaccccccacattgtccaccgggggcacacacaaattttgccaggctggccctccactttttttggggaaaaaaatagcggaagatcttgaaggaatttttaaacctccaagccccctgtgttagccacggatacttcccgcgcaaggtccatccccccaattccgggacaagattgagaaaatcggagacaagatggtgtaacatttctgccacttagagccggatgttcaaagagatgccccatccagaagcgcccggtccattcccgccaaccggctctctggagaaagggaaagagcctggtccagagcccgagaggagctggttcccgcacccaagagagagaggaagaaggagaaaaattgccccagctctgccgggatttgacttggccctaagaggaaaagcaagacaaaggagagaagtttatgaaggatgcccaacaaaagggggagatgacaccacgaggaaaggtctccgtctgtgaaatcctcccaggcgccagatgtttgctgaacggtctagcgaatgaggaatctgccagagcccagccgggccacgaagcctatgcccgcaggtaggagacccggtgacgagcgtctctgccctagaaagccaaaagccaggggatagaaatctgctatttgatgtaagaactccacccaccaccagcctagtaaggcccctgcacaccagtattcgtagctgtgcccttctctttggaaggatacaggaataccgattgggcttgccccccccgagacgtaggaggataacttttaatttaaatcccagataccagaggaaggaagttaactgtccgtggcctgaagaaaatcatgggggccagcccctttaatcccctccctgtgggaagtcatcctggctggtctgtcttttctcccatttgttttaaaacaaaaataaaaaattatac

SEQ ID NO: 681911 - DNA, 271 bp, Homo sapiens
agacgaccttcacccctgaaacaacaagaccaacctctcctctttctcctcctcctcagcctgctcaatgtgaagagacaaggatgaagaccttgatgatgatccacttccccttaatgaatagtaaatatagttcctcttccttatgactttttaaataacatttccttttctgtagcttactttaagaatacaatatataacacataacatgttatgacatacataacatatattacatgtaaaatatgtgttaattgactgtatcagt

SEQ ID NO: 681912 - DNA, 1181 bp, Homo sapiens
  misc_feature (208)..(208): n is a, c, g, or t
  misc_feature (398)..(398): n is a, c, g, or t
  misc_feature (1022)..(1022): n is a, c, g, or t
gctggtactctggtgttggtgccaaaaccgtgagcgagccggcgcatgggcggagcgtactcattctgagcgtgaatgaggagcgaggtgtcgcacgtgctgccgagtgcctagcgcatgtctgacgaggcgtaccgtgctcccgtgccagtcgacccttgatgccgctgaacattcctctgtggcgatctttggagacagtccatgncggatcggcaacatatcttgcgaggagatgttgcgtccacaagtagctagggtggctgcacatgtgaatgcatggagagtaagcattgcatgtaggctgcagggatgcagggccgtgcaggtgggctagtcgccacggggcatgggagcacactttgcgtatcatgctagaatagcgtcctagctactcngttgtcgcaccgactagcagattttgcttcgacaggttggtggcaggagttcgcaggagcaggactgtgtgggtgcgagagcgacctgctatggatcctgctggaacctgggacaacgtagacgagctatgagagtggatctcgggacgactccataggctccttgatggggacgacggtgccgcgcaaggacgcgtgcgtggatccctgagaacctgatgcgtcctgttggggaaactgtatccgtgtctcgtggaagagatggcaggcaccgtggtgctgcgcccatggtactaagggtccagagaccaatcgcactggagcggtcaggctttcgccatagcagggttccttcacattgcctgacctacgtggtccccttggtctagcgcggctgtcttaaagtggccccttgtggcggctccccacacaaaggcccctcctgttacataggtacttacgacgccttggcattttccctaagacgttttcgaaacgagggaaaagggccaccaggagtcacctggatctcatttggcttgggccgaacgtagggcattttttcggggaggcgaacctttcacttacttccacgtttacaccaccggctaaccatttctcttntcgggcccggggggagaaaactgcgcggttgtcgaatggaaaacccccaaagtaattctaacaccgattttcccgggaggtttcaccatccccacaccgtccttcgccccgaaaggtcccagccagggccgtagagacccccaaaaacacaaggcgcag

SEQ ID NO: 681913 - DNA, 658 bp, Homo sapiens
tggaaacggggtctcggctccatcaccccaggtctggattgcttggtgcgatctcagctcgtgaggttgacctcccgggcccaagtgatcctcctgcctggacctcccaaaagtgttgggattccggcttgaccattgatccagtggttctaatttcctacccaggttgttttaaacctagtttctccagctaagttaaaagtgtgcccaatgggaaaacatctaaatcttcctgcgagcccattcttccgggtgtcttggtgtggacaaacctctaatcttccagtgtcttgggtgtggacaaacctaaccttccagtgtctttctggtggacaaacctcttaaccttccagtgtcttgggtgtggacaacacctctccagtggggggggtgcatctgaccctatcccaaaatgccttaggacgctcatctccttgactggtctggccatcccctcccaaaactaagtggaggctcggtctttccctccaagttggaggtatctcattctcccagtgtctaaaagtgatcaatatgcctagagtaaatgctgctgacaaggcaacagtagtaatccgtgccaccggggaagcaaaggctgtgggtttgacaggggaaaccgggatgtaagaggctgatagataagcctaagaggcca

SEQ ID NO: 681914 - DNA, 354 bp, Homo sapiens
  misc_feature (46)..(46): n is a, c, g, or t
  misc_feature (52)..(52): n is a, c, g, or t
  misc_feature (88)..(88): n is a, c, g, or t
  misc_feature (149)..(149): n is a, c, g, or t
  misc_feature (177)..(178): n is a, c, g, or t
cttaagggacaacccttccttagtcaaaagagagaagaggcaccancttaanagatcgccagttgcctggtgcagtggcttcacaccnctgtaatcccaacattttgggaacccaaggtgggtagatcacggagatcaaggagatcaangaccatagtgaccaacatagtgaaaccnnccatttctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcgagacttggtttcaaaa

SEQ ID NO: 681915 - DNA, 860 bp, Homo sapiens
accaatggctcttctctcgtttacaggatgtgcgatgacgtcgagcgcctaggttccgtttcagacctggaagagaactttggagaacaatagtcttctccttccaagtatgtggacgtagtcctgtaaccacgaccccagacgttccgccgggatctacctgtgcttatgtcaccaactcagagctatcaggaacgcaccttccagacgcctgatgtaatatgcgaacagtcaatttccggtgaggtcttgtgatgaagctggatgagctgacccgtctggcagcagcctttccctcaagtcctttctgattctgtccttccaatgcatcacccggcctcgatactgctgctccgtgaacattctgaatagaacacagcctggctcctcggaggaggcaggaggccagcgaaggctacgaccaagccctggtagcagctgatccgggactgcaatacacaatgtccagagtatgcgacggacagaggagctaatctagctgagccagacagattgagtttgagtgcaaaatattcccgctcatttctcagtcgactgctggctgggtgaaaagtgcggagcgtgacatgccttggagttcatgtgcgttccccagggcatacgaaggaagctgagcacgcgtcagtccagctgcatctcttcaatgactgtctggctgctgtctcggcgcgagagggtagccgattcctggtatttgaccatgctcccttctcctccagtcggggggcaaacgtgtgcacatgaagctcacatggacctcacaaaaagctgttccgactctttctgcggagaacatcaggcgccaggccgagtcctctccggacggagattcactgaag

SEQ ID NO: 681916 - DNA, 964 bp, Homo sapiens
tttattcagtcgcgcgggacgtgagctgtaagtatgtaaggctggtgggacttcggcccgtcgatctacagagagagattggaatctgcaaatcgccgcctggcaagcgatgacacagtgaggcccaggccggcagtcagtgacatggtggccaagctgcttgctcagagctacgaacatgcagcaggagcaagagaagctggagctgagagatgtgcactgctgctgctggcgccatctgaggaccagctgtgcggctgtgccgagctgctggatgcaggctctggtgcaatgctgcagggccgggcagctcgatgccgaagatggagctgcgcaagaagcatggcctatgtggagaaatgtggagcggctgcagcaggcgctcgggcagctgcaggcagcctgtgagaagcgggagcagctggatgctgcgtctgcggactcgcctggagcaggaactcaaggccctgcgtgcacatgcagagacatgtgcaggtgccccaggtggtagcagtggcagtggtgggtctccagagctcagcgccctgcgactgtcagaacaactgcgagagaaggaggagcagatcctggcgctggaggccgacattgaacccaaaaggttgggggcaagcccagtgacacacggtatctgggaggaacgtgccatgaggcagtttgccatggatgcggctgccacggctgctgctcagcgtgaaaccactctcatccgagattcccccaggcctcacccagcagcagcttcaatgaggggtctgctcactggtggacacaggcatcaggagatggaaagcacggttaaccgggtggctccccatttgtggcacccccacgggacaattccccctttggggcggacagagaaaaacgcggggcacatttagccgatagagcctggaacattcccaaaagggggcaccctttaagtcaaggggtcccaggagac

SEQ ID NO: 681917 - DNA, 504 bp, Homo sapiens
  misc_feature (84)..(84): n is a, c, g, or t
  misc_feature (149)..(149): n is a, c, g, or t
tcaagacggaacaatgtagttttaaaaggtttggcttagcccaccccccggggaaacagcagtgattaccctttagcaataaangaaagtttaattaagctatacaaccccagggttggtcaattttgtgccagccaccgcggtcacangattaacccaagtcaatagaagccggggtaaagagtgttttagatcaccccctccccaataaagttaaaattcccctgagttgtaaaaaactccagttgacccaaaatagactacgaaagtggttttaacatatttgaacacccaatagttaagacccaaattgggattaaatacccccctatggtttagccctaaccctcaacagttaaatcaacaaaattgttggccagaacactacgagccccagtttaaaactcaaaggaccggggggggtttaatatccctttaaaggagcctgttttgtaatggataaaccccgatcaccctcccccctttttggtcagcctatataca

SEQ ID NO: 681918 - DNA, 838 bp, Homo sapiens
atcaaccagtggagtgcaagcatagtggaacaatccttaacacacttggttaaggttgggaaaagctgataaatattttcgtgacctgtgcagtggtccatgaagagcgcatatgggtttcagacaggcagttcctgtttggtgggataccacatctgatggtagacctgtaccgtcaagcatgggatgaaccggaccatgaactgtatgtgtcaactgtttgttgccgatagctatcgttctttaagctgactaataaattgttgggcgtagaagccatgaagcttaaggaatttgtcagtgtatcctgttccatagatagagagtaagtaggtagttgactaggtgtgctagagtgaaaagcgtgcaatatgctttaaaggtatcaacaaaaactgagtatttataagcgagcaatgatcatgagtaacttgggcagattcagctcatattctatacgaggatgcgtttgaaataggagcaaagttgaatgctagcatgaaatatacatttcagaaaatatggcatgacttgacgaattgcaatcgtatatttacaccagtttgttcactgaatatcttaggtacctaaggtgatggggacactccattcagatgatcaaagttctctttcaggtagagaagttcaacaggaagtaacttatcttgaccggaaggaagctggcatggcttacctgttggcacacaatgtggggcacttcagcactaacgcttgttgtaagtcatttagaactttcttgccctcagttgtcctgacatgtccggggaacgtctacattttttcaattgccttacaatagaagtataggagccaccag

SEQ ID NO: 681919 - DNA, 763 bp, Homo sapiens
  misc_feature (481)..(481): n is a, c, g, or t
ccacgcgttcgaagagacagtgccttttcagcagcagatactggtgagatgggggtggctcaggctgttcttcctcctcctagatatgtctggtagctgtattctacattcagcataactgggtcccctatcacaaggtctactggctaataggaattccctcctggtggccaccatcgtggccatgtacctttcctaagtcttcgctcaaagttaagcaggtctgtgagccagctggcttgagtgaagtgtctgaggcctgtgggggctgacgtctcgtgacaaatgtctaaggaagactcatgagtagcaccaagatatggttagtacctccttgaccccgtctgctcccgtactatggttcctggggcatgtgctgggcggcaacgagcactctgaggagaacagacgctgtgtgctaggagggaagaagacccagacatgtgtggtcgatagaattggcgtcgatgcaaatgcaacngatgcgagcgtcttgcgcacgactatgggggaaaccgctaggggccataatacgaacgacaggtatccgatccgagggggtcacagctgtcctcgtgcgaaccttccgtattgttcttgtctcaagttgcgtcgagggatctaatgttacgttggagcacgcgacgccgtcgtggctacaggggtcggtgattgtgtcctcttcccgagctggtccgccgtcacgctagaggggcgttacgttttccatgtgggggattgccatctacctttgggtttccag

SEQ ID NO: 681920 - DNA, 749 bp, Homo sapiens
ccgctttaagactcttttggcaagctatcaaatccctgggtcccccaaacccgtgtacctctgcttcttgccccccccactttgtcaaactaacccatataatggagaattaatacgctaagcttttccacctgaatataaccaggtctcgcaactttcaaatatctgggggcaaaataaaaggaagtactcccagattgaattggtaaaatgccacctacagtccataattacttgattattctcaacatctacagatctcagaatagcactgccaccgaccgttacaggaccataaagactactcctatctgcggtacaactagctttctatttagttctagatgttgaaactgacgatgcctgacattagaagtcacatgtgaccaaaacgtgtctcccaatgcttgactagggcaaaaacccctttccatagaggagcaatgtgccaccatttccacatatatcggcttatcccacggggcacggcacattgatatggaatttttggttttcgtgcaagttaaggaaaaaaaacaaaacaaaacaacattgttttcggggagaaagatgaggagacaaagattagatcttccacaagaatataaaagtataccatatagaattagtaataagaacaatagtagaacccacaatattagaaagggagacttgaaaaacatattaaagcaaatcatagagtagggattacaataataaaaataaaaaacaggacaaagacatgacgc

SEQ ID NO: 681921 - DNA, 182 bp, Homo sapiens
cccagttcaagttacgtgggaggctgaggtaggagaatttccttgaaccctgggaggcagaggttgcagttaagccaagatttgcgtcactgtacctccagcctgggtgacagaaacagaattagtgctcatatacccacacaaaattgctgagattacagatgtgagctatgaatgcccgg

SEQ ID NO: 681922 - DNA, 892 bp, Homo sapiens
gagcggtgtcgccggctgacaggactctcgcattctgtatgtccggcgctccgtcagtcacgttactctgacggatacgcgaagtaggaagaagagatcgccgagctggtcattgacaatggctccgtgcatgtgtgaagctggtttatgctggggacaggacacctctctgagaccgggtgtgtattccgttacgcatccgtcgcgagcgcctcaacagaagcaccgaggtggccgtcagtggctggtgcagtggcgccatgtaaggactcctagcgtgcgcgcacgaggcacagagtgaagcgttggtcgaagtcgctgacccgtggaaagtaacaccctattgaagctagtggcacttcgatcggtcgatagctgggaccgagcggatgcgtaggacatcatcgtggcgacatcaccgtttctacagagcagaatctgctggcgtgggccccggacgggagcacgcagtcgctggtggaaccgaggacccctccatggaacctctgagaggtccgacaagtagaaggaacgatgaacatcagaaatctagtgtgtgtgagccactcgttcataactaccccacggaagcaatgttaagcgttgggcccagtctgagtggggccgtggcttggttcacatctaaggcgcgtactggggctgcaacacaatccgtgggcaattttgggtctataggcacagatcttggtagaactggcgggatccaagcgcgacaacggcgctgtctcatacgtacataaagtgatctagaagcaccgcatccggctggatagcccaatcgcttggcggtctggacccttgggtgggccgtgcgaaccctgagacacggatttatcatcctttgacaagactccggtcatttgaagacgga

SEQ ID NO: 681923 - DNA, 400 bp, Homo sapiens
atccacctcctatgactgcacgaaacgggatcaaaacgaccccactaggaatcacctcccattccgataaaatcaacttccacccgttactaacacaatcaaagacgccactcggatatactaactctagccttcgtctcctataatgacatttaactctattctcacgcagacctccataggcgaccccagacaaattcataccctcagccaaaccacttataccacccctcccccacattaagcccgcacatgatatatacctatgacggctacacaattctccagatccgtcacctaacaaaactaggaggcgtccttgccctaattactcatcccatccgtcatccctagcaatcaatccccgatcctccgatatatccacaacaaccaaagcata

SEQ ID NO: 681924 - DNA, 964 bp, Homo sapiens
  misc_feature (9)..(9): n is a, c, g, or t
  misc_feature (37)..(37): n is a, c, g, or t
  misc_feature (234)..(234): n is a, c, g, or t
  misc_feature (537)..(537): n is a, c, g, or t
  misc_feature (635)..(635): n is a, c, g, or t
  misc_feature (637)..(637): n is a, c, g, or t
  misc_feature (681)..(681): n is a, c, g, or t
  misc_feature (694)..(694): n is a, c, g, or t
  misc_feature (701)..(701): n is a, c, g, or t
  misc_feature (740)..(740): n is a, c, g, or t
  misc_feature (772)..(772): n is a, c, g, or t
  misc_feature (798)..(798): n is a, c, g, or t
  misc_feature (837)..(837): n is a, c, g, or t
  misc_feature (847)..(847): n is a, c, g, or t
  misc_feature (849)..(849): n is a, c, g, or t
  misc_feature (861)..(861): n is a, c, g, or t
  misc_feature (956)..(956): n is a, c, g, or t
gtgggtgcngcgtgactggagaccgtgtggaggccangtgtgccccgtgcagggatcaggagcggcgcggggagcggcaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttcnggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttcgtaggtagggctagtaggtagggttagtaggtagggttcgtaggtagggntcgtaggtagggttaggtagggtcgtaggtagggttagtaggtagggctagtaggtagggttcgtagtagggttcgtagtagggctagtaggtagggntnagtaggtagggctagtaggtagggctagtaggtagggttagtangtagggctagtangtagggntcgtatgtagggttagtaggtagggctagtatgtagggnttcgtagtagggttcgtaggtagggctagtangtagggtagtagtaggctagtagtangctatagtaggtcctagtaggtcctagtaggtatagtangtcctagtangntatagtaggtcnagtaggctatagtagcatagagcatatagtatatagcatatagcatatagcatatagcatatagtctcatagtctatacgtctatagtatacctntccctccc

SEQ ID NO: 681925 - DNA, 359 bp, Homo sapiens
gtactacaaacctggcttgctgctgatgtgcttcatcctgcccacgctcgtgccctggtatttctggggtgaaacttttcaaaacagagtgtgcgctgccactttcttgcgatatgctgtggggcttaatgccacctggctggtgaacaatgctgtccacctcttctgatatatgtccttatgacaagaacattaacccccgggagaatattctgggttcacttggagctgtgggtgagggctttcacaactaccaccactccttttcctatgactactctgctactctggaaagagcacttttcagagtagcacttttcacagtagacttttcagagtgtcatatatttgaaattgta

SEQ ID NO: 681926 - DNA, 143 bp, Homo sapiens
taaaatctgtttttccaaaaaaatttcactgccttaatgtgtccgggaaagggtgcccccccaagttctatggacttgtcccaaagctaatatttttatggcctatggtcttgtttggcccttaataaaataattgtgttctt

SEQ ID NO: 681927 - DNA, 111 bp, Homo sapiens
ggagtcagagctggccaacatagcgagaccccccaactctttttctaaacacaaagagaaaaaaaatcccaacctgagctgacagagcttaattttttggattcctttcgc

SEQ ID NO: 681928 - DNA, 101 bp, Homo sapiens
ccgccggggtcatcggagtgtctcgcaaataagtggaaactaatcaacatacttcaaaaataaccagtacgggccgggcgacactccgatggctcaggatg

SEQ ID NO: 681929 - DNA, 145 bp, Homo sapiens
  misc_feature (69)..(69): n is a, c, g, or t
ttcttcataaacagtgcgatctcacggtagtgccatcattctggtcactgccgtggagatcccaactgnttatgaagacaggcggagctaagagggaatccagagagcagctgcaggagggaaagctgtcattggccttcagatg

SEQ ID NO: 681930 - DNA, 259 bp, Homo sapiens
tttttttttccaaaaaagcccccccccccccccccaatggcaaaaatggccccagggcccctttacttttttttttgtttaaaaacccccttcctttgccctttaggagaattcccttttggcccccaaaataaaccccaaataaacccctttgggggttggggtttcccttttgggttgtttttatttttttacctttggggccccggttttttttttaaaaaaaagttcctttttataaaggggctgaaaatggcca

SEQ ID NO: 681931 - DNA, 103 bp, Homo sapiens
atcgagtgattatacattcctagtcgccaagcatgcctctagtctatgagatctcccccgcactagtggttgaactaagatattcctaccagaagaacataca

SEQ ID NO: 681932 - DNA, 639 bp, Homo sapiens
  misc_feature (50)..(50): n is a, c, g, or t
acgaagcgcccaaacctccagaggagccaacccttaaacactcagtaganccgacgagctagctaatgcaggaataaggacgcatgctttgcgccaacgccctcgcataaggagaactctggatagaaacgatcgatcaagcgcctgctcacagtcgcacccgggatagctgatctggtcacacgcacggctcaaatactatgaggataacatcatcgcgggagtcatttgtccgtaaaatttggaattgtatagtagaggagcttcaactgaccttgcctcgagactgaaggctgttatccagtatatacatcaagtgcactagaagtaggacaagaagattgcatacagtcactgagttattcttatagttgattatgaatgccataggaactccaaaaggaacctgtttgtataatgacacccaggtacaaagtatgtgattccaggaagtgagccaggcgccgatgtgtgtctatgacccctcttgaacctcctatgatcacagtctttgaagtaggactgagaactggtcattctctaagtgacacaagtaaagtaatagctagaacagaagaaaaaggggtcccgaaaatgtaacctttaaatttgacgcttggaacgtactgatagtaagca

SEQ ID NO: 681933 - DNA, 104 bp, Homo sapiens
cttccccggaatctgcgcgatatcaatactggctatatctcttctcgcgtagtgccgttgtttacacatgattgcactttgtgggtcgcaagcgtgactacata

SEQ ID NO: 681934 - DNA, 484 bp, Homo sapiens
  misc_feature (250)..(250): n is a, c, g, or t
gagacgggggtctcagctctaacatactcttatccttaactggattaggacttcaccaactcaccagcggctccttctccggctacacggagcacatataccagaaacccacttatttaattatttagaacatctgagcaagtagtcagttaattttaaaaataagtgcaagcatagaatcatgaaaaagttttaaacacattaacggttttacctttttacaaataagtctacattcatgcaccagggntcttttccttatttatagcacgaatctgtggacccagagcggggtgtcatctttcttaaataaaccacatcaataatatacatgcggtgatttacagtttcagtttcttccaagggggaccaagaagcttagagctttggtgaaaccaatcggcagtgcagaagaaatcattctagaatttagtgaaattttcccaagtctttcttagtggggtccagtctactagcaagccaa

SEQ ID NO: 681935 - DNA, 1027 bp, Homo sapiens
ggtcgcggcgcctgtactgactctaggaagtggctggagttgtttttgactgggcgcccgtaagagagtgtgggcacagtactgtgttacatgacgtgacacgccgccctttagtgcggtcaacggtgtggtgcgatgcagactgttctgccccccgtgcagtctgtgcctgtgtgtcactacccaatgatgccttatggagtgctgtgaagcatggaacggtctgcaaactgttccctgagctgtggcctctgcgtgctcatggctgtggctgtttcgaacttgtggcgccggtgcacactgcccagtcccgagatgcgctgagggttcccttagcgtcgccctcaccccgtgcaacccagcggggcgccagagtcctggccctttaaactgccgcgctgtgcctcaggcgtcttcgtttcgcgcgccctgccctgcggcgcacggcggagcgaacatggacccaggctgcgcgggtggtgctgggcgctgtggcctggtgggatgcgccttgggctggacggctgggagtgccgccccaagccgctgctacccactgcagagcctgggctggcttcgctgggggcgtgcgggcggcccgagaccccagagggctgcacgctcgtaacggggaagcccgcaggatgctgggagctgccggcgctgggcctgggtggggagccctggggctgtaccacacggggacggtggcaaccatgcgcgcccaggagcatccatgcagaagcggctcaagacggcgcaagtcttccctggtccaggccggcctgcaggttgaaccctgttaaccgagtacaaggaacgtgtcccttctggaggaaggttccgagcccttcctcgaactttccatggcctgccctaccagggtggtggaggtgaaccctggtccgagggctgagatcaaggtcgtctcctagagaagcggtgcccatccttgttggccgtggacgagaaactcgcgaagataatgagtctgtggttaccaagggcgtagaactaccagggtcgg

SEQ ID NO: 681936 - DNA, 135 bp, Homo sapiens
actgtgggttcttaccactgtgcctgcttctggcttctcactgcaggacgatggccgcacttgccgcccagagggtcaccctccacagcctggaagccccacaggagcctgcactgaagtcagaattttcccagg

SEQ ID NO: 681937 - DNA, 142 bp, Homo sapiens
gggggcgcaatagatatagtcccgcaggggaaagatgaaaaattttaaccaagcttaatatagcagggactaacccctataccttttgcataatgaattaactagaaataactttgcagggagagccaaagttaaaaccccc

SEQ ID NO: 681938 - DNA, 146 bp, Homo sapiens
cgatggatgagacggcttcagttacttcctcttgacccacactgcctcgtgcacactgtggctgctgctgtcacatgctgccgatgcactgtcaccggctcagtccctgggccccctctaccctcaggcataccccggccacgttc

SEQ ID NO: 681939 - DNA, 838 bp, Homo sapiens
gccagcgccgcggctgccgcctctgctggggtctagtgctgtttctctcgcgccatcactggccgccggccgcagctccaggtgtcctagccgcccagcctcgacgccgtcccgggacccctgtgctctgcgcgaagccctgtgccccgggggccgtgggtgcatggtgccacgtgggctgcgtgggtgaagctggcttccctgctgggtgcctgtgactggtgcgggcttcgagctcatgacagacccgtcataggccgcctactccgtgtggtcctgcgccggctgagcgtcagggccgaggtctgaccggagaccatgcgctctcacggaggacctgcgcatgtcgcgcgaggaggtctgggagatggggcactggatccagtcatcctctctcgccctccagtgacctcttctctgtcgacctgagctcaataggtccaaggtggacaaagcagcttacaggtcatctcagtgcatccaagtgggtcctgtccttccttgtactagcgagatggcctgaaagttgccatcctcatgtacgatattctagcagctgatttgctggcttcatcgcctgtgcctctacattcactttggctggatgttagacttggaacacacccaagaaaggtggccacggacggtcacagagggtccgaaactgggctgtgtgacgctacttcgagactacattagccaatccagcttggtgaagacgccacaaactggctgaaccaacagggaactatatcttgagatacaagacccatgggtacaatggactgggtgcctctgcaagtttaaggaacagaggcacaccaatgagcagaagtcc

SEQ ID NO: 681940 - DNA, 200 bp, Homo sapiens
gataaaacatcggcataaagcgatccccaaaatgtccacgatgtgtgttatcagcagtcacgtatttgagagcagctatcaaaactatagtcatggggtgacagaaaaaagattctcatcctgaatgattacatgtggaatctccgcagagaaatgcacattcttataaagaaccagatagaaggataatgacatttaaa

SEQ ID NO: 681941 - DNA, 282 bp, Homo sapiens
taaggatccgtgtgcagtgtatcagttacttgggaggctgaggaagtgaagactgttgagcctagcggttggaggctatctaagcaaagagtgaaatgtgtcttaaaacattaaatccaatggacacagagagagacacaaaggagatgatgtcaacatcggatgggccatccgtctgcaaatgttgggagaagaacagctggggaatggtgcctggagcaagacgggacactacctcagcctcagaagcaaccagccctgcaatacctgggtctcacatgg

SEQ ID NO: 681942 - DNA, 171 bp, Homo sapiens
ggcacctggagctagatggacagcaagaatttcgatgactacatgaagtcactcggtgtgggtttactaccaggcaggtagccagcatgaccaagcctaccacaatcatcgaaaagaatggggcattctcaccctaatagcacacagcaccttcaagacacagagatcagc

SEQ ID NO: 681943 - DNA, 80 bp, Homo sapiens
ttgtccttaaacgttatgctgaatagttgttgaaacagttctcattttgtagtatttaataatcagggaaggaggctttg

SEQ ID NO: 681944 - DNA, 167 bp, Homo sapiens
gagatgcttttccatagtatttcacagtcacatcatgttcagccatatctgctagataagcagcactctcttgtgatggctgcgccatacaaacaacatcaagatctgtaaaagcccctgcttcaattaaatcaattttgccaccaccatcttcttctgcagccgtt

SEQ ID NO: 681945 - DNA, 679 bp, Homo sapiens
acttcctttgtcgggtagaaaatgaagggttcttggagcgtaggggcgctgcttgtctaagtcagtgttctggtagctgagtacacggttgatgctcttcacacacagcgggggtccacttttatagaggtctggaggagtgatctcgcggtgcggagaaattggtaggtttattcctggaagatcatgtgggtacacacaactagtgtcttaggaagaacgaggcttgtctttcctcccccgccaccacgccaggccccccggatgtgtcaaggtgtggagatcgcttgaaagagtagctcccccacgtttgttgaatatccacgccccttcgaatctaggtaagtgtgtctcttcacgcaacaaacaactctctgctggagtcttttcgtggacgcgcctaaagagatgacgccctctccctcctcgagatggccgtctctatagatgacagatagatatctagtgttaaaacatatcttcctataggcgcgctagaaaaagacatgttgtggatgaaatacactatttcgccccactttcatcgctgtattgtgcgtgcgcccgctgcctcctaaggcttaggtcatcttgccactctgggcgcgcccttctgtgggtaccacccctccgaattagaaaatcaaccatgggagggccgatcaatagacgagaaaat

SEQ ID NO: 681946 - DNA, 146 bp, Homo sapiens
cgctatgttgaagagatatacccatttgaaggcctcgcgactggttaaaaagctcgaaggcaacaaacaccgcggccagcaggtggtcatcaatcacctggtcccgtaccccgccataactcagcagacgcccacaggcgttgttg

SEQ ID NO: 681947 - DNA, 260 bp, Homo sapiens
gagcaggtgagaggaccagttaagaccagttaggaggctgctgctgtaacccagctgggatagctgtgtcctagggcaagataacaacaatgaggatagagagagtggacacgttggataaagtttagaatcacggaacttgctgactggagaagagggcaaaagcagagttagcacaacacatgagttatgaccagcttgagcagctcagcagggggtggtggccatttacagaacagacatggcacgcgacatcgcca

SEQ ID NO: 681948 - DNA, 121 bp, Homo sapiens
accccccattttttttttccttggtttgtttttgggaggggggggaattcccccttaccctttcccccccaaaggcttttggttttttttttttcaaaaaaaagctttccatggggggcca

SEQ ID NO: 681949 - DNA, 1168 bp, Homo sapiens
  misc_feature (342)..(342): n is a, c, g, or t
tgtcggggacggtaagccgggaccacggtgtcgtgctcctgtcgccttcgccatcctaagtcccatagcctacttactgcgtgagtgcagtcttctcgatcgctagcgtgggccaggctggtgtccaagtatgagcaaatgcctgcatgagcgagctcttactgcgcgtggaacacgggcatccagtccgcgattggccagactgccaagtgtacaggtactcatagggtggaggaggatgacctcctttcaaacatcgcattcttctaggtgatgacagggcgcttgggcaagtcgactgttgctcgccaggagtcgtgctgtgtggctagactttgggcnatcgcacaatcagtctattgtgatggaatggttctgctacatggcggacgcataaccgatcgaggtttcttctcgagcccatgaagacatgcgtcaagtcaccagggctatagggcagacgtatgcgttgcgcaatagtacacctaatgtcaccccgaagtggggcatcatcactagcccattcttgtgccagatggcatggatcaattggaaccttatgttagtttggaccccggacatatctgccaaaagtctcgggctagaacccatgcttgtcatcccgtgctacttaccacggagctttcttctggggtctatatccaccgagccttgagcggttggcggggcaaccttggattcatggcgcggttcaaggcttccccctagccatctatggagaaagcaggtactcctagcaggttcgaattaatcgcgccgactgaacggtgcccaacggcctgggggacggttcctgcccaatttttacaccccaggggcaatcggcccaagggttttatcccaaatggcttggtacggttggaagggccttaacgaaagttccccaataccgttcaaagccaatggccaagaatgcaaagcccctgggaatgtcacgctccttgagttgggttgcgccctttcacagtggggctcccagaccacgtgggatggggcccacgatccttattctgcacctttgttgggctcgggtcgaccaagagcccgtcggagtatatccggaggccggccccaaagctttagagttagtcgcttttagaccgggcgtaatataagacgcagcattgatgggcccccccataacgtg

SEQ ID NO: 681950 - DNA, 728 bp, Homo sapiens
gagagtctcgatctgtctcccaggcttgagtgcagtggagagatctcggctcactgaaagctctgtctcctgggttcatgccgttgactccgtgccttcatggcttcccgagctaagtctccacggatgtaagctagggacatacaggagtgtccagtcactcagcaaaccctatgtgtaaacatttttctgaggtattttcaagtagtacgaatgtgcgcgcttaaacactgcttttcatgacagcgataggttctagatactaacactgagcctgctgtgactcccgacgacgacttgtgactcgcgcaaaacttgcgtgggacttataaaagccagtagaagtaactagacgactctcgcggggcaagacattctgtcagtggattttgatacgataaaagacctggggtttccaccgattttttggccaaggaattggtcatgcctaatctcgcaatccttgttcgcatgctggtgccactgctcagctctgcgcaaaggtgcttgaaccgaattgctagggtgattgtacgtccacacaattcgcgtagtggcttttaaatggtgttattcgtaataacttattatcaaatgagtgctgatcttgttgattgaaacatttggtcttggggcgtcctaatttaactatacattttaaagaattgagaaaactaggtggtcgttaaaggggagttcacgtattgaatcccacgatttgaaaccca

SEQ ID NO: 681951 - DNA, 106 bp, Homo sapiens
ttagtcatactgcatgtgctgggaaggtgcagaaagaacctggacccatgttctctgtgggtggtgcacaaagctcagcatggtcccgagccccaagagtaccctg

SEQ ID NO: 681952 - DNA, 189 bp, Homo sapiens
gcattttcagaatcgcagatgatgctcacccaagagtagcacttgttaacggaggccatcaccaacatacatgtacaaaacgttttaatgtggacgatcaagactcagaggaaatttgacacgaccatctgtgtaaggtgttgccgcttaatggtagctgcagcaaagtccacttccatctgccttacc

SEQ ID NO: 681953 - DNA, 408 bp, Homo sapiens
  misc_feature (4)..(4): n is a, c, g, or t
  misc_feature (66)..(66): n is a, c, g, or t
  misc_feature (112)..(112): n is a, c, g, or t
  misc_feature (139)..(139): n is a, c, g, or t
  misc_feature (403)..(403): n is a, c, g, or t
attnaaaaacaaaacccgtgtgtgaaagaaccaaggagcctgaaaacctgcacctgccccatgaancccaagttccctcaacatcctactctgtgaccctatggcaggaggncccccggaaaaggacatgtgcctcccncccaaggcagagggctcccccccttttcagtttgtgcttttgtatgggtattagccggggttctctagagggacagaactaataggatatataatgggatatatatatatgattgtggaagtcaatacttaataacacaatcacaatcttgtgatcgtgaatgttaatacttaataaactcccgtgtgtgtgtgtgtgtgtgtgtgtgtgtgtgtgtgtgtgtgtatataaatgcttgtaaacagtaatctgccaaaactgatntaagt

SEQ ID NO: 681954 - DNA, 187 bp, Homo sapiens
ccatcactaaccattacggaaagacaaaccaaaactgcaatgaggcgcaacactttggtggatcactgaggtcaagagttggagaccagcctggccgacatgtgtgaaaccccgtctctactaaaaatacaaaaattagctgggcgtgatggtacgtgcgtatagtcccagctacttggtaggcccg

SEQ ID NO: 681955 - DNA, 699 bp, Homo sapiens
agtttgaggcttaagaagctggatctcctgccgggcgtggtggctcatgcctgtaatcccaccactttttttttaaggcaggcggatcacctgaggtcaggagtttaagaccagcctgaccaacattggagaaaccgtcgtctctactaaaaaaaaaaaaaaaaaaaaaaaaaaaaaactgggtggggcgcggccccgcggcccccgcgaagaagacctttcaagacacaacgccgggttggggcgcgcgcggggcgccccaaagaggagaacagggaacacaatggggcgcaaaagcgcgggtctccctataagagaaaccctcggggaccagagagacaaagggcgcgaggaggatcttccacccacaataaaaaaaagacgccgcgggcggggggcaaacacacgagaggcgtaattgcgagagaaaacaatccccccgagagaggggaccactctcgagggagagactataatagagggggagagaatatatctaacacaaagagggaagctctcccacgagaggagaggccacgagaatcaaataagaaaattctagccccccgggagagacggggggggaaaaacacagtgacaagcagaagcagaggaaaacacacgaacaagaaacgaaacgacgagggaataaacaccacaggaagcaaaagcagcgaagagagacgacgaaaagaacac

SEQ ID NO: 681956 - DNA, 518 bp, Homo sapiens
tgaggggagtcccggaaccaatcccctacgaagaaaggaacaactgtatatatttccattttttcagattctgcttttatatctttaaagttttacaattttcttcatacagatcttatgtctttcttacaatatttaagtattgtataatttttctctttttcccaaatatattccaggaaatattttataatttttaacacttttataaataaaatatttttctcctcaccaatgcagttaattcccattcttcccctgccaatatcccagtgacatcaaataatgcttttacttaccacctatccaccacattaccctgtccaacatctgagttctgctgaaatcactgggaatgtttctttcagacgactaggttttctcttgcaatatgtttcttctggattcttacttagcatttatatcacacattccttgatattctcaatatatactatgtatatacaagcaggacctgaagtaaccttattttactcaatgttatgttataaagaggc

SEQ ID NO: 681957 - DNA, 169 bp, Homo sapiens
  misc_feature (25)..(25): n is a, c, g, or t
  misc_feature (75)..(75): n is a, c, g, or t
  misc_feature (108)..(108): n is a, c, g, or t
  misc_feature (147)..(147): n is a, c, g, or t
aatgcacttccctaagcctctgttnccgccaaaaaacatttcatttaataaacatttcttaagtgtctgctaggngccagcactgttccagggcctgaagataaacgnaggtgaaaacacaggaaaaagccctgccctcttgtagtnacagcaaaaaccgagattaaaa

SEQ ID NO: 681958 - DNA, 135 bp, Homo sapiens
tagacctcagatgaggaatggttagtaagttggtctaatctctctgagctgcttgtaaggaagttatgaggtagaagattctgctgacttttagtaaggtggacaagtgcgagaaaagagaaaagcagttcctca

SEQ ID NO: 681959 - DNA, 244 bp, Homo sapiens
gcggcggatggccgtgtccttggcatggttgaccgcgcgctcacggatctgggtctccacctccgtgcggatcttgaagacgacctcgcccgggtccttgcccttctgctgcgagagctcctgcgtgaacttcttcgcgaagcgctcgtcgatcttggagacgtccgccgggtccttgaagatgacgcggatgatcgaggtctctgcgccgtaggcgatgcgcaccttctcgtcgagcttggcg

SEQ ID NO: 681960 - DNA, 578 bp, Homo sapiens
  misc_feature (103)..(103): n is a, c, g, or t
  misc_feature (106)..(106): n is a, c, g, or t
agaggatcccggtattgagtggcatgtgaaatagtctccatttttggctttgagggggtcagttgggtgctgtctgttccgggttgggggaaagtggtgggtnganggagcaggttgggatggagggagtttacaggaagcagacaggccaacgtcgaagccgaattcctggtctggggcaccaacgtccaagggggccacatcgatgatgggcaggcgggaggtcttggtggttttgtattcaatcactgtcttgccccaggctccggtgtgactcgtgcagccatcgacagtgacgctgtaggtgaagcggctgttgccctcggcgcggatctcgatctcgttgagccctggaggagcaggccttcttgaggtgccagtctgctggtcatgtagccacgctgttcttgcagtggtaggtgatgtcctgggaggcctccagtggacatcaggcgcagaaaggtcagctggataggccacatcggcaggatcggagccctaggcggcatactcgaactggaatccaatcggtcatgctctcgcggaaccagacatgcctcttgtggttaggcccgaag

SEQ ID NO: 681961 - DNA, 1604 bp, Homo sapiens
ggtgccctggccaccgggtactcgcgctaagttagctagtagcagagcgctagcctcggctgaggcatgctccggcagattgagtctttacgctgggctcccgacggacgcagaggccatcggagtcgacgaccggagggaattgagggagctgtctagtcagcgggacgcggcatgtcgtctgctgcgaacgcgagtagctgctgcaggccaatgtgcagtacgcagggtatagaacgcaggtacggcaggacatgtgcattgagtactagcgggaaacgcgcggtgcatcgagccccatggcgcctctggcgtcccgagacatcgtggagggtcgtcaggtggagaccgggtggcgagtcgcgcacaccaaagcattactgcaacgcagacatcaactagggctttaagtgacacttgcttgtctggtgatctggactcgggtacgtccacccgggaagttatggagccattgctctgggttcgcggtagcggagtagcgtagggggacgcagccggggaatcgcggcaggtaagacggtacctggcaacgtgttggggcgcccaaggaagagtggcgacaattcacaaacaggccgcaacttcggaacgaggacccgagggacagggggagcacgccaaacttcataggaccgtctgatacggtgccgatcgtttgcgcagacgatgacacaagcatgaccaagcagaagattgactccgtggtttgggcgcaaacagcaattatcgcaaaacattttcacaccagtaggttggattccgagttgacacacaagtggcacacggacagcgctaacatagcattagctggcacgcacgtaggcggatccggtcctaggttccgcccgctttacgcggaagactaaagatagcaaaccgtggggaaaccagtatccacaacaggtatagaagcgagaattcaatattacgtggagagaaccccacaaacgcgcatttggacctctcaacagaattcggcagacagcacctagacgcgcaagagagggacagacattcgaacgccacattgggcgctcgaacaatagccacacagagtccttggacgccaggcggcaagtattaccgcccgaaaactggacaataaatgtcaagccatccctaagagctgcattaaccgcatgtgtagggtgctagacgctgtagagtccgtttggaccatataacatgcaaagacacagtaaacataaatagcttgaaatatacaatcggtatccgtaccacgaagacatgaagcaaaaagaacgagagagaacagaagaagcagacccgcaaaggacgacaatcaaaaataagaacagaacaaaagagcggaaaacaacagaagagcagcaagcaaacaacaaagacacacgagcgacgacacatgaggcaccgcagaatagagagatagtcaaccaacagcacaccacaaaagcaaaagagtgaagagagaactaaacacaaacggcagaaaaaaacaacagcacgtacgcggggcacgacacacgcacaagagaagacagaacgaacgaaataaaacaagtaaagaacacaagcgacacggactagccgcgagcaataaa

SEQ ID NO: 681962 - DNA, 267 bp, Homo sapiens
attagggttagaccagttgaccaggggggttagggttagaccagttgaccaggggggttagggttagaccagttgaccgagggggttagggttagaccagttgaccaggggggttagggttagaccagttgaccgaggggattagggttagaccggttgaccaggggggttagggttagaccagttgaccaggggggttagggttagaccagttgaccgaggggattagggttagaccagttgaccgagggggttaggggtcgacgc

SEQ ID NO: 681963 - DNA, 211 bp, Homo sapiens
tacccccccccaggggggggtttttttttttcccgggggggggggttttccctttttgggggccatgcccccctcccccaaggttttggggatgtttttggcccccccgggtgaaaagggctttttggggggcctttttttcgggccccccccaaggcccggggtttttgtttttttaaagccttgtggattacccccttttttgggccca

SEQ ID NO: 681964 - DNA, 289 bp, Homo sapiens
  misc_feature (87)..(87): n is a, c, g, or t
ttttttttacccccccgttccccggggggccccccccccctttttttttccccccaaaaaaacccggggggggcccccccccccggntttttttttggggcggggggggggaaaattttttcccccgggaaccccttttcccctttgcccctttttggggcccccttaaacccggtttttcccaaaaaccgggggggggccggcccgggtttcccggggttttttcccccccccgggcggggggctttttttttttttgggggcccttccccattacccccttttttta

SEQ ID NO: 681965 - DNA, 764 bp, Homo sapiens
tgttcagcctaagtttgtgttggagacctgggatctcgaggtcactggctgtcttccccaagatagtcttctcctgagagaatgaatttttccgggaggggaaaaaaaaagatcttggggggtttgggagaagcatctgacctccgtcgagtgcgagctgagctcatcactctgatgtgttggtattgaccctggttgtctcacagaaaccactccttgtccgatcccgattgcgggagttatcactgactccaatctaggctgggtttctccgtcctctcggggttggctctcctgtgggtgtaccactcgtcgggctgcgcgagcgcagttcttggcaggctgctgtttacaacagggagcgtaggatgtgcctcctctcacacggcgatgctgtttttcttgttccctcccggcagctcgtctcttcctggggtctgtgttttttctctgtcctcctactagtgagagttcttgttctccatgctcctcctactgatgttaattcacaactgaatctcatcgtttggtctctctcgcgatgttcgttcccgcgtatcctcatccgtgtctgtcgatcccgtctgtgccggcgtctctattgtgtgagttgacgatccgacgaactcctcctgtccagatcacacttgtcgtaccggcgaggactatcatttgtgttgttgcatctgcagtgcgcgcgggaggtcacaattgagtagcgcgtaccctactatgtactcttcgtctactcgagacgctcccct

SEQ ID NO: 681966 - DNA, 413 bp, Homo sapiens
  misc_feature (1)..(1): n is a, c, g, or t
ncttgctagctgcataaactcagagaattattgttggaaatctcttggcttcagatatctcatctctaccctagtcatgggattgtaaagatcaacagaatagacacatgtgtatacagcatgcctagaacactgcataatgtaaaccatttgtaagtcttagtgctacttgagaaagaaaacttaggcaggggttcaaagcaaggagaatgaaaaatcaatatatttatgggaacaaatgacccagccacagagtgaaccaattccagcctttctgaaagctttccaatcctgatctgcctcctctgactgatttgtgtcctttgtgtttgttctctgtgcatttagcctctcccgtggcatatcccatgtgagttattcattttgtgtgagacatttgcatgtaagtcagt

SEQ ID NO: 681967 - DNA, 411 bp, Homo sapiens
agtcatgactagaccctgggcccctgcacccccaacaccaggcagccaacacaacctatgggcctagccctatgccaggtacaatggagaatatgaataagaaaatataccccctgttctcaagaggtttgcaaattacttggggagacaagagttgtcttttgagggcagtgccaattcaggtttcagctaagagacatcagtgggagctagaatatggggaaggcttcctggagaggatggatggtactggagctgggcctgaataggtggaaaaaaactagagaacccaacaaaaaaaataagagctggaaagaaaaaaagaaaccatttgttccaactcctcatttcacatcagtatgataaagtcttaattaactataaaatactacataaatgtaaaaaaaaaaa

SEQ ID NO: 681968 - DNA, 135 bp, Homo sapiens
aggaggtagcgcactcacaaacagcaagatgtgctacggacccgcgtaaagacacggggatgtggagacacacttcaccttcaaggacctacacttcaagatgttagatagagggtggtcagcggtctagagcgg

SEQ ID NO: 681969 - DNA, 161 bp, Homo sapiens
ccaggattcatttcgctcccaatccgtgcgcaagtcttaatcttggcttcaaggcacagcatcagacaggaaggccaggcaatgcttaggcaactaaaatgaggtggggggtaatgctaacgtcaccctcacagggtatggccacggtggactgttattcg

SEQ ID NO: 681970 - DNA, 971 bp, Homo sapiens
gtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaacatgtgtgccttgcacatacaaaaaagaacctgttcgtatatctaatggaaactaaaatatggacactgaagttctctcataactatttcaacataagactccacttgtccttctccatggttttcggacggaggtcttgggctctgggcactgaactttcggagatctttgcaccaacagacctgtctatgcttttgacctattgggctcttcggcaccgacgctagtagacccaggcttcgcacacgcctgactgccacgcacacgaacgctggcagcaactcacgcttctgctggacatccacttgacacggacgctgcgcacgactgctgaccctagcgcacttggcacaacacactgactcttgcttgcggcacaacctaggtggatctccttggctgctgcttactcgctgaagctacccatcacaggcgttaactcatctcactttctacgtgcgagccttgcgggcttctccctgaacgaccagaccttgctgatcaagacagaccaattccagtcaggatcagagccttgggagcagcattgactccctttaaccctttagctggcctaaggattgcaggacctttggttcaagtctagtgcagcgtctcacggcctgatttcaaacgaaacgtattcttcaatcgtccgaaacgactcctgctacacaatacatctaccactgtcatgtccagactcccagtgccaacacagctttcaacaatcatactatccccttatccatgccccacaccgccctgccccaccaccctcgcctaaattgcac

SEQ ID NO: 681971 - DNA, 1199 bp, Homo sapiens
  misc_feature (1199)..(1199): n is a, c, g, or t
gtgaggccgaggctgggtggcctccaggccaagggcttgggccccatcctgagtctccaggacccaagggcaagagacgccaggcttgggcagcaggagggaggatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctggcgcgcggccn

SEQ ID NO: 681972 - DNA, 200 bp, Homo sapiens
tcccgttcacttgctacagcaaagagaattgtaactcctcctgagacaaacattcctgctacaaacataaattttgctccaatatgtacaagatagtttccacaataccaaggcatgccatgcaactctgaacaaagcagaaacatccaaatgatcataccagataatgtgtagaaagttgaacagggtaccgatgctcg

SEQ ID NO: 681973 - DNA, 270 bp, Homo sapiens
  misc_feature (30)..(30): n is a, c, g, or t
  misc_feature (270)..(270): n is a, c, g, or t
acaccccccacactccccctcaccggcccntacatggagaggaacagcacagccccggcggacaggctgccctgtgaggcccggcccaccccggcccaccccccaggctccccctcacctgcccctgccctgcccccaggccgccacctgtttgcgggcacggagctcacggacctggccgtgggctgcatcctgctggccggctccctgctggtgctctgcggctgcctggtcctcatagtcaagctgctcaactctggcgcgcggccn

SEQ ID NO: 681974 - DNA, 1277 bp, Homo sapiens
  misc_feature (1277)..(1277): n is a, c, g, or t
atggagacaaggcctaggggccttggggccaggagggtacccccgtgagggcctgggctcctgggtaaacattaatgggctcagtacccagcaggtcatgtgcgcgatcaggggatctttgacctgcaactgctcccgccccatgtctcctccctgcaggtgccccctcaccacccacacagatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctggcgcgcggccn

SEQ ID NO: 681975 - DNA, 285 bp, Homo sapiens
tttttttggcaaaactaccttttgttaactcttttagggagtttcccacttttaactttttacccccccttttgttttttggggacttaaggtttggggctcccttgcccgggccgcccttccggggctccttttttaagggcttttcaaacttgtttcaaagccccgggctcaagttattttcccccggaattcccagggttggggttccccccctttttgtgaaggttccttgattggtcccacccccttttccttttggaaaattaaactttttttaatcca

SEQ ID NO: 681976 - DNA, 671 bp, Homo sapiens
gcaaccagcagcctctggtgttctgccttgatcgcctcaatggtgcttggagaggcaagcagctctatccctcaggcctgcacaaggagagagtcacttcctctttatgcgatctgtctcttacggtgaacccctcgtggaggttgatgcctgcctgctaggacagcatctgtgtgccttgacctgcctggcttccccgcaaaattctctcccctcatttacggccaccacgtgtcgtggtcaacaccgtggctcttatctccctctttcctgccttttaacgtgattgcgaggctctgctgcctgctgagtaaagacccagcttatggacctgacagacatactcggactggacagcattggaggaaaggctatcacttcttgaaagggaaaggaacaaggctcgaaggggacagcgagatccctgccctattgaccaaaaggaatccttgaggacacaagagccgggcctctggccggaatggaattcaccctgaggctctaggaggaaaacttcgataaagaatgctctgtcacttacgggcctgcgcctgatcctgttacctgctcttgataagcacgcaaagtagaaaggacggacgattgaacttgaactgtgtccaaactaggcaattcaccctgacaatcccgaattagaggtgagcatgctg

SEQ ID NO: 681977 - DNA, 82 bp, Homo sapiens
actgaagacagtgccacttacttttgtgctcttggggaagtccggccttctcctactggggccacgggccgataaactcact

SEQ ID NO: 681978 - DNA, 106 bp, Homo sapiens
acatgccaaagaaagcgtgcatattagcctatagaaccacagtaatcacactagagaaattccactgctacaataaaatgtaatcggaagcatctttacttataaa

SEQ ID NO: 681979 - DNA, 103 bp, Homo sapiens
tcctgcctaaggagtgccaaacagaaaggagagagtatcgcatttcggacttgcagaaaagaggtccagaaaacaattttcgggtctgggcagaaatggggat

SEQ ID NO: 681980 - DNA, 400 bp, Homo sapiens
  misc_feature (1)..(1): n is a, c, g, or t
  misc_feature (13)..(13): n is a, c, g, or t
  misc_feature (16)..(16): n is a, c, g, or t
  misc_feature (39)..(40): n is a, c, g, or t
ngaaaattaaaantanatttaaataaataaactttagannttgcatcccctattctacccctagtccaactccgccaatctactgttggtagtgaatcacaatggcaacttaccaaggtttctgatacagatactctggaaagaaatgttaaaacctcaagatgctactgcagcggtccctccaacgcgtctgctgccacattcacattatgagcaaggcatgaccgcatttgcacgcaaagggcatttcgcccacccacccgcctaccctctctccatccttctgccaaccccctcttccccaacctaaacctcacttcataatatctaggatccgccccccccactcccccacccagccatccaatacaagtctgcaagctgcaacataatcacataa

SEQ ID NO: 681981 - DNA, 127 bp, Homo sapiens
ctgtactatacacaatcttgaaggagatgtattcagcttgtatcaattcagcggctttgattccagcaagccacaacagttaaaacacacggctatccaggaaatttttcgggtggtatcaggggta

SEQ ID NO: 681982 - DNA, 425 bp, Homo sapiens
cacgaggccatgccaccgcgtgacaggccgatctgcggcggcgggcgctggtaggtcacttcgtccggccgcagtgcatcccagcggtcgatgggcgcttcggacgcggtggagggcaccggcttgtcgtgcggcgtgaccaccacggcgtcggcgcccggtgacgtgcagcctgccaaccagacgcatccaagcagcaacacagcgctagggttcatagggcctcagctgggcatcgcgcatggtgtaagcagaaccggccagatcatcatccagccgttcggcacgcagggtgccggccaggaagaatggcgagtacatgtccggcatctcgatcggctgcggcagcaccacgtgcacgatctggttcggcggcggcggtggcacgtggatgcaggcgccgtaatacgggacgaacaggaatt

SEQ ID NO: 681983 - DNA, 137 bp, Homo sapiens
ggcacgagacctggatcaaatagtgagaccccatctttacaaaacatttgacaaaattagctgggtgtggcagacacatgcctctagttcggtttacttaggaggctaggttgaggtttgtttgagtctggtagata

SEQ ID NO: 681984 - DNA, 387 bp, Homo sapiens
taccgaccggcctgctcggtggtgtcacccgccgcaggtactgaaaactgccgccgcgcccgccgcgcacggattgccagcgtatcgggcagcggggaatcggcgctcgactccatccagcgacaccgtgcccagctgtttcctccagttcgaccgtctcggcccaggtcttgggaatcagcagcgtgggcgtttcgggcaggtcggcattgacaaaggtgccggacccgcgcgaacgccggatcagggccgtccctgttcccagtctgccgaagtcctggcgtatggttgcgcgcaatatgccataaggttccatcagggctcccagcgggggaattttgctggcccggcccgccagggtgcgggcccctggaatttggctgcgaa

SEQ ID NO: 681985 - DNA, 177 bp, Homo sapiens
aaattgttgagcatgaatgtatgggtacaggagatcggtcgtacagagttggggctgtggcagaagaaactccatagctgggtggccactgtctcattgtccactacatgctgtcttgagcacagactgtcaaacgtggtcccgaggacagggtcctgcttgcccagctatgcatac

SEQ ID NO: 681986 - DNA, 311 bp, Homo sapiens
cggtttgccctgcaaaaacaccaatggggtttagtgcaggtggacactttgaacccctcctcaaaaaaaaaactttggctgattccttgtggtgacactcaaaggggtttgaacaaacttgacaattctgttctggtcaagctggagtttttttttgtgacttggactgctctacaaaaaacatcagccaactgcccgagtcaaagtccagggattgtccctattattaataatgtaaatggcttcaaatggggccctgcagataaaatcccaaaaacccctgttatattaaagattccccctttcctgga

SEQ ID NO: 681987 - DNA, 192 bp, Homo sapiens
ggcaccgattctcgccaagagtctgaggtgacatgcgaagccaatatgaggtcatggccgagcagaaccggaagtatgctgaatgcctgtgttcaccagcgcggactgaagaaattgaacgcgggaggtcgctggcacacacggcagcagctccacattaaggcggagtacgcgagctcgtaattcgtagat

SEQ ID NO: 681988 - DNA, 894 bp, Homo sapiens
caggccggagggaatgatggcggcgccctggtggcgatgccgcgctgtgcgagttgtcggagatggcggggtcttcagcatcctcggccgtcctgggccgccggactagcccccgctggggccgatgcccaacagtgacatcgacttgatcaacctggagcggcttggagaagtaccgtgagcttctgaccagcgtaccggctgccgagcagagcgaggaggctgcaggccccgcactggtggcggacctaccgagagtatatcggggagaatgacagatcccaaagagaagattgatattgtggctgactccatgccaaagtctctccggacccaacagctatctggtaacggaatacaggtccatccaggagtcttcgaggccaatgtggtacagagagagcgtggctgctcctgctctccgactacatgtcagatgtccctgctgggatgcctgtgcgtggccgacgtgtggaaaggaccttgtgggcccataccacaagtcagcgtctggctgagtattacggcctctaccgagacctgttccacggtgccacctttgtgccccgtagtccccctgcacgtgggctacgctgtgggtgacggatgacctgatgtcctgtgtacgtgtggcaatcgaggtgactccaaacgaggtaaccactcacttgtgccactcctcccatgcccttgtgcaaacacagacacatcccatctcagatgtcacagacactccctgggttggaccatcagatggtctgctgactctatggatttccctggaagacgaataccaatgaacaattttcaaagaaaagtagacacacacatgaaggaaaaagaagctctgtctttagcacattcctgtgaccgcctgcgttctgtgaggtgcca

SEQ ID NO: 681989 - DNA, 704 bp, Homo sapiens
aactcggtggtggcactgcgcagaccagacttcgctcgtactcgtgcgcctcgctttgttttcctccgcaacatgtctgacaaaccgatatggtgagatcgagaaattcgataagtcgagacttgaagaagaccgagacgcgagaaaaatccactgcttccaaagaaacggattgacaggagaagcagcaggcgaatcgtaactgaggcgtgcgccgcaatatgcactgtacattccacaagcattggcttcttattttacttcttttagctgtttaactttgtaagatgcacacacgacgttggatcaagtttaaatgacctgtgctgccctttcacatcaaagaactactgacaaccgcaaggccgcgccttgcccttttccccatcatgtctatcatcatccttggcttgcgctcagggccacggcacacagacactctgccatcgtcggttgcaaagggacgaagtgcggggtgggcaagcaaagtggcgggttgccgaccgacacagactgacactcttaaggcagtcaaacaccccaagatcggccacacagagtgtcctggcaggctcgtcactgaagctcccaaaaccaagaagtcgccgactttaatgcccaccgcggcaccatccatttcaaaccatcaggcaagtcgcgatctgtgaaaatccatgaaaaaacagccacacaaccaaaaaaaa

SEQ ID NO: 681990 - DNA, 790 bp, Homo sapiens
taacacgtgaagggttatttatggttataataaccctgttcctgcaacgagggactggaagccactacggaggaggagggtcccatctctctcctgtcggtttacaccgaggttcacagccagacgtgtggggcaaagggtgttccctgtgttcctacccagccatttcctgtgggcctgccgcctaggggcctcacagggcccaggagtccccagctcacaggccagggcatcaggccaggcgcgctcgggtgcacaccgcaccgtgggaggcaccgtgggttacacctcaggaaaccaagaagcactgtggcgggtctcaggagtggtgtggcgttacagcctcccatacgggggtggggaaaagttctgtagccgaaagccaagcccccttccttgccaggctcttcccaggtttcgaaaaaggctggaacctcaatttctgcagaaaaatctcccagtattcccgtgttgggtaagttttttatacaaagacgggatctggctgtgtttgcccaggctggtctggaactccgggcctcaagcaatcctcccacctcggcctccgaaagtgctgggataactgggcatgaaccattgcgcccggttggagctccggttttaaagcactgccgatcctagaagagctgaccttttctctggccctcaaagctatatgctgaagctgagtgtgaggacccagagagacctttctgagacaaccgctgtggccaaaggggtatatgccgccgagatcctggatcccaaggaaggaggtcctggggaaggg

SEQ ID NO: 681991 - DNA, 246 bp, Homo sapiens
tcagtcggtaccagaggtgaggtaggagaactgcttgacactgggaggtggagtgtggtgagctgagatggcgcattgcactccagcctgggcaacaagagcaaaactctaaaaaaaaaaaaattatctactgtagttgaatgtttatgtccctccagaattcatattgaaacttaatccccaatgcaatagttttaagaggtggggcttaccagcctgagcaacagtgtgaaaccccagcgctac

SEQ ID NO: 681992 - DNA, 168 bp, Homo sapiens
  misc_feature (11)..(11): n is a, c, g, or t
  misc_feature (13)..(13): n is a, c, g, or t
  misc_feature (40)..(40): n is a, c, g, or t
aacatcactgncngatttatgttcatatcttgaacccctnatactgtgtcataagaaacgcacttcacctctgtgctatccttccccaaaatatataatcccagtctaattatgagaaaacattacacaaacccaaattggggggtattctacaaaggtacttgacca

SEQ ID NO: 681993 - DNA, 736 bp, Homo sapiens
cgacgagtcgtgctgaactaccttccatgacgggtactgtcgtgagccgctcacttgctgtcattctcatcaggcaggtccatccaggacgcatgcgcattcgaattaatcataattaccgcccccgctgccgtacccccaccacaccacccaccccacccacaccctccacacccacccacacccccaccacaccccccccccacccacaccaccccccccccccccccaccccaccccccaccccccacaccacccccaccccacgacaccacccaaccaccacaaccccccacaccccacccacacccctcacccccccaccacctcacaacacacccccacacccacctcccccacatcccccactctccaaccacccaaacgcacacacccccccccccccacccaccccgccaccacgaaaacacgacaccacccataaaccaccagcaccccccccagcgatcgccacccccacccccaccaacacgcccaacccaccacaccacccaaccacacaacccacaaccacccaccgagccccatcacccccctaccaccaccaccccaccccccagccaccctccacaaaactcgaccaaaccacccacaactccaccacaccccacccccaacactcaccaccccacaacaccccccccaccgcaccccccacccccaccaccaccacacccacccccacccccaccccacccacacccccaaccccacc

SEQ ID NO: 681994 - DNA, 1365 bp, Homo sapiens
  misc_feature (375)..(375): n is a, c, g, or t
gagcttctgtacgctggtttactgaccatgctgatgcaggtgctgatgagttaggagaggtcatcaaacgatgatatttggccaaacccattacagtatctacttggtttcccgagtatggatgatgaatgaaggagaaggagaaggaagatgatgatgatgatgaggaggaggaaggattagaagatattgacgaagaacggggatgaggatgaaggtgatggaatgatgaagatgatgatgaagtgggaggaacggagcagggaggatgacagcgtagatacgatcgtactaaagtagtaagagcagccgatggattccaaccgctacctgttacttctatgttcctccagttccctggcgaggcgagcttgntggatcatccccaattttgtctggatgaccactgggtggcctgaacgcgcgcggatccagcggaggacgccctgtccaccaatactgccgcgcggaacaccaaaatctacttgggcgggagaagaaccgctaggaacgggtgcacacgtgggaaaaggaagtccaatgacccccttttacggtccacggaaaaggctcacatagaaaaccctcacccgggtggtgaatgcaacaatacggtactggaggactaggcgccagccaaggcatgctacgggagggggaccaagccaggcaacgataccccggagaccccatggagggagcggtagggagcactccagggggtcttcagaccccctgggcaaagctggatggaagcacaagagtccgacacgccaaatcgaggaaaagggggcccccagagccacccggagccatccttagacatagggcaggcacaatagcagagatgagtagacaccctcgggtctcaacgagaaacactcgacaacggtcgatcaggagcaagcggcaccgtatagagagccccgataccgcgggacactaggctgcagggggacagcgaccacaaaaagctacgtgtccagcgtgtgtcgacgttcgtcgtcgtgacactaacacgatgaccactagagccgacgaccagacgcagcgcagacacacggcaagcacagcaaacaccacaaggagaacacacaccacaaccgacacacacagacgcgcgcaacagacacgcatgaggaccaaccagcccagcagcgactagaactcaagttacccgcacacagcggtatccagcggtagacacggcaaaacaccagaaaacaaaagccgagaacgagcacagaaagaaacacaccccacacacagccgaacacccacggatcagaaacaacacaacaaaagaagtccacaatgaacaggaaaagaagaacagcgaaaagcagagaaactcaaaagacccca

SEQ ID NO: 681995 - DNA, 250 bp, Homo sapiens
  misc_feature (41)..(41): n is a, c, g, or t
taggagctctagagatctatccgggtctgggtagctgggantatagtgtgcccaccaccacgccggctaattttttgtatttttagtagagacggggtttcactatgttggccaggctgatctcgaactcctgaccttgtgatccacccacctcggtctcccaaagtgctgggattacaggcgggacgcaccgcccccggccttgaatatccttttaatcatgcttcttgtctacaatcatacccaggaa

SEQ ID NO: 681996 - DNA, 428 bp, Homo sapiens
  misc_feature (13)..(13): n is a, c, g, or t
  misc_feature (41)..(41): n is a, c, g, or t
  misc_feature (52)..(52): n is a, c, g, or t
  misc_feature (76)..(76): n is a, c, g, or t
  misc_feature (108)..(108): n is a, c, g, or t
  misc_feature (140)..(140): n is a, c, g, or t
  misc_feature (180)..(180): n is a, c, g, or t
  misc_feature (219)..(219): n is a, c, g, or t
  misc_feature (245)..(245): n is a, c, g, or t
  misc_feature (270)..(270): n is a, c, g, or t
  misc_feature (420)..(420): n is a, c, g, or t
  misc_feature (427)..(427): n is a, c, g, or t
gctaatggttgcngggcttcatccccggggtgatgagatgntctgtgcagcnaagccccatggtcatgtttccctntgtacaaccctgacatcctgcacatgtccccnggaccttaataaaaggtggaaatttttaaaangaatgaataagccctggtatttgatagcacaacagggagnctatagtcaacagcaatttaattgtatattttaatatgnctaaaagagtataatggattgtttgnacacaaataaatgcttgaggggtgncaccccatattacatgatgtgattattacacattgatgcctatatcaaaacatctcatgtccccataaatatatcacctaattcccacaaaacttaaatataaaatgttttaataaaaataaagaaaagattcccacaataaaaagaaanaaaaatng

SEQ ID NO: 681997 - DNA, 195 bp, Homo sapiens
tgcccagcttaatttttttatttttatagagaggggtttcacctgttggtcggggctgggcctccgaactcccttgacctttagttgaccccaccccgcccccagctctcagggaggcttaagaggcggtgtaggattagctttgagcccaggagtgtcgagacctcctgggcaatatacgagaccccgttctcc

SEQ ID NO: 681998 - DNA, 128 bp, Homo sapiens
  misc_feature (39)..(39): n is a, c, g, or t
ctggtccggacgttaattggagctcagctaccaatcacnatcatcttcattgccttctgctgtcaaggcctctcttgaatccagaaatgcccagtgtgggaagaggtcctggaggatggaaaggggga

SEQ ID NO: 681999 - DNA, 147 bp, Homo sapiens
tacctggtgtcattggtgatccctgggagcgcggtggagtacgttggtccatggaaagcagcgccccagagctggagcagagtgggcaggaatccccaggaagtgggacaagagtgcctcgtctggaagtcgctccctagtctgcat

SEQ ID NO: 682000 - DNA, 758 bp, Homo sapiens
  misc_feature (36)..(36): n is a, c, g, or t
  misc_feature (65)..(65): n is a, c, g, or t
  misc_feature (71)..(71): n is a, c, g, or t
  misc_feature (161)..(161): n is a, c, g, or t
  misc_feature (208)..(208): n is a, c, g, or t
  misc_feature (246)..(246): n is a, c, g, or t
  misc_feature (251)..(251): n is a, c, g, or t
  misc_feature (276)..(276): n is a, c, g, or t
  misc_feature (279)..(279): n is a, c, g, or t
  misc_feature (281)..(281): n is a, c, g, or t
  misc_feature (299)..(299): n is a, c, g, or t
  misc_feature (306)..(306): n is a, c, g, or t
  misc_feature (325)..(325): n is a, c, g, or t
  misc_feature (352)..(352): n is a, c, g, or t
  misc_feature (378)..(378): n is a, c, g, or t
  misc_feature (382)..(382): n is a, c, g, or t
  misc_feature (384)..(384): n is a, c, g, or t
  misc_feature (396)..(396): n is a, c, g, or t
  misc_feature (402)..(402): n is a, c, g, or t
  misc_feature (406)..(406): n is a, c, g, or t
  misc_feature (418)..(418): n is a, c, g, or t
  misc_feature (436)..(436): n is a, c, g, or t
  misc_feature (438)..(439): n is a, c, g, or t
  misc_feature (441)..(441): n is a, c, g, or t
  misc_feature (447)..(447): n is a, c, g, or t
  misc_feature (455)..(455): n is a, c, g, or t
  misc_feature (466)..(466): n is a, c, g, or t
  misc_feature (478)..(479): n is a, c, g, or t
  misc_feature (486)..(486): n is a, c, g, or t
  misc_feature (493)..(493): n is a, c, g, or t
  misc_feature (495)..(495): n is a, c, g, or t
  misc_feature (498)..(498): n is a, c, g, or t
  misc_feature (533)..(533): n is a, c, g, or t
  misc_feature (543)..(543): n is a, c, g, or t
  misc_feature (549)..(549): n is a, c, g, or t
  misc_feature (644)..(644): n is a, c, g, or t
  misc_feature (648)..(648): n is a, c, g, or t
  misc_feature (662)..(662): n is a, c, g, or t
  misc_feature (758)..(758): n is a, c, g, or t
atttcaaaaggatagaaggagaaaagcaggccaggngtggtgggctaagaggcgagcctgccggngcctgnatgctgctgggcaaaccgctgcatccgctcctcgagctccggccgtaaagtggcggatcagaccctgcacaggccaggaggccccgtcanccagagcacaaatcgtatggccttctatctgcttgctgatctcccanagggagtcgatctcggccggccgggcatcccccctcangaaangtgccaacaccttgttcatccagtncanancctcacggcatggggtanactggcnaaagctctcgtgcttatanaactcaatgaggcgggcgatggctttnacgatgtccgtcgagcggtccatgangatnancgcagctgtgcncaggcntgtntgtgcctgcacnagcgcatcgaagtccatnannancgtctnaaaaaaanaattggggatnagtggggtagannagccgcnagggatnanagnaaggaggttgtcccagccgcccgtaacaaccccancatgcttctnaatcanttctttcaagggcacagacatctcctcctccacagtgcaagggtggttgacatggccagaaatgttgaatagtttagtgcctaaatagcgttctntgcnaaagccagcaaacnaggtacctccacggcggcagattgtgggggacactgccactgtctccacgttggccacagttgtggggcagccaaacactcccacgtctgcggggn

SEQ ID NO: 682001 - DNA, 226 bp, Homo sapiens
  misc_feature (47)..(47): n is a, c, g, or t
  misc_feature (50)..(50): n is a, c, g, or t
ggcacgagctttcttgttctccaaagtctttaacctttccctgggtnttncctctcctctaataaacatttagaagtgtctagccgggcgcggtggctcacacctgtaattccagcacattcagaggccaaggcagacatatcacttgaggtcaggagttcaagactagcctggccaccgtggcgaaaccctatccctgctgagaatacaaaaattagccgggcgt

SEQ ID NO: 682002 - DNA, 151 bp, Homo sapiens
acacccttactgcttctgccaaatgagactttcctcctactgtatttggagaaggaatatccgcaggaaagaacagatctgggctgcttcctgcttctgccggtctaccgccaataccaccctgaatcgcgcccgagtctcggtcttgatc

SEQ ID NO: 682003 - DNA, 1369 bp, Homo sapiens
  misc_feature (1)..(1): n is a, c, g, or t
ngctgactaagaagagtgtggcgctattcttatagggaagggagtggccctcctagcctcccccttgtgggtccccaaggacccccccacgccacaagggggcaaaagactttgtccgccgccttctcataagtgtatagggcaccagggccccagcgggactaagagcaccaaaccaagctctcgcattgggggcccccaggaaagtgttggccccattatgacaacaaagggccaatctgcttttaggctccggatttgaatattaacccttaagagttatctgggcgcctatgcttggtggttgaattctttttctaaggcccctggcccaaataaccctcgggtgcccgtgcccccttgatagagggttaccaaccggtcgcgtgggaagacacatgtgtgggccaccctggggccagtcacctgtgccccgtgcggcccccaccctaaaaaggaaaaaggggggcttaatatttggccctgctcctgtggcacaagaaacacaacggtttgcccgcgcgctgccgctcccgtgctgttccccctctcccctcgtgggggttttttcccccactttcacgcccccctttctcggttttttcccctctctttaaaaggcccccccgttgaaaagatttgggtggccgctctatacagcggcttgtctccccacgttatagcgtttatcacttgaaattgtgaagagttggcttcccctgtgcccctgggccccataccctccccgtgcccgctcgtggcccccaccccccctcggcattaaagtcgtacacttgtgtttgggtattttctttccgcccgagtttgtctgtgttgccccacagtagagggtttttggtttgaaccctgcagactccccccgcatgtcccctgaggccccagaagagtgtggtggtggctttaaaactttccccccacccctcttgggtgttttccccgcctttccccccgtgtggtttttaagttcttctttgtgcctggtggccctataatggccaccctgggcctcggggaaggaccacctgccccgcttctagggtttttaataaaatggttcttaactccacagggtcacaaccctcccacgcgcctcgtgagaattatacctcggtgttctctctctttttgaacttgggaagcccacgtattaggctttggggtggggggaggttctgtaaagtgaaacacaactttctgtgtctttttttctgccccctcgttgtaaataaactctttaatggcccaaaccccacgagctttggactttttttttttctaactgctaaaacccttctcttccccctggttttactgtaaccatttgggaaagggataaatgtcgtcccct

SEQ ID NO: 682004 - DNA, 245 bp, Homo sapiens
  misc_feature (30)..(30): n is a, c, g, or t
  misc_feature (97)..(97): n is a, c, g, or t
  misc_feature (168)..(168): n is a, c, g, or t
  misc_feature (231)..(231): n is a, c, g, or t
gggaaggggtctttggaaaggggagggaanagtgggaagggctgcatctcatggcttgagtgccagctcagccacagtacactagaacaccaagtanacttctaaggtttttgactgcagtccctggctcccagacagcacctctagacctgcccacggcctgggggnacttgctacagaggttacactgagccgagatcatgccactgcactccagcctgggcgatacancgagactgcatctc

SEQ ID NO: 682005 - DNA, 169 bp, Homo sapiens
ccggagtacccagaccctccttgttcctatggcaagcacagacctaggggagaaacagaacgcgctgctttcctgagcaaacacgcattggggctgagcttggtttcccgcaggagagttgcactttctgcgtaaggaaggctgcaaaggaaagctagctttggtgcca

SEQ ID NO: 682006 - DNA, 173 bp, Homo sapiens
  misc_feature (57)..(57): n is a, c, g, or t
aggataccctggctgtgggcgcgaccagcagcagcaggagcagcacggtgcccatgnatgtgaggaaaacaatgaaggcaacagtgtccgatgtggactggaaaaggagcccaagccagagggcaagtgacaaaggatgtaccatgtccaatctcccacaacccacgcgccca

SEQ ID NO: 682007 - DNA, 1108 bp, Homo sapiens
gtggaaccactatatgagattggctgtgtgaatctcggacgcctcccttcccacacacctctggacctacaccaaagggcctcaggtggccacacttcctatccttcgaaggggctccccttcttggcatggacattatttaaaatcaccgactccatgaggatgaggtttgttttacaaaatgccatgaggttaaggagagttgggacccgtgagactggaggtggctaccgtccccactcctttgatcttttaagaccattcctcttccttgatccctgtgacgcagactcgagtggtacatttgtgcaagttgctcggccctggagggaaccagatcagttatttaaagccagaaataatgtttttcattatggttacggattctattgtttgtgtcctcttactccgattaccgaggtgtgtgtgtacatatatatagtatactatatcattataaatatcaaagaaattatatatctatcctgggatgggaaaacaagggagggatatatagatatatatatatatatatacataaaggagggggatccatgtcttcaccttaccttagaccagaaggaaaagagagacatgaaagtcttaccaatgacatcagaaggaacacctctactagagaccacaagaaaacaagtaaggaagtagcactactctgctggagctaagagatcaggaaagacaccgggtacatcatggagtcacagataaacagaactcgggagacgtcaaaagggctccctcacgatcaagaaccccacgacagggccagaaactcacgagggagaaaacaagaaaaacaatatgactatgagacaagaagaaccacgccacaattggaaaggagagagaagagaaagaacacgtaccggacccccagtgctagcagagccagaacgcgacggccgagacgtcggcacaaaagaaacccagacggcagcaaagcaaacgaggggggagcgcagcgcaggccaggaccgccagccaccagtacggcgagaaccaagcgacacgcagaccaaagataggagagcacgccagggggacgagagaaccgcaggagagccactggtagtaatagagaacgaga

SEQ ID NO: 682008 - DNA, 250 bp, Homo sapiens
aattcgcggccgcgtcgacctgttcttccaggcgcaagctcgaaaggcggcggtagagcgccaggcggtccttcatgtcgggcacgtacgtttcggggagcatcgcggggaatggcaggttgatttccacttcctcgagaggtttcgccacctcttcgcctttgaggcgatggatttcttcctgcagaagctcgaggtacatctcgtagcccacgctgccgatgtggccgctctgcgagctgccgagcgc

SEQ ID NO: 682009 - DNA, 138 bp, Homo sapiens
ctactggttgcagcggtactgagctttgctacggttactggctttgcatcgtgtactggtttccgccgggtaaacgagagaacagcaagggaagactggtcgacagtggccagtggatcagggtcttggtgacggggg

SEQ ID NO: 682010 - DNA, 289 bp, Homo sapiens
aaaaggtgcagtagattattttctacaagctgaaggaagtatcaacaatgaggttatccctagacccactccagatagctctaatccgagtcagctaagagtctgcaatctttagcaaatatgtatcccttgctagagttctggaatacttatctgatcactcaatttattgcttatatcatagaacctgtaagtttgcacttaaaatgaatatttaggcacatctatctctccgtcattctgtcggtaagcagatcagtgagtgcttacctttgtttcatccttggca

SEQ ID NO: 682011 - DNA, 314 bp, Homo sapiens
tacatggagctgatgaacactacataatcacagcacatattttttttggagatagagtctcactctgtctcccaggctgtaattaaatgtctcatggtctgcctagtcatataagaattgtaacttccaaaaggacaatatgttggcttaattcactgattcatcccaaaaaccccatgtacatagatgcttcaataaagctgtatccaccgtagatatttaaggcccttctacaagatatttaactgcaaaagatgaacagtctcactgaaatttaaatgtaagcatgatgaccaactactttaaatcacagc

SEQ ID NO: 682012 - DNA, 226 bp, Homo sapiens
  misc_feature (3)..(3): n is a, c, g, or t
  misc_feature (7)..(7): n is a, c, g, or t
ttnttgncatgcctccattcagagatttgcagaccaatctagggactccgtcctctgtcctctaccaaggaaaagattgctattgtcgtcatcacctaccgacctccgggggtcttctgggagttttctcccctaaccatttcaacttttttttggattctcgctcttgcatgcctcccccgtcctttttcccttgccagttccctggtgacagttaccagctttc

SEQ ID NO: 682013 - DNA, 186 bp, Homo sapiens
aaatggttagctgggcatggtggtgaatgcccttagtcctaactgcttgggaggctcacgtggcaggattccttgagcccagcagttcaaggttgcagtgaactatgattgtgccactgccttctagcctgggtgacagagtgagaccatgtctctaagaaaagttggtgaggacgccaggggaca

SEQ ID NO: 682014 - DNA, 261 bp, Homo sapiens
cgataggtatatcgcctggatcctatggacctcgtttgtgttagagggtatttgatctgtctctccccgcagagttatttatagttagttcatgtaggcacaagttatatgtgttagtgctctcatataatgtgtttggtgatacctttgtgctctatggttagttattgtatttgatacaggagggtccgacattattagcatgtcagatatttgtgtagatggatatgctcagtgtatctgtcagtgtggatgagtcgc

SEQ ID NO: 682015 - DNA, 1089 bp, Homo sapiens
  misc_feature (964)..(964): n is a, c, g, or t
ggacggacagtggataggtgcccgatgcctacagctggtctggggctcgtgtctgttaccttcgtgacgttggtggcccggtggtccaccctttccgtagcttgtcccaattgggatgctggaattgggcatgctggtgaccaacgacctgctgggccgtttcctgcatagaggaacagtggagatttcggcggacggggaaccggatgtacgtgccgtgagggaaccgcacatgggtactggtgtcgctgctcagcatttcaagaggataccgacgacgaactggtgacaggtaaaaatgatttagctgtgcgtccctgctgtaggtgctcccagtcgtcagggtgatacacttctccagtcgtctcgtcccaatcacctgaccttggttcgcaaccagtggatacaactgcacgtaacatgctctctgccacaacgggaagaagctgttctcgtaatggcagtactatgagcacgtgaagaggcgtggtcataagaatggacgggtgactcccaaagagtgagcttcgcacttggcaattagttggaacaggatgcgtgagtagaggaagaacaagggacaaagtcagcttgacggttctaagctagcgttggtcaccaactgcacggaagtagagtaggttgctcactcttggaactcaagaggtatgggcagtgtgacatcaccttggggctaggagaacctggtttgacatgctcaacttagagagcgcgcagagaaaccaacaccttgctagagaaagggtagatgcgacgactacaaacgtagtttcttcacctaactaccacgatagtatttcattgtcattcaccagaacgacagtctggccatatgagattggaaagaagatagatattagacagagaaggagatctaacacttaaaacagctcgattctttgatgacatacagacacacaccaaaaccattttgtacttagcnttcagtaaacaaaaaatttataacagacgttccttggtagtgaactaggcaaaacaagtgccgacccatattacaaatgtgaagaaaaacctaccaaaggacaaagttaacactttgatactttc

SEQ ID NO: 682016 - DNA, 615 bp, Homo sapiens
agtcgttactgttggagttaagtattcagaaaatccaaaataattctatttaaggggagtttgtgatcatacagtcaaactcttatcaagatacttttctacaacattcctaacaaactagccttgctactcacagacagttctcagcgatgtatatccttacttcacatgaattccttaaatagctctaattttcaggaaattctttctttatatcagaaacctgcttccttacaactgtctgcctacgggaataccaaaaattaagtctgcacttaattcactttgggaggccaaggcagggggattgcttgaagccaggcattcaagaccagcctgggcaacatggtgaaaccccatctctacaaatacaaaaattagccaggtttggtggcatgtggctgtagtcccagctgcttgagaggctgaggtggaaggattgattgagcctgggaggtcaaggctgccgtgagctgagattgtgccactgtactccagcctggacaacagagcaagactgtctcaaaaggaaaacaaaaacggtgttccaagactctttagagttttattaagcatgtgaaatttcgttgggttgggtgatagttcctttagaac

SEQ ID NO: 682017 - DNA, 288 bp, Homo sapiens
caaccactgtctcatgagagacagcagatgctgtgctggcatgctgctgtcctctagtttacatatcctatctgaggtaagcgggtaccaagtatggccatggcagtctggctgagttagaatgtgaaatgtaaagtgacttctgtgggtcatagccacaaatagtgtcaagatgtactaacttgataaacatattccagatgtttggttaaacctaaaaagacctctctggtggatgtagcagtacatcatttcatatgtattaatttcataacttttttattttaa

SEQ ID NO: 682018 - DNA, 114 bp, Homo sapiens
cgcatagctatgaccatgcactggacgacgttctacacgcagagctatgaccatgcattggccgtcgttgaacaccaatagctatgaccattgcatgggccgtcgattgaccac

SEQ ID NO: 682019 - DNA, 1646 bp, Homo sapiens
  misc_feature (1119)..(1119): n is a, c, g, or t
gacaaaaactacgaatctgctcagccctcgcgggctgctgctctctgttactatcctcatttctatgacggcgacactgaaatgttacggagattacgggacagttgctgacgctgcgactgggaacctaggcccatctgagcccctgacgctggacgtgctgacgctcaccactgccagtgtggcctcccatggaccaagtatcctattatgactgggacccgtcatacttaaccttgcgctgctgtcagggcacactcctgctgggctacgagcctgcgcacactctgactgctcctagctccacgcactgacccactatgacggacgtcccgtctctctacccaagcgtgcgggtgctactctccaagaaccacaccgggctgccacgcacacgcgggcgaacgcgcgcctactcacccgcgcagaccgacacacctccctggcgcccccgaccaactgcctcaccccgccggcacacaacccgcacccacctcgcacacctcccagcacacccaccacccgccaccaccacctccgacacacacccacacccaccacaaaaacaggcaaacacgcacacagccacacaccaaccaacaaactaagaacaccgagaaacagcaatacaaccaccagaccacacactcaacgcatcgccgcccacccgacggaccagccgaaacgcccaccacagcgaaaggaaggaacccagccaccacaagcggcagtaccgaccaacgaaccacaacagaagcaccaccgactagataagcacacacacggaaccagacgaagccgctccacctaccatccacgcaacgaccgcgacacgaaaaacgacagcaaacaaaccaacagcgagctcgcgaggcacgcagccaacaccgtacaccaccacaacgccaccagaccaccacacacgagcaaagagagcaacatgggcccggcctgacaagacccacacaaacaaccagggcgagccagcaaaagcgagagcacacccgcatccaacaaccaccatgaccgaactacgtgcggaacacaacacaactgccacagcacacaaaacacacgcagcaacgaccaacacaaaatacaagcaaacaccagcaccanacactactgcggacagccctaacactacatcacaatgacacgggaccgaccctgaagagacaacgcacaaatgatagtacaccggcacaggcacgcacacacacacagaacccacgaggcgacagagcagtaggtcggcgatagactgcgacacaacgagcgcacaacgaccacacaaaaagcacagaccacactacagccaacgaacaatcgccaaaacagaaggccgagacgctcacataccaggcagcgacagactagaagccactaggcggagacacacagcgcatacgactggcgcgagaggctacagagatgacgcagcagacagaagagaacaacagcacgacgacgcccaccgcggccgcacgcagcaccgacgcagaccgaaccagacgcaacagcgacgcaccacagcgcaatagaacgacaagacgcaccaacacacaaccaacagacagggaggagagaaactcaagagagagggcgcgaggcgaccggcgggagtggtgtggcatcacgacccg

SEQ ID NO: 682020 - DNA, 258 bp, Homo sapiens
tggtgagaagtacttggaatctgggtatatttagatgatgaagctagaaatttttctgacgggttctctgcgggaagtggagagaacagattcaaggctgagtgcaagatgttggcccgggcaactggaaaatgggggggctatgatggagtgggaagctggtgggagccacaggtgtggccgagggtgatgaggatccatccggggcgagcgtgagctgcctttgaccccgagttgagatacggactctgctgttgg

SEQ ID NO: 682021 - DNA, 119 bp, Homo sapiens
gaattctctactcctgcacgatgggcactcatgtaggatgtggacggctactgctacaatggcatctgcagactcacgagtgtgactgtgggagcggagcaccacctcttgcacttgtg

SEQ ID NO: 682022 - DNA, 145 bp, Homo sapiens
tggctgagggctatgtccaagtcaagatcagaaataggtcagctcatcatgcttggctatgttggtctggtagttagattaggtcaagggcttgtttcatgagggagagattggaacactcgcaggtgtacgaagtacctcgtcg

SEQ ID NO: 682023 - DNA, 90 bp, Homo sapiens
  misc_feature (69)..(69): n is a, c, g, or t
ccccattccctctctactcttgacagcaggatggatgtgtgtatgtggtttattttattttcttcattntgttctgaaattaaagtatgc

SEQ ID NO: 682024 - DNA, 341 bp, Homo sapiens
ctcatatgatggggagtcggtgggtctctctctaaatcgtccccccttttttattaaatttggtgttcctttttggaggctgtgtttggacacacaggcacacacacacacctcttttgggatttatacacttttaagttatgtaatactacattttctcgtatgagcctttggcctaacctatcggctgatctaacatcaaaccagcttcttttttttgaagtggcctaaatactccttaattccatcttatgaactctttttctttcttcttccttttttgggaaacggcatatcggggacccgagcccgaattcgaaactcggggccatagttgttcc

SEQ ID NO: 682025 - DNA, 464 bp, Homo sapiens
aataaaacttatctatagtttttcattatttttgagtggtaattatgtgttaattcagctgaacaattgcaattagtattatttctttgtaaccaagacacattttttacttttcttttctccctttgtttgcattttattcactctctaatgtcaatatcaagaaactataggctgggcatggtgctcatgcctataattctagcgtttggtgcagggtagggggcgccaaggcaggaggattacttagcccaggagtttaaaaccagccttgacaacatagcaagatcttatctctgcaaaaaagtaaaaaattagctgggtgcggtggcatgagtctgtagtcctagctagtcaggcggctgaggcaggaggatcgcttgagcccaggagttcaaggttgcagtgagtcatgtgcgcaccactccattacagcccgggtggcagagtaaggcctcaactca

SEQ ID NO: 682026 - DNA, 183 bp, Homo sapiens
ccagtcaacactgagtcaatgctttgcagttccaaagtacgtatactatcttcagtctccgggttagttactgaagtaccttgtgtctaaatccttagtactttgtaacgttggtacatttcagttgtcaagtcctctcttctcccagtaacctctagtacaatgtctagtctcattctattg

SEQ ID NO: 682027 - DNA, 91 bp, Homo sapiens
ttaccaatgatataaagggtttataatacatctagttttattatacttagtactagaattatctcaaacgtacaatataatgtatttcagc

SEQ ID NO: 682028 - DNA, 349 bp, Homo sapiens
  misc_feature (17)..(18): n is a, c, g, or t
  misc_feature (42)..(43): n is a, c, g, or t
  misc_feature (87)..(87): n is a, c, g, or t
  misc_feature (131)..(131): n is a, c, g, or t
  misc_feature (183)..(183): n is a, c, g, or t
  misc_feature (224)..(224): n is a, c, g, or t
  misc_feature (330)..(330): n is a, c, g, or t
actggaatatgtattanncggatgatttttaaaagattaggnncactgtgataatgatttgggattgtaatttattgattttcgtcnctttcccttttgaattctctatttattaccgttcaccccatcanacactcttgcgttctcttaccatctctcttcctttttctctccaaaccaaancgttgtaagttgttaaggttttaaagattcccacctttaanttatttttcccttcatcccaaagcttccttgctccttttctctgtttttagtcgcaagtcacccatgggacacgtgtcgttattaatgttgtgtatttattttttnataaaagaggtatttattg

SEQ ID NO: 682029 - DNA, 127 bp, Homo sapiens
  misc_feature (57)..(57): n is a, c, g, or t
gggccacagcactcacatgtgtcctagtgcgtttggcctgccacggttggtttgttncccaccgtggtctttggtaaccactacaagtgccttggtagaagctactctcttctgtgcatcctactca

SEQ ID NO: 682030 - DNA, 336 bp, Homo sapiens
  misc_feature (27)..(27): n is a, c, g, or t
gctactactactaaattcgcggccgtncgacccaggctggagtgcaatggcagtctctgacctcacagcaacctccgcctcttgggttcaagcaattctgctgcatcagcctcccgagtacctgggattacaggcatgcacaactacacctggctaattttgtaattttagtagagacagagtttttccatgtaggtcaagctggtcttgaactccagacctcaggtaatccgcccacctcagcatccaaaattactgggactacaggcatgagccaccacacccggcctagttcctgtttcttatgaagcatgagttaaactcacattatacgtg

SEQ ID NO: 682031 - DNA, 1274 bp, Homo sapiens
  misc_feature (642)..(642): n is a, c, g, or t
  misc_feature (689)..(689): n is a, c, g, or t
  misc_feature (694)..(694): n is a, c, g, or t
  misc_feature (749)..(749): n is a, c, g, or t
aggggctgtgttcagatgcttttgttgggggtaattccacctttaaaaggtttaaaaggttgccagagggagaaaagctcaaggatagaaagggccagttaatctggatatatatttcgctgataactaagcttccctttaacagtaaccttttcacatttagcctttacttctgtgtttacattttgttaatgttcagtataaaaattcaattccattgaattcagccataggcacattgtaaacttcctttttgctgaaacgaaatactcctggtggtgatagcttgtataaatataatgtctttctgagcatgttggcattttctcttacctcctttaacaacttctactattagaaagggaccaacggggacacagaccttttagagtctatttgctcagggtcacacatcaagcaataaaatgcttgttgttttacaggtaggtgttaagatgatggtgacatacattcattcttggcctgtgtgacatagtgacagagtctccttgttgttgcagaatggactgtggtaacttctttctggcctttcaattttattaattcctaagttgttcgcagagtacctacaatataggaagcaggctgcgtggtgcagtggctcacgcctgtagtcccagnactttgggaggctgaggcaggaggatcacttgaacccaggaatttgngaccngcctagacaacatagcaagaccctgtttctacgaaaaaaaaaaaaatcaggcgtnatggcacgtgcctgtggtcccagctacttgggaggctgagatgggaggatcacttgaacccaggtgtctaaggctgcagtgagctaggggtgtctccactccagcctaagcaaccgagtgagaccctgtcttttgaaaaaccaaccatgaagatatttgatagaataaaatcatgtttttgtgggttactgggtacccaatgaaaaaaaatatttgcccttggccaggcgcggtggctcacgcttgtaatcccagcactttgggaggcaaaggtgggtggatcacctgaggctaggagtttgagaccagcctggccaacatggtgaaaccccatatctactaaaaatacaaaaattagcggggtgtggtggtatgcacctgtaatcccacctactccggaggctgaggctggagaattgcttgaacccaggagggggaggttgcagtgagctgagatcacgccattgcactccagcctgggtaacgagagaaactgtatttcaaaaaaaaacacaaagtcgacgc

SEQ ID NO: 682032 - DNA, 140 bp, Homo sapiens
gctcactgcagcctcaaattcctggctcaagtgacccttccacctaagcctcccaactagctaggactacaggcgtgacacccacacccaccctgtttatatttgagagtatgcaatctgataatttttatttacaatga

SEQ ID NO: 682033 - DNA, 772 bp, Homo sapiens
ggcccattacgccgtgtgctggagtcttcctgcaggcttttcctatgcctcatgatgggacccatgtgggcgtgtccatcctggctggaagaagaaaagccctctcatgctagcgttgcaaagcccagagggtcctagtgtgagtctgtggcagagtggctcaactgatgaatcataggcagcccagtcggcgaggaatgcgttcccatgactgaggtcatctccaccgaggttatctccgaatcacgagcacagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaatgcttggtggaaactcccccggctgagaacaagcccagaaagcggcagctctcggaagagcagccaagcggcaatggtgtgaagaagcccaagattgaaatcccagtgacatccacaggccagtcggtgcccagctcccccagtatcccaggaaccccagagctgaagatgtggggtacgtcccctgaagataaacagcaggcagctctcctacgagccactgaggtctactgtggacctggacatccagaccaatgctgtcatcaagcaccgggggtcttcagaggtgctgaccccgtatcg

SEQ ID NO: 682034 - DNA, 457 bp, Homo sapiens
gtgatgtgcgggtgatctagaggatcccttcgattggaatggctgcacgcctctgcaggtcttcgaggacctgcaggtccagcccctccttgcaggtatacagacagtcgatcaccttcttatccgcgagtttcccggaacggagagttaagccagccagatggcctcggaaaaacggggtcatgtgcaggtcgccaccttggggtcaggggagaaaaggcgaagtcaggcgtgcaacccagcatcgcccaactcacttctcactcaacacggtgtaacgggtgctggcagctcaggggatggacatgcgggttagttcataccaagtccggttagccttgcaatctacatggaagcgcaatgaagaaattaaaccgtttatgatcatgcacatggccgggagaaagggagagtggggggtgtctcacctgaagccaagaggtccccggaagggagc

SEQ ID NO: 682035 - DNA, 551 bp, Homo sapiens
ttgcgtgcgtgccccttcgtacctgaccccatgataacctattcagatttatgtcttgccctctagcactctccccttcagtcaagctgtcttttcatccagacacagttcctactgtcatctccctgtcttcactctgtactttacgtctgatccactcctctcaacaccagctcatccctggcacaacaaagctttctgaggttcttgtggccactactttgctccaaatgtgtttctgataaaataaggacacagtttagcacttaaaattttctcaaaacgatctattttcccagttgggtgtgaaagctctttaagggcaaaagccgggcttgaagcaacatatacttttggacagattcagcaaaccccaccatctgcctggaaaaaaacaaggctcaaggtaaactcccgaggttgttggattgccagtttggtttattcttccattaccttctttctttcattagtcccttgttctcaacaaccaagagaaaaatacaacaacatccaatgcaaaggcttcttactatgctgaggggcaagcg

SEQ ID NO: 682036 - DNA, 624 bp, Homo sapiens
cgagcgacagccgggtatacatggaggtggcacgaccaggtcatagccggtgcgcgcagccatgaccttgctctgcatgatttcggcgctgtcgaaagcatccatatgcagcttgatgccggtctcctgctggaattgcctgggcgtctgcggttcaagaaacccgaaccagttatacagatacaccgaagattcagcggcggctgcgggcgtgctggttgcagcccccaggagcgaagctaaaaaaatagctcgcaagtgtgctcgactcatatgactatccctgtccacacgacacgccttcatggctatcgtaagctcggggtgaatataccgagcatcaacgaatagtaaatacctacaagtacttagctctggcctgcaaagccctaaccctaaaggggtagaatatgtcgcttgaccttcatagcctggcttggcaccgatcggttggaaaactgatcatgcagctcaatcgcccggagttctggagttcgttgattcgcgtattgaatgaatatgtgcagatagacaattgggtggtgctggttttgggcgaccacgcggtgcgcgtgatcagcctgcccgaagtagcagacggattccattgggggggggatcctc

SEQ ID NO: 682037 - DNA, 426 bp, Homo sapiens
aaaaatcatatccttaattaacccttcatcagtttcttaagtcatcggtcatccggaaagcaagtaaattatctaaaggtaaataatttgggtagtgtctaatctataaaacatacatacactaccagtttttttctacctttaacaaattcgttcccataaaagacaattttatcactaacaaaggataacgggcaggcacaaaatagtgagtagaaaaggatttcctaaaatttttcatttctatcatttgatagcaggtggcatttatcttaaagataaatatccttcaataaaaataacaattcgaattttccagtggtagaaatcccgggtgatgacattggatacaaatagtttatcccggaaatccatttaaaatttttaatcaaatcttcggcaattcatggatcaagaatacatagg

SEQ ID NO: 682038 - DNA, 697 bp, Homo sapiens
  misc_feature (112)..(113): n is a, c, g, or t
  misc_feature (186)..(186): n is a, c, g, or t
  misc_feature (195)..(195): n is a, c, g, or t
  misc_feature (228)..(228): n is a, c, g, or t
  misc_feature (235)..(235): n is a, c, g, or t
  misc_feature (238)..(239): n is a, c, g, or t
  misc_feature (249)..(249): n is a, c, g, or t
  misc_feature (253)..(253): n is a, c, g, or t
  misc_feature (261)..(261): n is a, c, g, or t
  misc_feature (263)..(263): n is a, c, g, or t
  misc_feature (281)..(281): n is a, c, g, or t
  misc_feature (286)..(286): n is a, c, g, or t
  misc_feature (300)..(300): n is a, c, g, or t
  misc_feature (305)..(305): n is a, c, g, or t
  misc_feature (314)..(314): n is a, c, g, or t
  misc_feature (319)..(319): n is a, c, g, or t
  misc_feature (330)..(330): n is a, c, g, or t
  misc_feature (344)..(344): n is a, c, g, or t
  misc_feature (357)..(357): n is a, c, g, or t
  misc_feature (374)..(374): n is a, c, g, or t
  misc_feature (382)..(382): n is a, c, g, or t
  misc_feature (398)..(398): n is a, c, g, or t
  misc_feature (414)..(414): n is a, c, g, or t
  misc_feature (425)..(425): n is a, c, g, or t
  misc_feature (462)..(462): n is a, c, g, or t
  misc_feature (534)..(534): n is a, c, g, or t
  misc_feature (557)..(557): n is a, c, g, or t
  misc_feature (576)..(576): n is a, c, g, or t
  misc_feature (590)..(591): n is a, c, g, or t
  misc_feature (599)..(599): n is a, c, g, or t
  misc_feature (613)..(614): n is a, c, g, or t
  misc_feature (627)..(627): n is a, c, g, or t
  misc_feature (634)..(634): n is a, c, g, or t
  misc_feature (676)..(676): n is a, c, g, or t
tctcaccaagggtaccgcacaccggaatttccaggaagaaatagagtttcttaatgcaattttcccaaatggagcagcatattgtatcggtgcacgtatgaattctgtctgnngggacttatatactctggatttcccagagagtcgggtaatcagtcagccagatcaaaccttggaaattctgangggtgagcntgacccagcagttatggaccagttctacatganagatggngtnnctgcaaaggntgtnactcgtgngngtggaattcgtgacctgntaccnggttctgtcattgntgccncaatgttcnatccntgtgggtattnggtgaatgggatgnaatcggatggagnttattgggctattcacntcactccngaaccagacttttctnaagtaagctttgaaanaaacttaagtnagacctcctatgatgacctgatcagggaagttgtagnagtcttcaagccagggaaatttgtggccaccttgtttgttaatcagagttctaaatgtcgcacagtgcttgnttgcgccccagaagattgaaggntttaagcgtcttgattgcnagagtgctatgttnnatgattanaattttgtttttannagttttgctaagnagcagcnacaacagcagagttgattaagaaaaatgaggaaataacgcanaaagagtacacatgtagaagg

SEQ ID NO: 682039 - DNA, 537 bp, Homo sapiens
agctgactctgtaggtaggtttcagggaaaaggagagcaaagaaagatgaatttaaaaattatacttggccgctgatggtccacaccatggtgtaatgaaattgggtaatttagattcttgagtaaagacaattttctcatcatcagacaggtctcttgaggagggacatggatttcccaacgtatatctgactactacacatctctgttcagaagaatacagacatctatctgcaaaagatcgtggccttaaaattggtttaaagcatgtattatttcctgccagttcctgtatgtgctcgtgattgggggataagattaactgcatcctgcctcctatatctataatgttaggcatttgacatttatggagataacattggcagcttcatctgttcataaggcatccttaaaggtccatcatattataatttgcaatatccatggcacccaaaactttgaaatttcatcttgtgtgtggcagcaagcccttgtgcagtgaataaactacccagcccccttagtggtcccccccca

SEQ ID NO: 682040 - DNA, 205 bp, Homo sapiens
ccgggttggctcccgtggtactagacacatgatgatacaaggcactctgaaggtaaaccagcagaattaccatgctaaatagaaaaaatacccacaaaatctccaaatatggaaataatgggaaaacaaatgaaattaattatgcctggtatactcaaggatatcaggaggagattaaaaaagagaagagcggggtaccggagct

SEQ ID NO: 682041 - DNA, 271 bp, Homo sapiens
ctggtgagcaatgagacttatggattcaaatctgcctcatgccatttagctagtaaacacaaagagaagtccataacctagccctctttgacctctctgtccacactctcagctactagaggatggagactggcaggagaaaagcagaaggttctggagtccagaacaccagctcttagtgccaggaactgccaggtaagaattctggctacactgaggccaccatgctctgtggaagtcaagccagatggaaagatcacagaaggagaac

SEQ ID NO: 682042 - DNA, 433 bp, Homo sapiens
  misc_feature (390)..(390): n is a, c, g, or t
accgcacgagctcggagttccacgaatcaagttgggagtggggaattgtcgagaggagtttctctttattttattttattttactctatttatttttgagacagggtcttgctctgtcacccaagctggagtgcagtggtacagtctcagctcactgcagcctcaacctcctgggctcaagcaatcctcctgcctcagcctcctgaggtgctgggactataggtgtgcctcagcagcctggctaatttttgtatttttttgtagagatggggtttcactgtgttggtcaggctggtctcgaactcctgacctcatgatccacttgccttggcctcccaaagtgctgggattacagacatgagccactgtgctcggcctaatttttgtatntttagtagagacagcattttacaacgttggccagactggtctc

SEQ ID NO: 682043 - DNA, 86 bp, Homo sapiens
  misc_feature (22)..(22): n is a, c, g, or t
  misc_feature (84)..(84): n is a, c, g, or t
gcttggaacaaagtgacaacgntttgttaactcaaactaggacaattgcaatgtcattggtgaaatgtgccagcagtgacacgnag

SEQ ID NO: 682044 - DNA, 205 bp, Homo sapiens
cccccccgggggggggttttcccggggggggttttttttttttcccccccacaagggggggggggccccccctttttttggggggggggggggggtttttttacccattccccccccggggttttaaacaaggggggtttgtttgcccccccccgggcccctttttgggggggggggtggtaaggggtttcccctttttttttta

SEQ ID NO: 682045 - DNA, 382 bp, Homo sapiens
atacgttctctcctcaaaaaaggatgaggcggctcgtctggtaacagctctcatcgacccaggtggggtgctcagccttcagcagagtcacacacacagattgtgctcacagtaggcggagcgtggcatacagcatgagcccaggaagcagcccaaacacctcctggaccacagccatctggctctggggcgggctgcctcgggggtagtgcatcaacacaggcgcctcttctaccgagggcgggtacatttctccatccagggaactggtacttgagtttcccatccttaaagagccgcagttgatactgacgctccagattgtctccataaatgtggccgaggtctaccccatggcccaaggccttggtgaagccaggac

SEQ ID NO: 682046 - DNA, 111 bp, Homo sapiens
gggactccatcttaaaataatactaataataaagaaaaagaaaaagaaaaaaaatgaaattgccacagccactccaaccttcagcagccattacccttctgtcgtcttctc

SEQ ID NO: 682047 - DNA, 826 bp, Homo sapiens
ttggtgagctgttggtttgcgattgtgggttccgatagtggtcaggcgcgagggcccagccgagggcaccaaccggggggacttcctggcccgccgttcttgggaccgcacggagctgggaggacgtgtactatcccctgattcgtcctgtccttgatacgatcgcgacgtcttcagagaggtgacagctagcaagaccggatcgatagcgagacacgcgatcgatgtggagcatgtcataggagctggcgcgttcgtgtgcgctgccggctatgagggggctggccgccaacgaggcgcggtcgcggtgcagccggtgggtgttgtgcgcgcgtgctttgtctaggggaggaacttgtcaagggcgagcgacagcgtgtgtccaagcgggtcccacggcgtggagagcgctgcgcgcgcccattgtggggtgtccttggccacggacgcgccttgccttggcccgggtgccgacactgtggggttggaccgtgttcgaaagcgggtgcagctcctgaggaagacctgttcgcggcaatggggctcccacgagaagcgcctgtgttaccagaaatgggcgagggccccacggcctcgtgttgggaaaattcccattgccccattgggagccgtggggggagaattctgttagcggccgtgggttgacagttgtatgccgctttgtaggccggctggcgatatatgcgctcctcctcttccagtgtgcacatggcattgagggaaaccaccctttccctctgctaatcataccgcttaatgggggcaatatctgtacccattggtggcgcggcataaggaaccctat

SEQ ID NO: 682048 - DNA, 436 bp, Homo sapiens
agtatatgaagtctccaacttttctggggaaatattcagtgtactgaaatttacctgcatttaaaatcattataaaccaaaaaacacgtcaaatagcattatcgtattattattttttgtttgtttgttttgagacagagtcttgctcctgtcccccaggctggagtgcagtggcatgacctcagctccctgcaacctccgcctcccgggttcaagtgattctcctgcctcagcctccaaagtagctgagattacaggcacctgccaccatgcccagctaatttttttcgtatttgtagtagagatggggtttcaccatgttgaccaggttggtctcgaactcctcacctcaggtgatccacccgccttagcctcccaaagtgctgggattacaggcgtgagctcccacaccctgccagattattaacattttaaa

SEQ ID NO: 682049 - DNA, 232 bp, Homo sapiens
gaaagaactatacacagacacattacagcgaaactgaaaaagacaaaggatttcaaaatgttctagagaggaaaagaaatcaaacggcaacagaacttcccccaaagtaacatcagagataagaaaacaaggtagtaatattctcaaaaggttaaggggaaactatttaaaaccaaaatcattactcaaactaagctatgggtgatactaagctatcagctatacctgaggg

SEQ ID NO: 682050 - DNA, 469 bp, Homo sapiens
  misc_feature (8)..(8): n is a, c, g, or t
  misc_feature (17)..(17): n is a, c, g, or t
  misc_feature (42)..(42): n is a, c, g, or t
  misc_feature (85)..(85): n is a, c, g, or t
  misc_feature (199)..(199): n is a, c, g, or t
  misc_feature (282)..(282): n is a, c, g, or t
  misc_feature (338)..(338): n is a, c, g, or t
  misc_feature (428)..(428): n is a, c, g, or t
  misc_feature (441)..(441): n is a, c, g, or t
aaactgtnatccctatnaccccaaatttggacgggccttttnacccaactcaaaaactgatgaaaactagagtaaaatagccctnaatcaagtggacctatttatgaaatttctcccctaaacattgattccctcaccctattgagggagcccaggactgtaccggcccagtcttcaaaaggcagttaatgggcccagntcagtagcacatgcctgtaatcccaacattttgggaggccaaggtgggaggatcacctgaggtcagaagttcgacaccaggcnctgcaacatggccaaaccccatctctactaaaaaaaaaaaaaatttagccgggcantgtggcacgcacctgtagtcgcagctacttgggaggctgcacatgagaatctcttgaacctgggaggcagaggtcgtaatcagccaaaanttgccactgcacntccaaccagggcaatagagccagacctt

SEQ ID NO: 682051 - DNA, 288 bp, Homo sapiens
tatgtatattgctaaaagaaatgaaaacatatgtccacacaaaatctcgtagaaatatgttcatagcagcatcattcagagtagccaaaaagtaaaaacacacaaatgtccatcaactgatgaatcaataaacaaatgtggtctatctatacaatgaagtattattcagcaatacaaaagaatgaagtactgatacatcctcaacttggacggccctagaaaacattcagtggaagaagccaatcacaaaagagatatcacatgattccaggggtggccgtatatatt

SEQ ID NO: 682052 - DNA, 143 bp, Homo sapiens
tcttgaggatacccacagacggaggtgtaccgctggaccagcacagaggaggtggccgctggacagcacagacggaggtggacagcaggcggttgctagggcactggggtgggccccatctcctgtccttccctctgtgctgt

SEQ ID NO: 682053 - DNA, 400 bp, Homo sapiens
  misc_feature (13)..(13): n is a, c, g, or t
  misc_feature (88)..(88): n is a, c, g, or t
  misc_feature (94)..(94): n is a, c, g, or t
agctcggttctcncttttggggtctttgctcttttggggtctttgctcttttggggtctttgctcttttggggtctttgctcttttgnggtctntgctcttttggggcattgctcttttggggtctatgctactatggggtctttgatcaaatgggatcttagctctattaaggtcttcgctctaagcagacactttaagaggaaacttcattattagatcaggtagattactaccaagtgatgtgacatttagcaagaacggcagatattaagaacacgtacatagcgtttaatttccatcatttccttgatttcaggcaagatcatgaatcacagcacattgctaattcaacattcttaaagatctagaatggaagggcaggcagagacaccataatc

SEQ ID NO: 682054 - DNA, 328 bp, Homo sapiens
  misc_feature (13)..(13): n is a, c, g, or t
agctcggttctcncttttggggtctttgctcttttggggtctttgctcttttggggtctttgctcttttggggtctttgctcagccgggcccatccggtaaggctaaatactcccatgagaccgatagtgaacgagtactgtgaaggaaaggtgaaaagcactccgcgcggagagtgaaatagttcctgaaaccatgcgcctacaagcggtcggagcaaagtaatttgtgacggcgtgccttttgcataatgaacctacgagttaccatgtctggcaaggataagtgattcagtcacgcatccatagtgaaagcaaagaccccaaaag

SEQ ID NO: 682055 - DNA, 427 bp, Homo sapiens
gcccaaacctatgacgtagcaatgcgccataggggttgtaggaccacgacattgtattaagtcaatcgagaagaatattctggaaagaataaccatagagggtgatagtcctgtactcgaagtgcgacttagcatagtggtatcctgagtaccgcggaacacgtgtaattctgcgcgaatcagccgggcccatccggtaaggctaaatactcccatgagaccgatagtgaacgagtactgtgaaggaaaggtgaaaagcactccgcgcggagagtgaaatagttcctgaaaccatgcgcctacaagcggtcggagcaaagtaatttgtgacggcgtgccttttgcataatgaacctacgagttaccatgtctggcaaggataagtgattcagtcacgcatccatagtgaaagcaaagaccccaaaag

SEQ ID NO: 682056 - DNA, 212 bp, Homo sapiens
cggacgtccagctgagatctcctaggcgccgaaaaaaaaaaattttattggaaataaaaaattttcaatcatacacgtaatatcctttaactttttgtgttcgtttcttgtttcagtaagtgttagtgttcgtcaaatatcaaactgtataagaagatctaggacacacatccgtgttgtaggttaaaataccctgactctgacatgtcata

SEQ ID NO: 682057 - DNA, 169 bp, Homo sapiens
  misc_feature (13)..(13): n is a, c, g, or t
agctcggttctcncttttggggtctttgctcttttggggtctttgctcttttggggtctttgctcttttggggtctttgctcaaagtgcacaggaggtggcagcagggtcaggcaagttcctgttcactttgagcaaagaccccaaaagagcaaagacccaaaaggagc

SEQ ID NO: 682058 - DNA, 139 bp, Homo sapiens
catttaaggggtggcctggccttcggggtccccacgctcctttgcaaagtccactgtgggtgccatcatggtttccgggacctgggccaacgggaacgtgggggccctgggtgtgtttatataaagtcggcatttctca

SEQ ID NO: 682059 - DNA, 317 bp, Homo sapiens
ggggtttctttggggtttttttaggcccccaattttgggggccccccccccccccagggggttttttcccccaaaagggggggccctggggggggggaccgggggggggggccccttaaaaaaccccctttttgcccccccctgttggggttttttttttttggcccggggggggggccccccccctccccccccccgggggggggggggcccttttgggggtttggggggggggttttggggagtttttccccttgcgggggttttccctggggggcccccttttttcttttttatttttttttttctccccccca

SEQ ID NO: 682060 - DNA, 205 bp, Homo sapiens
gcacagaatgaagaacccagaaatagagctgtacacctacagccatctgagctatcaacaaagttggtcaaaaaatacacaatggagaaaggactccctattcaataaatggtgctagggtagctggctagccatatgcagaagaatgaaaccagactcctatctttcaccatataaaaatgactattggtggcatcgataaaca

SEQ ID NO: 682061 - DNA, 860 bp, Homo sapiens
gctagtaagcctggttaatcggccgagggcgacctccgtgacgcggcccgctgctgctcctcgggctgctgctgctcggctccggccggccgcggcgccggccagagccccccgtgctgcccatccgttctgagaaggagccgctgcccgttcggggagccggcaggctgcaccttcggcgggaaggtctatgccttggacgagacgtggcaccccggacctaggggagccattcggggtgattgctgctgctgtgctgtgctgcctgcgatggcgcctcaagtgtgggtctgcctgtaccatgggtgccctggcaagggtcatgctgcaagaacatcaaaccagagtgcccaacccctggcctgtgtggcatgcctgcgccagctgccgggacactgctgccagacctgcccccaggatgcgcagcagttcggagcggcatgccgagctggcctgtccttcgagtatccgcgggaccctggagcatcgcagttatagctgacctgcggggatgccatggctgctgaggacgcgggcccgtggtgactggccacacggacttcgtggctgctgctgacagggccgaggtcgcaggctggtggcacgatgcccgagtctcgctgctgcgctctagcctccgcttctctatctcctacagggcggtgtgaccgccctaccagtgatcctgttctcagactccaattggcatgtgtcctgtttgagcaccctgcagcccccacccaagatggcctggtctgtggggtgtggctgggcagttgcctcggttgtctctgcggctccttagggagaacagctgcttgtggccttgtgacctcactcaccctcaggggaggctcggg

SEQ ID NO: 682062 - DNA, 126 bp, Homo sapiens
atacagcaagcccccactgaccccgcagatggcccggtgtaggggaacttccctcatttctctctgcaatctgaaaataactcctccattgaaataactcctccccaccccaataacaacaaatag

SEQ ID NO: 682063 - DNA, 147 bp, Homo sapiens
ctcctcgaaaggttgtcagctccatcttgccgatcaccgagcgcaacgtggtctgcgcgagctgcgtgatcgcgatgatgtagttggagtgagtcatagctcgtctcgtagttgataggtcacctggaagtacaagatgccgtccac

SEQ ID NO: 682064 - DNA, 193 bp, Homo sapiens
ctcggctcactgctcctcgccgcccaggtccaaatatgctgtgccttagcctcccaagtagctgggattacaagcctgtgccaccacacctggctcattttagtattttgttttggtagagacggggtttcgccatgttggtcaggcaggtctcgaactcctggcctcatagagtagttgcgatgattgaatg

SEQ ID NO: 682065 - DNA, 366 bp, Homo sapiens
cctactgacctgagtcgacaccacctgagtttaagctgaaggaagattttgtggtaaggttgttagaaggagcatttgtgatatataatgattggtgatggcctggatgtggctttgtatgaatcgaaaaactaaacggaagacacaaggtccgaataagagaaggagaaaaacaggtattaatggactatgaattgggaggacccgtgacatccaattagagagtgcccaagggggttcagcataattacttgcttggttggcaagttttcgggctctattcttgacagagaccttttttttaagttggaggctgaactgagtgaggtatgattttaaaagaccattattccgttttacctttcc

SEQ ID NO: 682066 - DNA, 227 bp, Homo sapiens
ccagaatgattggaagtgccctgttttgcctgagcattcacatgtgtccagtaaccagctgtatggcctccagagggtacatgcggagagcctcatgcaaaggccaggacccttctatcctccctcgacctcctcctccaaatctatcctccaccgccacttcatattatcattacaccaatctggactgacatgcttatcgaaaaccacccccagattgtccgcca

SEQ ID NO: 682067 - DNA, 836 bp, Homo sapiens
agcggggggggcgcggctcgcggggtggccgaaggagcaggtgggcgacgctcgcaggggcgcgggagggtgccgctgggaccgtcatcaggagcctggggttctgccagctttcggagggatcagcgacctcttcgccctgcgggtgacagtggggcatctgcctgcgagagggggaacggagcggagaagccaggatcgacacacaaatgttctcctcatctaggaggacaggaggaggtgaaggagggaggagcccgtgttgatactaacttggagctgcagaaaaccttggggcggcgttcaaggcacccctcgccaaaaagaggcgcagagcagagcggccatgatcctaccttacagctgcgtggcgtcgacagcgacggggacgaaagaaagccagtccaataccggcgctgggagagctggaaaagacccagcgagagcaagaagaaagggcaggaccgcgagacgaaacacagagacaagacacgaataaacacacgcaatccgaagcgaagcgcacaattaggagacaaaggcgggaaaaaaaggtggcaataagagaagaaaaagaaaggaatacggaccaaacattgagaaaaacggccaaaacaacaaagtcaacattacaaaagaggaagacgcaagaccatacccacaaagatcaacaaaaggagacagacagacctaacactaccacagcgaaaacgcacccagtagacagagcaggacaacacaagcacgagaaaagaccagaaaggacgggaaagacaaagagaagcagagagggaaaaccaaaaagaaacgagaaaacaaggacaaagagagagaac

SEQ ID NO: 682068 - DNA, 292 bp, Homo sapiens
  misc_feature (147)..(147): n is a, c, g, or t
  misc_feature (277)..(277): n is a, c, g, or t
ttcaccgtgttagccaggacggtctcgatctcctgaccttgtgatctgcccacctcggcctcccaaagtgctggtattacaggcgtgagcaccgcgcccggccaccattcactaattttcaagaaatgtggaagtgttctatatttncttcccactccatagctccaacattgttggctattatgaatttggctattaagtgatgccaacaatatttaatgaaaaaaagatatagcagtatagttgaaggaggaagctgaaagaaaacggtccatcngtgaggaaaaggccc

SEQ ID NO: 682069 - DNA, 130 bp, Homo sapiens
  misc_feature (39)..(39): n is a, c, g, or t
  misc_feature (124)..(124): n is a, c, g, or t
gtgccacagaagatgtaagatcgagaagtagctttaagnagttaaagatagagcaacttattaggagacaacacaaaaggtaactgtaaaataaaatctatgcttctctgtctgagaattactntgcatt

SEQ ID NO: 682070 - DNA, 111 bp, Homo sapiens
aagattgcaccatgtgcagtctgcctgggtgacagagctagactctgtctcaaaaacagaaaaacaaaaaaacaagtttccagtggcttctcagtgctctgagaataaact

SEQ ID NO: 682071 - DNA, 269 bp, Homo sapiens
  misc_feature (193)..(194): n is a, c, g, or t
ggcaactgcttactttcattgtcagagtagagtcacttctgtaatattcaacaagcttaagatttgtcttgctagaatagtgagactatactagtgtctcgtcaatttgacagacgtatatcgttgctcaggttattacgccatacgtagtgatttggcaacctttctttatcttctatcccgttccttgatnncaaagagaggtagaagaatctataagggtgagaatgaggctgaacctcacgaaatagttcttaatgaccacaata

SEQ ID NO: 682072 - DNA, 272 bp, Homo sapiens
gtggaaaatgacggttataagaccatttatttctttggagaaaaaactattccaggtggcaatgaccatgagatcttcacagaccccagaaccatgggctactccgtgacagcgcctttaggccacggggcaggatctttgaactgctgttctcctaacgtgggagccggaggggcggggtcccggcttacaagccagcatagggaattcggtggccaaaagccgagggtcctcccacacgtgctaacccacccgcagcctaggcagggtct

SEQ ID NO: 682073 - DNA, 634 bp, Homo sapiens
tgggggggaaaaaaaaaggtggttttttttttggggggaaaatggggggggagggggggggaaatttttttttgaaaaacccggggtttggttttaaaacccgaagaatgtgtgttacgtcgtcatagcacggaggcaaaaagcgaggaagcgctcgcgcatcaggagagggaaaaacaccccctcgactgcttttagacgccggcttgccgggggagggagaacatctgcggggggacagagggttcttgttggatcagcagagaacacgagggggtatcaactgtgagggaggggggtgcgggggttctggggggggcgagcaccagcggtggccagggatcctcatcgtcgggattagagagcaaccccgggagggggggtgcgcggggacaaggagaagaagcagcagaaaaaaagcaaacatatttcagagtgagagaaaaagggccccctcccgtcgtcctaaagaagagggggtccccggggaagggttgttcttccacaagaaagaagctgccgttgtcgtcgtgaaggggggctagctcaggaaaccttcttcttatcgagttggtggtgtcaaacgtgttgataatacacaccaatctcgggggggcgtggttattgccgtcag

SEQ ID NO: 682074 - DNA, 404 bp, Homo sapiens
ggtccccggaaattcggccattatggccggaaattaaaaattccgccattttaggttttttattggccaacccaaccaaaattttaggttttaactttaaggggaaggttttttttttaagttgatctaaaattgaaggcaaattttctaatgtggaaatatttggttattattttaccggggggctttccaaggttttaaggcctaaggttcttttgttgcgttaatgtaggttgcccaggacctttaactaattggtaatggggcctaaaactttttgaaggtttaccttttaaatggccccgacgatttaaattttacaggtaaccatgggttaatcctggggcttccggaattttacagccaattttgaggataatgattccattgggttaaactaagcc

SEQ ID NO: 682075 - DNA, 2571 bp, Homo sapiens
cccagtccagcctccctactcagggccgagggcaccaggaggatggtcgttgcaaaagaatatgggaggccgggtgcggcggctcacgcctgtaatcccagtacttctgggaggccaaggggggcggatgacttgaggccgtgcaacacctgccagcaccagcatttgacacggaatcgaagaaaacaggcaggacataccctgactacactagtacaagtcatcggcgtctcggggtcctgggttttagaaatcacactgtcagggagggctgatggggtcctgggttggaggctggaagtggaggaatcgaggcataggcagaaacttgaaggaagggtcagccgagctggccagaagggggctcctcgccacggtccccagggaagcactttgctcatgggccccggccctgagagaggagctcctgcctcttcccactcggagagggctgacaggagaggcttggcctggtgtttcctgatgagatagcgggcacgttccgggaagcggtgagcaggcccagcagacatcagatgtggtgcttcctgtctcctgtgaatgcgcctggcccttgaggggggtctgggatggagagtcgggggaggggaaccccactcgcccttctccttgttgttcttggcagctggacttgggcaattgtgcctccaccctctggaggggcctccccctgtgctggctgcagatcagaggggcgatggggagggatccaccggtccaggcgggggctcaccttccagacccgggcgtgggcgagaggggtgcatgggaggacgcccgatgcctcagggcccccggtcagcagcgaggcacagactctcctctgggcggtgatggccctgcacgaggtccgtgtgccgtctgcctgcacagggagaggaaaggatcacgcgaccatgggtacgttggccacctgaaggttgagtcccgcagcctagagactggagcgtggggaccaggaggagcttcttagcggaactgggctggggctcatgcagccctccaggagcccccgacgcgacgccctggctcatcccgggtgaagaggctgctgagtctgaactgatgacagtggacgggtggccgccggttcccaacgcatggttgggcctggaacccaggtgactctgggagatgtggtcacagtcacagccgtctgtgggcctttgggttcaaaacagcgcgagtcacaggagacagaagggaatctgagcttgcgattgctcattcttgtcaccctcctggctctgggacacctctgccatctcctaccaagggtaccccattcctggcgagttggaaagtggcctcatgggcagaaaacgagggcaaagggagctgcgtgctgtgagagacgtccccgcacccaccctccccaccagctcccttgggcctttcctccctcccagccccacccacagccgggtggctcccttcactgtctctcctgggtttaactcagaggctggcgagcaggggctgaccagtgtgtgtcggagactctccgagtggccagcacgggcagggagctcataggcttggccctgagaccaggtcctgtctgagaaggaggcaggtcctgtctgagaagaaggacccccacccctcctgcctgggaccctgccttaggctcactctaatgacctaatttcaatttgattgaatgcaaatctgaatttgctagaagacctgatttcatctttccgggttcagtaaacatgacattctccgtgggggtttatttgtggaactcccagtcggagctgctgccccagcccagcagggctcagcgacgtgcactggttttaggagtaaatccgaagcaacagaagcgttcgcactggctctgggtgcagcctgcatcttcagccctggggcactgatgctgggcagcttctcggcttcactcgggaagggactcaggagcgaggtggtggggaagccagcagcttggctgaggcggcagtggaggtggtccagctccgcgactgctcccacagagcagggctgccgctcggtcagtgtgcagagtgcagccgcttggggccaacttgccatcatatgtataaccacttttaatgacatgctaattaggggacgggttattcagatatagctggaggatgggcagttgcttccaggtgttgccaaggcagtgagagcaacgggaactgcccttggcgcctcttccagctttggcctgtctttggtcgggtccggggaccaggcttgcctaccacgttttctgtgtcaaaacagtcacgcagaaataaacagtgacagcactgtgatgagaaaagcgaagaaacaacttatttcaactttctgacttttgttgtggcctcagcacttttgtttgtgcttaacattgaaaacagtgaggcagtgtaaactgtgagatgtgatttttcatttggtaagtgcaaattttagttcattcatgaaaccaattttgaagatctttaaaatagaatttagtcgaccttaagaattgttaattgtttacaactaaagaccaaaaatccaagagaataaagcgttgcaccagtg

SEQ ID NO: 682076 - DNA, 2664 bp, Homo sapiens
  misc_feature (2639)..(2639): n is a, c, g, or t
  misc_feature (2644)..(2644): n is a, c, g, or t
  misc_feature (2646)..(2646): n is a, c, g, or t
cccagtccagcctccctactcagggccgagggcaccaggaggatggtcgttgcaaaagaatatgggaggccgggtgcggcggctcacgcctgtaatcccagtacttctgggaggccaaggggggcggatgacttgaggccgtgcaacacctgccagcaccagcatttgacacggaatcgaagaaaacaggcaggacataccctgactacactagtacaagtcatcggcgtctcggggtcctgggttttagaaatcacactgtcagggagggctgatggggtcctgggttggaggctggaagtggaggaatcgaggcataggcagaaacttgaaggaagggtcagccgagctggccagaagggggctcctcgccacggtccccagggaagcactttgctcatgggccccggccctgagagaggagctcctgcctcttcccactcggagagggctgacaggagaggcttggcctggtgtttcctgatgagatagcgggcacgttccgggaagcggtgagcaggcccagcagacatcagatgtggtgcttcctgtctcctgtgaatgcgcctggcccttgaggggggtctgggatggagagtcgggggaggggaaccccactcgcccttctccttgttgttcttggcagctggacttgggcaattgtgcctccaccctctggaggggcctccccctgtgctggctgcagatcagaggggcgatggggagggatccaccggtccaggcgggggctcaccttccagacccgggcgtgggcgagaggggtgcatgggaggacgcccgatgcctcagggcccccggtcagcagcgaggcacagactctcctctgggcggtgatggccctgcacgaggtccgtgtgccgtctgcctgcacagggagaggaaaggatcacgcgaccatgggtacgttggccacctgaaggttgagtcccgcagcctagagactggagcgtggggaccaggaggagcttcttagcggaactgggctggggctcatgcagccctccaggagcccccgacgcgacgccctggctcatcccgggtgaagaggctgctgagtctgaactgatgacagtggacgggtggccgccggttcccaacgcatggttgggcctggaacccaggtgactctgggagatgtggtcacagtcacagccgtctgtgggcctttgggttcaaaacagcgcgagtcacaggagacagaagggaatctgagcttgcgattgctcattcttgtcaccctcctggctctgggacacctctgccatctcctaccaagggtaccccattcctggcgagttggaaagtggcctcatgggcagaaaacgagggcaaagggagctgcgtgctgtgagagacgtccccgcacccaccctccccaccagctcccttgggcctttcctccctcccagccccacccacagccgggtggctcccttcactgtctctcctgggtttaactcagaggctggcgagcaggggctgaccagtgtgtgtcggagactctccgagtggccagcacgggcagggagctcataggcttggccctgagaccaggtcctgtctgagaaggaggcaggtcctgtctgagaagaaggacccccacccctcctgcctgggaccctgccttaggctcactctaatgacctaatttcaatttgattgaatgcaaatctgaatttgctagaagacctgatttcatctttccgggttcagtaaacatgacattctccgtgggggtttatttgtggaactcccagtcggagctgctgccccagcccagcagggctcagcgacgtgcactggttttaggagtaaatccgaagcaacagaagcgttcgcactggctctgggtgcagcctgcatcttcagccctggggcactgatgctgggcagcttctcggcttcactcgggaagggactcaggagcgaggtggtggggaagccagcagcttggctgaggcggcagtggaggtggtccagctccgcgactgctcccacagagcagggctgccgctcggtcagtgtgcagagtgcagccgcttggggccaacttgccatcatatgtataaccacttttaatgacatgctaattaggggacgggttattcagatatagctggaggatgggcagttgcttccaggtgttgccaaggcagtgagagcaacgggaactgcccttggcgcctcttccagctttggcctgtctttggtcgggtccggggaccaggcttgcctaccacgttttctgtgtcaaaacagtcacgcagaaataaacagtgacagcactgtgatgagaaaagcgaagaaacaacttatttcaactttctgacttttgttgtggcctcagcacttttgtttgtgcttaacattgaaaacagtgaggcagtgtaaactgtgagatgtgatttttcatttggtaagtgcaaattttagttcattcatgaaaccaattttgaagatctttaaaatagaatttagtcgaccttaagaattgttaattgtttacaactaaagaccaaaaatccaagagaataaagcgttgcaccagtggtaggggtttgtagttgcctaaattgtaccttttacagatgtttcattttattaaaactcactagtcnctggntnttctattcaaaaaaaaaa

SEQ ID NO: 682077 - DNA, 451 bp, Homo sapiens
catctcaacctctgctgggataggaacagaatgatggcctcagcagagacaccgcaacaaggaggcagcagcaacaaggtcaccacctcctcaaggaaagccacaagggacatcccaaacaggagagcatcccccctcctcctcaaggaaggccacaaggaccaccccaacagggaggcccatccccgtcctcctcgaggaaggccacaaggacaacccaacagggacggcatcagcaaggtcctcccccagctcctcctggaaagccccagggaccacctccccaagggcgccgcccacaaggacctccacaggggcagtctcctcagtaatctaggatacactgacaggaagtgaataagaagatgacagtgtttcaaatgccttgaaacataatgtgatcatgctctaacttcaatataccaataaaataatcagattgcggagttag

SEQ ID NO: 682078 - DNA, 142 bp, Homo sapiens
cctgaatggtgctgacagggacacactcctcttccagctcctggtgattcacggccttccttggctctgcgtggagtttcacatggccttttccctcttctattttgtctcttacaagaacacctgtcagttgcatttacgg

SEQ ID NO: 682079 - DNA, 168 bp, Homo sapiens
tggagcctcccaggcatgcagaacggagagtccggtaaacacctgttctttataaattaaccaatctcagggatttcttcctaggcgtgtgagaatgggctaattacacccttgggagtcactagaaccctgggtatgccccagacccttctattgtttttttccctc

SEQ ID NO: 682080 - DNA, 103 bp, Homo sapiens
caaagagggccagccctgagaagcttaccttaaatatttctttccttctctcatggaagtccgattaaagccaccccttctccttatcctgttcaactgggct

SEQ ID NO: 682081 - DNA, 566 bp, Homo sapiens
gtgagtatgcgcagtagtcgtctcttgcggtgcgttggtggttctcacaccttttaggtctgttctcgtcttccgtcgccgactctctctttttcgcttgctgccactgaagatcctggtgtcgccatggtgcgacgccccgtccgttggtgagtcttgactccgtgtacttgcatcctgtcgtgggcaagacgtagcgagggtaacagaagctgccgtatggccgtctgaaacatacaaattgtggggtggcatgccgtcccccgctgcgttggccctgatcttggtgaactgaccctatgttattacacctcccgggcatattctatttagtcgtgcgattacttactgtactgttccattcggatcccgtgatcggtgtggaagtcgacgtgttccctcgtatctctgccgtgtgtcctgcgaaggctcatccgcattttctgggcgctagataccgctcttggggccatattgtgtgcgttcatcgtgtctgtatttccgggcgagcgtgcctgctgtgcggttgtcaggatcgtgagggggcagtccgggaacaaatgggt

SEQ ID NO: 682082 - DNA, 117 bp, Homo sapiens
agggagggaagcttctcctcctcttggggcaacggtctgggctgaggctctgagctgggaaggtcaacgtcccctcctcaggttccttcagtcccagctccattggagcctcatgta

SEQ ID NO: 682083 - DNA, 248 bp, Homo sapiens
gaagcaccgtaaaggcgctgcgcgttgccgcccggttgggattttcgctgagcggccacggctacatcaagggcatcgtcaagggacatcattcacgacccggggccgcggcgggcccttcgccaaggttggtcttcccgggattcctattcggttaaggaggcggaccgaacctgtcaattcccgccagggccattacacacggcccatttgtgtgtatgcgcggcaggaggccccatctcaacatg

SEQ ID NO: 682084 - DNA, 973 bp, Homo sapiens
aggagctggaacacagccaggacacagacgcggatgatggggccttgcagtaaggcagtcctgacatggagcaatggcgaccagcaggtgaagggcatcgtgcgccaggcctcgagcggggcacccaaactctggatgccagcccccgcagcgggttaccagagtgcaaatgcatgggcgagaatggcagcctcatctcgcacaatgcattccagccaggtgccagtgttctctgcaggtggagttactgcctactccttccccatgagccctccctgtctgcactgccaggccagagggtagagcacaggtgtttccccatatactccccctccccaggaacactcccaggctgggtttggtgctaatacggttggcggggggccacagggaaggggacccctgacaactaaaagagatgaatctcaaaaaaaaaacaacaacaaaaacaaacgagaacaaaatacggtttgccgccgcagcatacgcgccccacaaaaagcacttaaagacaacatcaagatggggcacacagcgggcacaaatatagcagcaacgcaaacacgggcgcaagacagggaccaggaaaaacgggggaagacaagagagcgggacaccccaccaacaataacatcaggccgcggggacacggcgcgttggacaccaccacaagggaggctagagaggcaacaagaggcatagacacacgaggacaacaacgaaacggaataaaaacgccacgcggcggaacaaacaaactgaagcagaaataacgaaccatccatgaaacacgcgcaaaccggcacaacgcaatacctgctcacacagacgagctgacagcaacaaacgacgagcaacgcccacgagaactacccatagatcgccgaccagcagacacacagcacgaagccgcgcatcacgacagcataccacaagctaggagacgaaccgaccacagtcatgatagccgata

SEQ ID NO: 682085 - DNA, 211 bp, Homo sapiens
  misc_feature (103)..(103): n is a, c, g, or t
cagtcaaactattattaggggggggggggggggtctcaatcaatctaaatcgattcgttattctgaatccatgctaaatcgtagctatcggactgagcttgantggtcacactacgtgatactagctgatgctactgatacgtcagactagctctcatacgtactgatgccgtaagctaatcggctagctaggtcgacgtagagtctcgca

SEQ ID NO: 682086 - DNA, 748 bp, Homo sapiens
ggggatcaaaagtgggaggtggatggttcttattctggaggagaagaagggcgggaagaacttccgtttcaggaggaagctggaacttactgactgtaagaggttagaggtggaccgagaaggacttttacgcagtatttcaggtggcacttcccaagattgtcctgttgccggtgtggtctgtgcctagattttaggacagataagatgactgccatgtgatgttgcaggcttaatttgtgtttgttcgtttcctttcgatatcgcagtataatctctgataatcgacaggacgagcccaagaacccatgtgctctcccgagtaacacggatggctgtcttggtcattgccatcctacattttgggactcctttcagactcaacacagttcccttgctcagtgaccaaaatggtggcctactggctggtctagcagacagtggtacttagcaaagaccactgtttccatagtgaccagctgatacctcttctgccctctagtgtgacaattgggtgttgcctcagtttcgctcccagctcagtctttattagatcaaagctgttgttgcgcaccagagtggccacttcaatcaccagccaacatgcttgctttgtccaccagaggtgcaagttcacctctctggtgctgtagttcccagctccttcctgattttgctaatcgctccttgtggggaacaggaagtgatcttcgccatggtggacggaaatgccgtacctcagtagtta

SEQ ID NO: 682087 - DNA, 129 bp, Homo sapiens
gtttacctggtcgcaagtcggggttgctgtaaagttgcgtaggtagaagtagaggttacggagggatgatggtggctatgctggtggggatgatgaggctatagttttttgtgaattcttcgataatgg

SEQ ID NO: 682088 - DNA, 253 bp, Homo sapiens
tcagacgctgaactatgttgcatttgctatgtaatccctgcccatggtggccgcagctaatcagaatcagatggaaaattaaaccgggtaatctgcttctaagccttaagaatattccctgtggacacatgacactataatgtggaagtgctgagctctgggtgcagagaggatcagtgtgactcttctgcaacacaagtttgtcccctcagcctcacatatgttcacgcgtctgactgggtacccgagctcg

SEQ ID NO: 682089 - DNA, 1012 bp, Homo sapiens
  misc_feature (241)..(241): n is a, c, g, or t
agcgggtggtgaggcctacagaacgcggccttcagctggaccttggtctccccgccggacttcgagggtgtctatcgtccgcccctggttggcggcgtgagcgccggcgcggtctggcctgtactgccttcagcagtgcagagagaaaagaccccttgtatacgcatgtaaccaaggaacacgctgtgctcgttttcacttggctccaccggagccaattgcgacgatccctcttagcacncgagcatgagagtgcgccccagaggagttctattgcccacacgacaagacatacgacctatgacaccgaagaggcgatcagaacagaggacagtatggagtgtgcgtttagtatgactgacgtatgactaccatgcgatgctaccattgcaagtgaaccatcgtggtgccttcagaagtcttttatttccgcgtcaaagggtacctttcaagtgtcacacaactaggaggagatgagagaatagaagaagacgctaggtaattccaggctactgtaattaactttgccttcatcagtgtttgcttcagagttatgaggaagatgttggatcgttaaactaacatgcatgactccagatttcacggacctcgactggattgtggatcctgacattgttgctagctcttgatgatcgatttcgactttgatgactccagataatctgcttgaggatgacttgtattcttcaggccaaataaggcaacaggaggaggaacgagggcaatggatatccagaacattctgagaatgaccgatttacggcgagtgggaagattgtggattgatgagcaagggagatagccattgatgactagtgaattctggcaggccttataggtccagattgaacactgtatttgtcctgggcccccggaaaaacttccagaactatagccgaattcactgtgttctggagttaggaaacaacagaagtgctttccgggattatcgctgaaattcctcaatcatgagaaaatgaacgtggaccta

SEQ ID NO: 682090 - DNA, 358 bp, Homo sapiens
cggtttcacgtatacctgcagcgcctcactgtccaccacgtcagctaggtattcctcctccagattgaggatgtgctcgattgcttcctccacattctctgggagccccgctcacatgtgacgcacgtttgggagtctgggtgctccgactctgtgcgtaagcgaactgtccaaccttgtaattcagtccactgtattattgcgacctggccttctgccgacgggccacctactgactccgtgcgcgatcacaccgccgatgtgtccgagcgcgcgactgtcctactctaacccaatgcttccacgtgggagcaccaaggcggacccacccttctactcaggactgtccatcatgacc

SEQ ID NO: 682091 - DNA, 303 bp, Homo sapiens
ccgggcttcattggaaaaaaacagtttagtgtaaccgactaaaacatgatgaggccaggcgtggtggctcatatctgtaatgccgacactttgggaggccgaggcgggcagatcacttgaggtcaggagtttgagaccagcctggtccaacatggtgatgccctgtgtctactagaaatacaaaaattagccaggcatggtggcgcatgcctatagttccagctactctggaggctgaggcaggagaattgcttgaaccaacagaagggaaataaattgtggcatactcattacactctgtgg

SEQ ID NO: 682092 - DNA, 1769 bp, Homo sapiens
  misc_feature (149)..(149): n is a, c, g, or t
  misc_feature (1250)..(1250): n is a, c, g, or t
  misc_feature (1253)..(1253): n is a, c, g, or t
  misc_feature (1263)..(1263): n is a, c, g, or t
  misc_feature (1293)..(1293): n is a, c, g, or t
atcctgcccttgctccaaaactgtcagtggtggtttcccatgaccacgccacagtcccagggtctcccctggccttcaaggctggcacagtctgaccctgccaacgtccctagtgccaccatctgtcagcccctccttgctcctgctcntggtctgcacatgctgttctctttgccaagaatgccatttccccagccccctggttccgatggggaacacctcctcatccttcaaagccaagctggaagggaacatctttggagatgccgcttgacctcccaggcagaaggggtcattctccctggagatgtggtcacgtcattaaccacactgggttagaatcatcagaagctgttcctgcctcttccgtcaagcaaggggctctggaggccagaaaatgcctatgaatcatgcccacacccccagagcccagcatggggcgggctcaggttaggtcaatcgtgtttgaagactgaataaatgaatgtcttcatttgctaccctcagaagcccagtccggaaaaaaattccagtgcaaggtttttggcttgaatgagatcccaagaatcaccttcaggttgtcaggaaaatgatacagggaagggaaggagccaacaaagggtatgggaatgagcacataacactatggacagctggggaaccttgggcgatgatgcagaactgtttatcactaactctcaccaggtcagttgtgcatcaaggctactcgggggatagcactttacagcctactctagcaccacggtggccttctggggcaggggccagcaggctgcagctgctggatgaagcccccaggcagagtcgctggtcctcaggtgctcaagcttagctggaagccttcaggttgctgtgcaatggaatagtgagtacccagaggatatgtgcgtgtgttacagtgagtgagtgaatgaacgaatgaatggagaatcaagaaaagagccgcgtatcttcagtcattgagcagacacgggccttctgctgtgtggccctggacgagccatcatgcctctctgaccctggtttcctcttctataaagcaggaatgctagcccagcctcccaggagataaagggtgggaggtcccagagagtgagaagggttccactgggctcccagactcaatctcagctccaggaagcaggacatggccccagtgagggttctctgtgggtgaagaagccacagaaggcaggcacagtgccctggttggaaccacaggggccccnaancaaccacatnatggccaccacagcctccaccatcccacancaatttccgctgctgcctctcccagggcaagatctcccaccagtggctggctgtcccctctgccagcacctgccccgggtgggccctgcagcatggccatggctgctgcaaggcaggctggcagctgctcctgtgtgcagcagcgtgtctgctttgaaaagccacagagactcctgtggttaggggctcatgttacagtagcacacgttcgaatcccagttctactacttgtgactgtgggaaagtaatttcaccccagtcctctctggtctcattgatcaaatggaactaacattctattgtcccctctggtggtctcaactccagcagtttgtgagatggttgccttcactgttttccctactgcaaaacccataaggacacagttatcttgcctcctgccccaaccccagggtcttgaacacagtaagtgctcgataaatgcttggtaaatacatgaattattgtctgaaaaa

SEQ ID NO: 682093 - DNA, 555 bp, Homo sapiens
  misc_feature (262)..(262): n is a, c, g, or t
  misc_feature (330)..(330): n is a, c, g, or t
  misc_feature (398)..(398): n is a, c, g, or t
  misc_feature (404)..(404): n is a, c, g, or t
  misc_feature (409)..(409): n is a, c, g, or t
gaagctgttatagtagctgtgtaggaagaaagagagcaccagtgagaggccctgctacagatggagcaagagcaaatcatctttaagtacctcttcttcaaaggctcagaaattaaattaagtattctttgtggtcacgaaggggaaagaacattgcttataaagagaccagaagtggtatccaccatggcttctaccctataattctctgtaaaaatcatctgtactgtgtccaggaccagccactgttgcagcatgagtncccagcagcagaagcagccctgcatcccaccccctcagcttcagcagcagcaggtgaaacagccttcnagcctccacctcaggaaccatgcatccccaaaaccaagagccctgccacccaagtcctgagcctcacnccaaantgccngagcctgcagccaagttccagaccatgaaccaaaggtgcttgagccctgcccttcaatagtcactccagcaccagcccagcagaaagacgagcagaagtaatgtggtcacagccatgcccttggggagccggcaccagatgctgat

SEQ ID NO: 682094 - DNA, 953 bp, Homo sapiens
  misc_feature (149)..(149): n is a, c, g, or t
atcctgcccttgctccaaaactgtcagtggtggtttcccatgaccacgccacagtcccagggtctcccctggccttcaaggctggcacagtctgaccctgccaacgtccctagtgccaccatctgtcagcccctccttgctcctgctcntggtctgcacatgctgttctctttgccaagaatgccatttccccagccccctggttccgatggggaacacctcctcatccttcaaagccaagctggaagggaacatctttggagatgccgcttgacctcccaggcagaaggggtcattctccctggagatgtggtcacgtcattaaccacactgggttagaatcatcagaagctgttcctgcctcttccgtcaagcaaggggctctggaggccagaaaatgcctatgaatcatgcccacacccccagagcccagcatggggcgggctcaggttaggtcaatcgtgtttgaagactgaataaatgaatgtcttcatttgctaccctcagaagcccagtccggaaaaaaattccagtgcaaggtttttggcttgaatgagatcccaagaatcaccttcaggttgtcaggaaaatgatacagggaagggaaggagccaacaaagggtatgggaatgagcacataacactatggacagctggggaaccttgggcgatgatgcagaactgtttatcactaactctcaccaggtcagttgtgcatcaaggctactcgggggatagcactttacagcctactctagcaccacggtggccttctggggcaggggccagcaggctgcagctgctggatgaagcccccaggcagagtcgctggtcctcaggtgctcaagcttagctggaagccttcaggttgctgtgcaatggaatagtgagtacccagaggatatgtgcgtgtgttacagtgagtgagtgaatgaacgaatgaatggagaatc

SEQ ID NO: 682095 - DNA, 250 bp, Homo sapiens
  misc_feature (104)..(104): n is a, c, g, or t
  misc_feature (107)..(107): n is a, c, g, or t
  misc_feature (109)..(110): n is a, c, g, or t
  misc_feature (113)..(113): n is a, c, g, or t
aaaccagtaattgttactgggttgcaggatacaactgttcttcagacagtgttgctaaatttgcagttaaggctactggagaacccgaccaactgccatctggnccncnnganggaaaggccattacacaaggaggtaaatataaactctcctgaagacaagggagggttcttcttagaaattcataagactgatacttctgacagtggactttatacttgtacagtaaaaattcagctggatctgtgtc

SEQ ID NO: 682096 - DNA, 781 bp, Homo sapiens
gggtcctaggggtgcttccgtggtcggcggctgctggggctccgcgccggggtccgagtcccacgaagccccgggccgagccgccggatgcccgcgcgcagaggggcccagtttgccgagggatggggcaaagagaagcagcgaccagctagagcagggtcagccacagagctcgtccgacgcagcccaggcaacctgcggagcggccactacagctctgtccagatgcagacccaggcacctggccccagggagcgctgcattgggaccgcccaaccaactcccgggcccatataccgcacgtgtctactattctcaagcccataagggccgaccattatccgagtgggggttggaggttcttcggaccgagctcgggagatcggccacctggcccaggggcaattatctgggacagggtcctaggctccgcgcggaattgtcctaatgggagcagaaacctccggagggccagcaatcaggtgggcaggaccggatggtcgactagccctggggggcccacgaagggatttgaacgcccagtccacatctaccaccggggggtggggccgggaagagagacgccacacggaagagaccggaggagcactgttacacttgagagtccgggggaggaaccacgtgttacggcggttacctctgcatttgagcgggcatggtaccattcgtggatcgtgaacgattacttcgaggcaggggggacacagggggactaggcagaactggctgcacaaggaccgggagcgccgggaggcgacgg

SEQ ID NO: 682097 - DNA, 626 bp, Homo sapiens
gtcgatctaaggatcctgtacaggtatatttgcccacgttgcttaggatttgtctcatactcctgtggattatgcaggtaccgtccatctcgtgcttccaaagtgctggattaccgggatgaaccactgtgcccatctcactagcgtaatatctgtattctatgtagacagggtttcaccatgtggcccaggatggccctctgcattcgaaagattttattttttgaaacgaagtctcactctgtcacccaggctggagtgcggtggcacgatctcagctcactgcaaccttacctcccaggttcaagggattctcctgtgtcagcctcccaagtagctgggattacagacgtgcaccaccacgcccggctaatttttgtattttaagtaaagacggggtttcgccacgttggccaggctggtctcgaactcctgacttcaggtgatccacccgccttggcctcccaaagtgctaggattacaggcgtgagccaccgcgcccggccaaacatttgttttatattggaaatattttcttcgaattttccactttatagacctcactttgtgtgtgtgtcatcttagaaaggttttctctctatttctacattctatgttcagattca

SEQ ID NO: 682098 - DNA, 598 bp, Homo sapiens
  misc_feature (16)..(16): n is a, c, g, or t
  misc_feature (72)..(72): n is a, c, g, or t
  misc_feature (126)..(126): n is a, c, g, or t
  misc_feature (175)..(175): n is a, c, g, or t
  misc_feature (209)..(209): n is a, c, g, or t
  misc_feature (225)..(225): n is a, c, g, or t
  misc_feature (229)..(229): n is a, c, g, or t
  misc_feature (249)..(249): n is a, c, g, or t
  misc_feature (321)..(321): n is a, c, g, or t
  misc_feature (332)..(332): n is a, c, g, or t
  misc_feature (338)..(338): n is a, c, g, or t
  misc_feature (357)..(357): n is a, c, g, or t
  misc_feature (369)..(369): n is a, c, g, or t
  misc_feature (375)..(375): n is a, c, g, or t
  misc_feature (380)..(381): n is a, c, g, or t
  misc_feature (414)..(414): n is a, c, g, or t
  misc_feature (424)..(424): n is a, c, g, or t
  misc_feature (427)..(427): n is a, c, g, or t
  misc_feature (501)..(501): n is a, c, g, or t
  misc_feature (517)..(517): n is a, c, g, or t
  misc_feature (531)..(531): n is a, c, g, or t
  misc_feature (534)..(534): n is a, c, g, or t
  misc_feature (573)..(573): n is a, c, g, or t
acagggggctgcagtnctagtaccctgtcggggaggactgagggatggtgagtttggtctccggagggggcnccagtcctggtgcccagttctgacacctgcccctcctgagttcacactggagtncttgcagtcctgaaaccacaaggcctgcctgaaccctgggtcaggaganaaacacttggggaggggaaaggacggcgtgggcnacccatgacggctctnagtncttcctggggcttgtgtctntccttggcagaagagggcacagccaaggcaaggaggggctgaaggctgcggggccatcccggcctgccaganccatgcccctnactccncagcttcaaaatcaggggnctcaggacagangatgcngggtnnggctcagagctcatcaggggggctgtgtgtganaggggatgcnttntggatgccctcatcctcctcggggctggggtctccctcaaggccacccagctccttcctttgtttgctgccgcnactcctgccgcctgcngccttggccctgcngcncttcttcttggacttcttccctcccagggcagctgtttnttccttcttgccggaccactgctct

SEQ ID NO: 682099 - DNA, 136 bp, Homo sapiens
tgctggggttacaggcgtgagccaccgcacctggttatgttatttctcttctcttctcttctcgatctcgtctcgtctcgatctctcttttttttgagacagatactcactgtattgccaggttgtagtgcagtgg

SEQ ID NO: 682100 - DNA, 412 bp, Homo sapiens
cgtgaatatccattgaatggttccatcctgccatcgctatactaacatctgcgtccagagcttcacaaaattacaaatctttttcatctctaggccttttttaaattgttatctcaataccactgttttcacaccaagaccaccataacagccttagcattatgcatttgcaacttgcgtacctccctgatgtttcccgtcccctctctccctttacagaagcaattacttgggccaggcacagtggctcacctattaatttatttattttgagacagagtctcactccatcacccgggctggagcgcaatagtgtgatctcgacttattgcaacctctgcctcccaaagtgctgggatcacactactacagccggctgaatatctttatatctaggtccttgtaaagctgt

SEQ ID NO: 682101 - DNA, 170 bp, Homo sapiens
attatgttgccaaatgcaaacctgatctacatattgtagtgaacctgtaattaaggtaacaattatgtaaaatcaccacatctggaagtctatgacacaggaaactctcacaaccacactggttacagggccttggtacgttgatgcacaactatactttacacctcacg

SEQ ID NO: 682102 - DNA, 164 bp, Homo sapiens
ctgtaccaagtaggaattctcaccactactcaataacagaaataagtgcctacagctaacttgcgagtactggctgtgctgttcatcatcctaaatcacatgggcatggtctacattacatccatttggacttctggactaagccaccaaacaccccttttctc

SEQ ID NO: 682103 - DNA, 264 bp, Homo sapiens
gatctggaacattgtgtatacttactgattagagcatcacaaaatccaagagattcagagccggtgatgctgtgtcccatgaccctgataatcgcatcattttggaggactacaagtgagcagactagcgttgagcacaagggtttgagaataggccatgcctgatctggtacccccatctgtaccaacatgccaccgttagccatgcttggtggtcgctgtgcctctggctccctgctattctgtatggggaatctcggacgc

SEQ ID NO: 682104 - DNA, 272 bp, Homo sapiens
gtacgttagcctgggcactacagttagagagacctgtctctcaaaacaaaaatcaaaagttacatttacacagttttagaacaacagtgtacataccttaatttaaaaatattttattgctagaaaacgctaacaatagcggctgggtccagtggctcacgcctgtaatcccagcagtttgggaggtcaaggtgggtggatcacctgaggtcagaagttcgagaccagcctagccaacgtggtgaaacgcgtgtctattaaaaatacaaaaa

SEQ ID NO: 682105 - DNA, 379 bp, Homo sapiens
ctgagttcgcggcggcgtcgacggcgatgcctatgagcccaggtagtcaggaggctgacgcataagacttgcgtgaacccgggacgtggaggttgcagtgagccaagatcacgccattgtactccagcttggcagatactcccgctgtctcagaaatagagtagataaataggccaggcacagtggctcacgcctgtaatcccagcaccttgggagggtgaggcgggtggatcacttgaggtcaggagttggagaccagcctggccgacaggtgaaaccccatctctactaaaaatacaaaaagtagccgggcgtggtggcgcatgctggtaattccagctactcgggaggctgtggcaggagaatcgtttgaacacgg

SEQ ID NO: 682106 - DNA, 2220 bp, Homo sapiens
  misc_feature (1053)..(1053): n is a, c, g, or t
tgctgagtgtattattgtaaagatcgaagtgaaggatcgcgaacgtagagcattgagagttattagtactaggcatgacgacgtagagttgcagattacttgtagtacacaatcggctaggcaggatatgcatgcgctcgctcgggaaggtgccgtatgtgaatatcactatcgcacgaccgacgcgccggcaagccgctatagcatacgaatctcgatgcgacatatagtcattcgagatcgctcgatgcgctatgtcggtgcgcacgcgtcgcgctggctaagcgccaagcgagcgttcattgggctgtccatcgcttgagctcgttgtgtctcggtctcttgcgcatacgcttagctgacccggatacgacacgccgtctcgttacacgcatcgaactctagccgatagagccaagttctagagtggacctatcctaatcggtcttctgcgacctatcctagtcgatctgtagaccaccagaacctgacaacggttattggctaacctcggtgcgcagggcaacgaactttatagactgcaactagttttcaaatgctttcgattcacttaccgtttgctttggttctcagccataatggacgtaactgcatctaatccgcactactggtgaaaatatatagactctaacagctgcccaccagggcacgcattaggcagcatttaggtaattaaaaaggcgccttaagttagcacgcccgcacagtggggaataacacacgtgaagccaacgcatgtgggcccaaccgaaaagggacgaggatacgaccgactacaccacaaaagcgagcgagcgaagagtacgcacacacacacaaaagaaagcgcataggcaatatgtgaatatacccctgtgcgtgtgtcataacaacaactctgcccacaccaatcagcgtagacgccaacagcatgtgaaagccgccacggtataagcctctactcaccaccatcatgaaacataacggatgtcactgttcataggacaactactatgggctcccgcaggacatcatcgcaaaggttgaccgcanactatgtagatcacagagcgaatatagacacaccctacacagatacaagtttactgcacaacacagtaacacattatccaagcatcgggcatcagaaaaacagagcctcgatcctgctacaaggcagtcacactggcacccatccgataatgcagcgtcgataccatatcaccatacaacgcacccagcgcattagggacagccctctcacctatcactcgtcgaatataactcacactcgacacccgcaagatccatcttatagatcgatcgtcaccagtctaccagtacgaacccacaaaacctcttgttagattacaacgtagactactggacactccgcctataaacgattataaatgaatgcccactgattgatcccatttcgtaaccgctcagaccaacctcatgaacagcaaatctaagtgataccagataaaaagctccctcaccacaagagtctcagtcacacagaccacctagttctgtcgctcgacactcacctccccccctgctctagtttctgatacaccgcaatgtatccgctcgtctggctctcaccagaatcatcacatacccgacagcagcacttgccctatacttcgcccacagatatcacagacgtacccgtaccctactgaagacctacctatcaggatcgtctcacattatcaagcgacgtcacgaagacaaccatcggagcccgctacgcgttatataacaacaccaatcatatttagtgcatcgactataacacgaacacaccctcattggcacacaccagccgcatctataagcattcacctgaacaacatcccaagcgaaatcatgatacaaaacgaatcatcctctgcccatgcctctactgtcactcgcttccgacctcacctgctaggtcagtgcacaccacatcaagacgcaaacaaacactagatcatagtccatccgcatactctcaagtgtgtcgcacgacctgtacacgacaaaagcgagatcatgaccgcatcactagagttacaaactagttcgaagaagccagtagcgaacacacactagactattgtcaacggcaccaggcgccagcagccatagtacgcacacatcgcgtacatcccgccagcgattaaacttcatagaccatatgaccatactagaccagcaactaca

SEQ ID NO: 682107 - DNA, 233 bp, Homo sapiens
catcaagaagtggaagactgcccttgatgagcagtagctgaatgtgtaggtgtaaacaaggaatgctctgtgtcgtcacagatgaatgagggcgtgatgggaattcctaatgcagggaaatcgcctgattcacagacagtaccataaatgcagatgaatgtctcataacgaattaggctgggttgctgacatagtaatatagatacagtaggtaactatcattaggttgcaga

SEQ ID NO: 682108 - DNA, 346 bp, Homo sapiens
  misc_feature (30)..(30): n is a, c, g, or t
  misc_feature (75)..(75): n is a, c, g, or t
cccttcgattacggctgcgagaagacgacngaagggacttgaagagggaaggtaaataactgggcgagatgggtntggtggctcacacctgtaatcccagcagggaggctgaggtggccagatcccaaggtcagaagatcgagaccatcctggtaacatggtgaaaccccatctctactaaaaatacaaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctc

SEQ ID NO: 682109 - DNA, 502 bp, Homo sapiens
  misc_feature (207)..(207): n is a, c, g, or t
  misc_feature (274)..(274): n is a, c, g, or t
  misc_feature (356)..(356): n is a, c, g, or t
  misc_feature (361)..(361): n is a, c, g, or t
  misc_feature (401)..(401): n is a, c, g, or t
  misc_feature (473)..(473): n is a, c, g, or t
tgagaccatcccctggtgacagaatgacccgtttgatggaatccctcgttgcaagagaaactccccaggcatctcggaacgaaactaattagttccagtgtgaactgcccaaggggacaccctttatcaacttactaaggtggaccactgtagtcgcgcttgctgagacaccagtggtggtaagcgtgtgggaaacagatgatgtgncgtctaaggagagagaggtcttacggaagtgtcgtgtcggtcatgactctcttctattagttgggtnacagtgccctcatgggtgtctctgtgtgtacaaagagcccagagccactactctgtgtcttttcgaggtggatgattgtganatccnctactgtccgctcacctctgacctgcgccgggttcaactntctgtccccctgatgtccaccatgcacacagaacctccgtgtgtctatttctctgttcctctgtggctgacncaatagacttttccctctgaaaaaaaaaa

SEQ ID NO: 682110 - DNA, 410 bp, Homo sapiens
  misc_feature (36)..(36): n is a, c, g, or t
  misc_feature (126)..(126): n is a, c, g, or t
ggatgtcagtgctacctccacaaacagagtgctacntctagtgctactccacaaacagagtgtacctccacaaacagaaacgatccatttatgacaagggtcactgaatgaacaccagtcactgtnctgtcacaatcacaccagcgagcttaagagttaggaaagaatgaggtcggtgcagcggctcatgcctgtaatcccagcactttgggaggccgaagtgggtgaatcacgaggtcaggagttcaagaccagcctgggtaacatggcaaaacctgtctctactagaaatacacaaattagccactgtgtggtggcacacacctgtaattccagctagtatgggagtcagggaggatagaatcgcttgaaactgtctggggtaacgagctcccaatttcctactcctg

SEQ ID NO: 682111 - DNA, 297 bp, Homo sapiens
  misc_feature (29)..(29): n is a, c, g, or t
  misc_feature (45)..(46): n is a, c, g, or t
  misc_feature (123)..(124): n is a, c, g, or t
  misc_feature (234)..(234): n is a, c, g, or t
  misc_feature (249)..(249): n is a, c, g, or t
aggaggtgatgaaagtttcgccatgttgncaggctggtctcgaanncctgacctcaggtggtctgcctgccttgccctcccagggtgctgggattgcaggtgtgagccaccgtgcccagctgnntttatataagcatccagggaaaagtcagccagcacactcaggaagtcattgtcactcagggctttgtgagtcaccccagtaagccaggcctcatagaattaaagtggccnaggaaaggtgaacgnatgttgcactgggaggtagaaccccagggtctggatcctggttctgcc

SEQ ID NO: 682112 - DNA, 301 bp, Homo sapiens
  misc_feature (127)..(127): n is a, c, g, or t
gagacggatccgctctctcgcctaggctggagtgcagtggtgtgatctcgctgcaactccgcctcccgggttcacgccactctcctgcctcagcctcccgagtagctgggaccacaggcgacacacncacgtctggccaatccttcgtatcttcagtagagacggggtttcaccgtgccagccaggatggtcccgatctcctgaccttgtgatccgactgccacctacttctgcaaccctcatcccacctagtgttaagtgtttcggatatgacagggtatatatattcctgaaagtcgac

SEQ ID NO: 682113 - DNA, 319 bp, Homo sapiens
aatctaaaatatttagtagctttgaagatttctgggcttttagggccttttctattttgtttccattttattttttgccaggcattttccatggagggcagggtatccattctttaccatgggtgtacctgctataggttaacaaatcataccaaggcctcatacttccccaaggttttttcaactagttttcgcccggattccttttgatttggaagggggcggacggggggaagcacggccaggggttttaacctttggggccaaaccccaaataatttggtttccaaccctgatacccgtgttcaacacaatcctt

SEQ ID NO: 682114 - DNA, 288 bp, Homo sapiens
gtcagcctctccaagcctggattttcttacctattaaatgggagtaataatacctacttaaaaattctgatgtgagtattaaatgagttcagggatataatctgtaaagtacctggcatgtgataggaattcagtaaatgttctccctctccagagcttttagtcttgtatttaaaatgagtttctattctcaacttggcactaatgagaccatatttgggattgaaagtctgttgctttgagatcacaaagaaaatttaaaacaagcctattagaaataaattttac

SEQ ID NO: 682115 - DNA, 1185 bp, Homo sapiens
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcgtgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682116 - DNA, 986 bp, Homo sapiens
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggggtaaggatgagtttcatcatttttggattctttcttgtctgtcaagttcagaacttcctgccttttactcctatatccaaaaactttgttttccacacttcatgggtttcttttctgtctctcttttttttggaagaataagcaaaaaaagcagaagatttattgagaaatgaaagtacacctctacaggatgggagtgggcctgccattcatggttttctaatggacgaacttccattcttctcctaagctggggctgagtcttggagagccaaattttacccatccatccaaaagtgccctg

SEQ ID NO: 682117 - DNA, 164 bp, Homo sapiens
gcggccgcctactactactactactgctcgaattcaagcttctaacgatgtacggggacatgcctggggtaagccacccggctacctaattcctcagtaacctccatctaaaatctccaaggaagcaataaattccttttatgagatcaaaaaaaataatttca

SEQ ID NO: 682118 - DNA, 1131 bp, Homo sapiens
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggctgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcgtgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682119 - DNA, 313 bp, Homo sapiens
aattattaacgtaggaaacatgtatctagggggatggcaggaaaggttattgcgatatggctaaagtaagaatgaatgtagccttagaaaagtaagggcacgaaggtataggtgagttcggagggagaaagctagtggagtaggtgtatgactttggggcagttgatagacaagcacaaggaggagaggtcgtgctgtctcagatatcctagaatgctcacatgcttcaggacacacctgctcccctctctgggaagttgtaatgaccatgatgaagtttgtgaaagattcacaaacgctctattagggtaca

SEQ ID NO: 682120 - DNA, 1353 bp, Homo sapiens
  misc_feature (986)..(986): n is a, c, g, or t
  misc_feature (989)..(989): n is a, c, g, or t
  misc_feature (1001)..(1001): n is a, c, g, or t
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcgtgggcattgtggtgggcactgtcttcatcatccaaggcctgcgttcagttggtgcttccagacaccaagggccattgtgaatcccatcctggaagggaaaggtaagattgagactggttacagttgaagcggcagtatgaaaggaaggaaagtgggagggcgttgtggacatgaatgtggttgaaagttgtaggggaattgggaagtggcatgatgatgacacaggagnccnctcggacccatngatctcatgtctgccctgttgcaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682121 - DNA, 457 bp, Homo sapiens
  misc_feature (141)..(141): n is a, c, g, or t
  misc_feature (279)..(279): n is a, c, g, or t
aagatcggactctcatttattccttgtggaaaaagaaaaacacaaatcttaaaaactaatgcaagtcagggaagcctggaaagatacccagatttgataacagtgttagtaaggacaatccatggctaagggcatctcatntttctaggctttgatcgtggttgtcacgttgggtatggtacttgccgcaacgtgagtggtccacagcaaaggccaagctttcttgatatttctcgctcatcctagtacctctatttttcattgaagaatcctgcctgngaagtttaggtcaaagaggctgcttggagcaaaatacagtggtgtctcatcccaaatattctccaggcgtttcttccatccttccaggatttgaattcgggcgtctgctggagtgtgcccaatgctatatgtcagttgaggttctaagacttggaagccacagaaatgcagaatgcca

SEQ ID NO: 682122 - DNA, 1010 bp, Homo sapiens
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682123 - DNA, 865 bp, Homo sapiens
gtcagatgctcagctcacaattactctacagctcagaacaccaactgctgaggctgccttgggaagaggatgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggctgaggttcctgaggtcacagtgttttccaagtctcccgtgacactgggtcagcccaacaccctcatttgtcctggggttgtctgtgggcctcgtgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682124 - DNA, 154 bp, Homo sapiens
  misc_feature (15)..(15): n is a, c, g, or t
  misc_feature (130)..(130): n is a, c, g, or t
agacttgagatagangaaaagaaggaggagagaaaactccggatgccttatgatgtaccagagccacgcaagttttaagcagactaccatagaagaaggaccaacgcatcaagcagttcgtgcccatgtntgacatgaagtggtataaaaagat

SEQ ID NO: 682125 - DNA, 783 bp, Homo sapiens
  misc_feature (14)..(14): n is a, c, g, or t
ttttgacccgcagnggcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatctggggttgtctgtgggcctcgtgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaaagacatgcctggggtaagccacccggctacctaattcctcagtaacctccatctaaaatctccaaggaagcaataaattccttttatgagatcaaaaaaaataatttca

SEQ ID NO: 682126 - DNA, 811 bp, Homo sapiens
ggcttccgctgggaggtcctccatgcgcagtcatgagtcgcttcaagttatcgatatgggtatcaaacttgactgaccctatgtcagaggaattataggggggttcaaaagcatcgagatgacttacaggatgtaatagggagagctgtcgagatttggtgtacaaaagtttatgattacaggtggaaatctacaagacagtaaagatgcacctgatttgtggcacaaacaaatggtatgtttttccagtacagttggatgtcatcctacaagatgtggtgaatttgaaaagaataacccctgatctttacttaaaaggagtgtgctaaaatctttgtggaaaacaataaaaggggaaagtgtggttggcaattaggagaattgcgggacttgatttgtgaccggaactgcagtttttgtcccaaaagatactcaatcaaatatttgtgaaaaaacagttttgaactgtcagaacaaaacaaaattaccaatgtttcttcattgtgtcgaaactcacatgctgaaattttttgacataatgaacaagaaatagagatcggggtgtagggggaagtggtgcattcaatttgagtggtaccaagggaagcaagcaagctgtttgattgactgtggatcttgatataaggatttacttggtttggtcactggaaaaatgacgctaattttgcaagtttgacgtcatcctaattgacaatatgttgagacagattccctctggtgtggagtcaaactgtaccttggtggtcaattttttaaaaggttctacaaaagaggggaagtgggctggtaa

SEQ ID NO: 682127 - DNA, 166 bp, Homo sapiens
gatggagtctcactcttaccatgctggagtcagtggcggatctcggctcactgcaacctctgcctcccgggttcaagtgattctcctgcctcagcttcccaagatgctgggattacaggcgtgagccaccacgcccggcagagactctatttcttaaaaacagcaa

SEQ ID NO: 682128 - DNA, 821 bp, Homo sapiens
acgatcagttgagcgcccgtgagatacgtggtgggtgcgccgtcgttgtacagcccgttgggcgggatattgtgaccgggtctgtggcctggggctagggcggccgttcttggcgcctctgcagtgtgctgtgcggcgcgtcgcctattccgccggtgtcggtgccctgccctgtgggtcatctgctcatgcgcggcggtaagtgtttcccccgggggcgccgcctgaactttgttcttgggtttctggtcgcccgggggctgtatcactgcgcttcacggtggtaggtgtctggccttcgcgacggagcgtctcgtgttgttcggtgtgccccgcttctaaccgagtgtgggccggtcgtgcatgttacgccccgcttcttgcgacggccgtgtgtttcagacgtcgtggtggccgccacgagatagtgtgctgggggacatttcgttcgacaagccttggccgctgagcgttggccggctgtgccccccctccgcttgaccctcccttctggggtggaactctcttttgtttggtatatatcaccactttgcctcggattcataaaacatctgtccctcacttacgcagagctccaacaacatatgaagtgactcacgcataaacctacgcctcttataacaatgtcgcgcccaaacacacttcggggtactacacaacccgcccacaactgtacacaaacaattgaaccctccactttacacccgagagacccaccccttccttgtcaaacaacctattccccccttttcctcctttcccccaccccccaatcctttccggggtttcccccacaaaaa

SEQ ID NO: 682129 - DNA, 220 bp, Homo sapiens
gtcggaccttccatctcctcccactcgcttaacttttatattttcagtagagacggagttcacatgctggccaggatggtcccaatctcctgacctcgtgatccacccacctcggctcccaaagtgctgggattacaggcgtgagccactgtgcctggccaataaattattttttgtagagttgaggtcttgccatgttgcctaggctagtggtcttgaa

SEQ ID NO: 682130 - DNA, 569 bp, Homo sapiens
  misc_feature (98)..(98): n is a, c, g, or t
ccatgagggatgaatggatgaatagacaatggagggatggatccatgatggatagatgggtggatgaatggatacaagatggattgatggatataganccatgatggagggatggataggtgataatgaatacccaaatgatggatggatggataggtgatacatgggtaaatgggtggagggattgatagatgatggatggatagatgatggatggatagatggccaaaaaatgaatggatatatgatggatggatggatggatgagtaaatggatggatggatggtaaagtgatagatatgggtagataaatatagagataggtatcgatagaaatgagggataaaatggggcccccaggtgaatgaggtgaggggtaaccagctgttcattgaattattctaaagacttttctgtaaaattgaagttttcaaaacaaaaagtggtggaaaaaagctaattcctatttcctagttttcccatagtttatcaaacttctaaaatggaaagaccgttcagaccttagaaagcccagagcaaccccccatttaaaaattaaagttatatt

SEQ ID NO: 682131 - DNA, 1264 bp, Homo sapiens
  misc_feature (1131)..(1131): n is a, c, g, or t
ggagagagagaactagtctcggtttatgtgtttttttttattctcattaaactttttaaatggggtctcaaaattctgtgacaaattttgggccaagtggttcccataaaaaagtcctgtatttaaaaactaatataactttaaaacgtgccacacgcaaaaaaaaaacccaaaggtggctccacaaaatcatttcctccttttcctttcgtgaaggttttacaagtgcattgtgttactcatttaaccagctctttaacatacataaacttaaagtggccaatttgaaccaaacagttctcgtgaaaccggttctttccaccactgtgatttaagaatgtgggggtggcaggatataggggcataactatctcatttatacccctctcgtgaaccttcgtgggcgagaactggggtgaccttgtcacagtctccagacagccattcatggctcacaacctgctcttgggattgaacacccccacgcgacacatgtgctcgtgctcctcaaatatctcacgaaaaccgagacaaaaagcggacccccaagaggggtggaaatacgctcgtggaaaaagagcctcttacaaaacaacaacaagtgggctttggcccgagggaaaccccagtatttcaccacaaagttggcaccagattattccacgccagaaattctcagagacaaattcttgagggcgcccaattatttacaccacggcgtatatctacaaccccagaaaaagcggggcgtaattccagaatatcattttctccccgtatcagaggccttacaaggcaaaaacaactgtgccatattgaccatttgtgtacaacacccgggtgtttggacaaaactcccaatcataaagagggggcgcaatacccccgcgccgctaaatagaggggccccggggaagtgcgctccagggaaataaactccaccttagaagccagagaaaaaacccccaggaatgacatcccccaaaatgaggggagacgggccacaaatatcatcaggcgtagtcaccccagagaaacaagtgcttgtccccagcgaatgagaaaacactccctttgcagcgagagccacagtttctgtgacccctttagacggccccacaatttttgctnccccagagaaaagaaacgtcttgtacctcacaaaaagcgccaacacgtgaggagcaatattcggagaccacaaatttttagcactctccccggtatgaaacacgtttgtacttagagccacaatggtgtaccc

SEQ ID NO: 682132 - DNA, 339 bp, Homo sapiens
cggcacgagggtcctgaaggctggctgccctttgagggcaagtgttactacttctccccaagcaccaagtcatgggatgaggcccggatgttctgccaggagaattactctcacttggtcatcatcaatagctttgctgagcacgtgagttcttcccactgaacctttgagaaccttcagggacagcctgcttctcttccaggatgcacacatccctcccttccctggatggcaagaaattagaattacttttcagttactaaaactttaacagcaagctcttcctaaggtagtatcatgcagaggttaagaagacatgctttgtttttgagttcaaaa

SEQ ID NO: 682133 - DNA, 501 bp, Homo sapiens
aaggatggtttatttattccactctgtaagatttgagtgaatttttcatgaaagccaaacagatctttgttttgcagaagagtatcttgtttctgaagatgccaagaaacaaatttgatcctaagagtggtcctttacgataagtgatgtatataagatgacttttttttttttttgagacagtttctcactctgtcacctaggctggagtgcagtggtgccatcagttcgctgcagcctcgacttcccaggcccaaatgatcctcctaccttagcctcccaagtaagctcggataacaggtgtcaccaccgtgccttgttttgttttgttttgttttttgtggaaatggggtctccctttggtcttgaattcctgggctcaagcgatcttcccgccttgcctcccaaagggctgggattacaggtgtgagccattatacctggccacaatgtgacattttaaaattcttatacataattagctttttatgtgttccaaat

SEQ ID NO: 682134 - DNA, 182 bp, Homo sapiens
  misc_feature (23)..(23): n is a, c, g, or t
cccccccggcaaaaaaacaaaangaaaaaccccccaaaaaaagtttttcccccccgttttagggttttaaccttttagcccaacccaaaaaaaggttttggttaattttttatccccttcccaaaaggggggttccaaatccccatattggcccggcggggttttaaaccctttttttgtga

SEQ ID NO: 682135 - DNA, 232 bp, Homo sapiens
  misc_feature (119)..(119): n is a, c, g, or t
tccctcaatcgacggtttctcaaactgagccgagaatagggtctgatagccagccagtttaaaagcagacacacacgaatgtagtatcgttgtgctgaaatgaccatttctgggttgtntagaaatccagaaatcatcacaacgccatgtggtatgaggaaagtataaatatcctcttggaatcttcttaacctatttttgcacaaaatggataggctgcattgaacagctc

SEQ ID NO: 682136 - DNA, 216 bp, Homo sapiens
ggatgatcagtacgcacagagcgtaagagagctctgtaagagatttgaattcatcacgtgaagttaaaagtcactggccgggtgccgtgagctcacgcctgtaatcctagcattttgggaggccgaggcgggcagatcacttgaggtcaggagttccagaccaacctggccaacatggtgaaaccccatctttactacaaatgcaaaaattagctg

SEQ ID NO: 682137 - DNA, 1010 bp, Homo sapiens
gcctcgtgccgaatgtttatcatgctcatatgatgatacatataccaaacgactagccttattcaaaaccaatttaaattctgcaaattgataagcaacataaaagtaggcaaaacgtaggaatgaatggaccaggatgcaacattcaaatagactgttttcggggctacgaacatcgtctaagactcaaaacagtgtctgtcacggatcggcaaaaaagtactgtcaggtaattttggtgtcaactgtaattagctgtagccctttgcacttcggtcttcctagggcagtcattacactgatgtgactactagaccctattactgtcccacacacagactggcgtggcttcaccactaactcagacaattcacttgctatcaccagtttctggacagcctggagatccaaaactcccacacagacaacatgagagggtcaggagttcacctctcaaacgcactgtgcaactgaagcgatctgattccatggcctctcacctagccttagcgagatgacgagacctctcattccccctgtctcttacacatctagtgaccgttgaactagctgttccacaatttacccacactatgcttagtaacgggatcaccaaggtcactaactaggcacttacggagcaccacacggcacgctagaccctacaataatacaaacactttgcattactctatcaggatataaaaggacgcccgtaattctacccaaacattcaatctgtccaccagttatcatggcaggagggaaacataggacagaacaataaaccctactaccatattacacccacattggagtacaatccagaaatagataccgacgcattgaagtcaccaacaacacaaaacacggcataaacctcgaatgataaacattcgcccaacaataccgagaaataagggtataagaccccaatcacaacgcacacacagcatcatcaaagaacacatgacacatagaacatcacaataaccgaaccacacctgtct

SEQ ID NO: 682138 - DNA, 404 bp, Homo sapiens
tcgggagcatttcaggtgtcagctccttgcacaccctcagtattccttctgaaaacagtcggatgcggcgccaggatccatcctccacgcgctgtagctcctctctctgccagggactcggtttgctccaccgtccctcgaatctgcccttcaggccgttccccgcgagaacagatgaatcgagcatccggagagacccctcgagctgggactttgggactgtgggacgttctttcacagtctgcagaggaatgcagctcaagtcagtgccttcttctgagaaactccctgtgcgcccttcctagtctaactccagacccccgccctctctcctgagcttcttttgtttctgttttgggccatttccgggatccctttttccccttgtggtctaaattccagcc

SEQ ID NO: 682139 - DNA, 118 bp, Homo sapiens
tgtacagcacagaggaggacgacaccgcagggattctcgcgagaagagggggctcaccagtctctggcccagctggggccaacctcagtgttgccaggcttctggtgccagcgccttc

SEQ ID NO: 682140 - DNA, 447 bp, Homo sapiens
tgtcgtgcactgtggaacaccctggatggtcgtggctggtacatatttgcacggcatgacatgacctgtctcacatgtctatgaagcataaatgaatccactgcttcactattatgggtcaatgagatgtaagagaatcacaaatggcttagaaccaggcctggcactgctgtgcttacttgtcgtgcgtagtggggagcacagatagctcactaccagctcacagcgttcgctatgtactgcctaacgacagaaggtagttatagatatcggtgttaacaggtcgttcgctctccgtctaatttagagttctctccaaaacttgggaactaaacttctcattgtgccttttatagttttaccatctgatcccacatagctcatattatagctaaggtaaatgttggggccaagaaattgccaattggttgaggtaatccgtgaggg

SEQ ID NO: 682141 - DNA, 434 bp, Homo sapiens
ctctcttggtcagttacaataattttgtcttccctgtccccatccccaatctctgccagcctctaatccatcctcctcactgcttgccatcgtgatctttctaaaacacaaatttgatcatgttcaaaaaaaaaaaaaaaagaaaggggatgaggcccggcacagtaactcatgcctgtaatcctagcactttgagaggctgagacgggtggatcacttgaggtcagaccagcctggccaatatggtgaaactccatctctactaaaaatacaaaattagctgggcgtggtggtgcatgcctgtaatcccagccactcaggaggctgaggcaggagaatcgcttgaacccgggaggcggaggttgtagtaagctgagatcgtgccattgtactccagccttccagcctgggcaacaagagcgaaactctgtctc

SEQ ID NO: 682142 - DNA, 426 bp, Homo sapiens
cccgggctgtaggaattctgcacgagaactcttctgtaccctctaacagacagacagacagagttagatgaccacacggaatgggctgtgtcctctaagagggcctgaaactattggataaatttttggaggaaggtaaaaaggtgtaccactcaaaaaccttcactgtgaactttggggacaccgaagaaggccagaaacagatcaacgattacctggagaaaggtactcaagggatggggatttggtcaaagagcttgacagaaacacaagttttggtctggtgaaatacatattcttttaaggcgaaagggagagaacctttgaagtccaggacaccgaggaagaagactttcacatggaccaagtgaccaccgtgaaagtggctataaagcggttaagcatgtgtaacattcacctgtggct

SEQ ID NO: 682143 - DNA, 170 bp, Homo sapiens
tcttagaggatccccggcattccccgcaagacgcctttgtagtcggcatggtcacgtgctcaccattcaacagcaatgcgaggatagacggcccgggctgcggacgggccctctagaaactgtgccctgccatgctgctctccggcacatctcccgtcttgcggggtctg

SEQ ID NO: 682144 - DNA, 346 bp, Homo sapiens
tctgagttcccaagcttctcaacgatctgttcctttagttacaggaaactggataatgaagatctccaccctggtctagatcagaggaatgacctaagtgagtcttattatagtgttgtaaattatttaaatatatgcttacatttatgattgaagactattttacaagtttgtctgtttctcataaactattttataccagaattatcattgcctgccaatttgtcttccatgtctgcttctcccactaaacctagagctccttgaggatcagaactatttatctatcatatatctttgtatcaccagtgtttcacatagtacctggccacacattgagaagctt

SEQ ID NO: 682145 - DNA, 731 bp, Homo sapiens
tgacatgcttggttgacgctgtgtatgttccttgccatgtgtccctatgtgcgcagcgtgccagggcttcgaccgtgctgtgagtgcacgtgcgagttcaccagactgggtgttctgccaatgggaatgctgaacctgacctgaagtggaggggctggctgtgaccttatccacgcgtgaaacatgatggtgcttgcatgctgtgtgggagtgccctcagtgcaatgctggactggatgatgctgggccactctgccgtgtgcctgggcctgatgaccctcaccaaagctctgtgcccacgtggacggcctatatctgatttcggccggatggattgacaacctggcactgagtggggtgtcctgtgagcaagccgacatcgaatgtactgggcactgcagtggtgtgcctggtgtgcacatctacgagatgccagtgctggcgggccaatgatggctccgctcagtgtgctgcacgtagttggtcacttgtaccccctcaatgtgggcaagagcagctagtgaaacctgcgtcagtcggaacgcctgtgtccatcgtgtcccggagccagggaccaccgtgatggtgctgggagaccccaggtcgactggctggatttccttgtgctgtgctcgacacggctggttcgcgggagggccgtgggccgtggagcacgagggcgtgcgggcgccgggtgtcggcttaagccttgctgccttatctggccattt

SEQ ID NO: 682146 - DNA, 404 bp, Homo sapiens
cactaggtcccgaaacttactatgggttctagaagtcaaggcgggcccttgagccactaacaattgtggccaacacactggttggaatgcattatcgttaaagtgcaaccctattgaggggttaacgcgcacaaaacagagagtgacccaatatagcacaatatcccgaaataatgtggaaaacaaaagcgattgcaaagttatcataagagcaccgattttattaaattcctatccgtgccaacccaatctcgagaccccgagtccatccggaacccgtgcctgaggctgctccagctcgctctcttccgggcgctgccccgcccccacttacgtgggacgctgaccgctccacggtctcgcggctggcaagccccagaaacccgtcgattcaactattatta

SEQ ID NO: 682147 - DNA, 508 bp, Homo sapiens
aggtagtggcatgctttcttttcatcttcattctcagtctttcagagcacagtgttgtagctaccaagtcattggtcgctgtgttgagtggccgagtgacctgctagcttaattcacaagaagccagttttcagaggtaggtgcacttatgtttgctcaaaaaggcagcaatggtactctgagagaactttattcattgtatctggtccctatttgcccaattttatggattttctttaaaattccttccataattcttgacctttggactataacttcaaatgattatagacactggcctgtgctgtctcacctttctttttatatatgaaaatgaacagtacaaagcacagacccaggtcttaaaataaataagctcattcaaaagaaatcaagctacaattaagtgaagacatattacaaatttaagaacatcaccatcgcactagcagcacattaaggccaccagtgctcaaggatcttgggtatcccattgctttgacattga

SEQ ID NO: 682148 - DNA, 218 bp, Homo sapiens
  misc_feature (68)..(68): n is a, c, g, or t
ctcatttggcgaggcagtctcggaggcttcctccgaagaatctttgtcctttccccgaggaatcaggngagctgggcctttacagctggcatcggagccacccttgctggcatgggtccccaccaaggagtgttcaggatctgctgacagaatcagagcagggacacgatgagggacctctagcagggacagatgtagccccacaagtctgaactcat

SEQ ID NO: 682149 - DNA, 360 bp, Homo sapiens
  misc_feature (94)..(95): n is a, c, g, or t
  misc_feature (97)..(98): n is a, c, g, or t
  misc_feature (150)..(150): n is a, c, g, or t
  misc_feature (307)..(307): n is a, c, g, or t
  misc_feature (331)..(331): n is a, c, g, or t
  misc_feature (341)..(341): n is a, c, g, or t
ggtgaaaggtgaggcacggcctgcagattttccagcggatcccccggtggcctcatgtcgcgcagtggaaccgatcctcagcaacccagcaggnntnngaggcggacccgagcagcaaccttccgggcaaacgaccatcagcatatccgntacaacccgctgcaggatgagtgggtgctggtgtcagctcaccgcatgaagcgccctggcagggtcaagtggagccccagctttctgaagaacaggtgccccgccatgaccccttcttcaaaccctctggtgtccctggggccatccgaagccaaanggagaaggtaaagcctgtataagncctggaattntgtagggttgtgggccaaa

SEQ ID NO: 682150 - DNA, 541 bp, Homo sapiens
  misc_feature (1)..(1): n is a, c, g, or t
  misc_feature (216)..(216): n is a, c, g, or t
  misc_feature (243)..(243): n is a, c, g, or t
  misc_feature (447)..(447): n is a, c, g, or t
  misc_feature (455)..(455): n is a, c, g, or t
  misc_feature (522)..(522): n is a, c, g, or t
  misc_feature (531)..(531): n is a, c, g, or t
naagtggggtctgctggtgaagacaacccagctggccaaatgaatcctggttggaagccttcttcagacggggctgtggtggcaccagctcccaagtctgaagaaaaagatgctgctgagatccaaaagcgcaaaaggctagagcaagctggaatcaaggtcatgccagcagcacagcgctttgccaggtcagctctgggctgagggctggcccgnctggctttctgcatgcctggggatttngaatctgtctagagagttggagttttcatctgatttttccacttcccgcttttcctattgcatcactgttccctgctctgagcacgtagatgatagtcttttgccttaaaggcatgttctctgcttaagtacctcctggggtatttttaaatgaaaggtgaagagtggagctcctcactgctggggtgcagcccttgtctttgntcatgtantttgtgattcagtcatgtgtggggctgcaggatttacctaggcaataacattgtatttttctattgntttgttggntgtttaattt

SEQ ID NO: 682151 - DNA, 195 bp, Homo sapiens
atatgatttgtaagtcatcatgcagctttggttctgatctctgctataactggctccagggttgactgattaactctaggtatatatcggtagataatggctgatagatcaaacttatgctgagccttgtttgctggatgaacagcaatgaactaccctggtatacttccactacaaacactgaggaattggagg

SEQ ID NO: 682152 - DNA, 351 bp, Homo sapiens
gtggacaaatgaccccaagacagaagagcatcaagtcatacataggccgtctcgttggccgggtggaagggacgaattggagccccaggcctggacagctcttctctggctggaacaccctcagatgagacactggccactgaccctcttgggctagccaagctgacaggcccaggagacaaggaccgaaggaacaagaggaagcatagaactcggggagggaggctgtctgacagggactacctaggggctgcctgggacggggccaccgtggtgtactggctggagctgtgggtgggcatgcctgcctggtatgtggccgcctggcggggcaatgtcaagagctgtgcc

SEQ ID NO: 682153 - DNA, 120 bp, Homo sapiens
ttcataaaacagcaacaatgacaccaatataagcttaccaccattaatcatttaccattatattccacacacatccatattgcagcgtttcacatttcatgcaacagcaaatatactgtc

SEQ ID NO: 682154 - DNA, 744 bp, Homo sapiens
  misc_feature (1)..(1): n is a, c, g, or t
  misc_feature (14)..(14): n is a, c, g, or t
  misc_feature (18)..(19): n is a, c, g, or t
nactgatagcttgnaccnncatgaccacgtggacacccagcttggcacgagggctacagctcagatcattgatgccgccttagctgctaagcacacctgatatcgggagaatggattcatcatgactgagaaagactatctgaatctgagtccacgaatataataaagagtacatcactaaggctccttatgctaccaactgcaaagacctatccgatcacaaatacaacgattgctcacacgatgaaagcacccccaaagattcgaatgagacagattgcggccgggaccaaaccctaaacaggctcaacgctttcaatcgcagcaacattaccacgtcacatgacatcatgaataccaggtcatgcttcagcatcatctctgactcactcagcggctacacctatcactcagcttgcagactgtcagaacagtttcaaaattcccaccgctacagctttaccgtatcttctggttctccaagtggttttctgcgcacacacgacagcacgtacgccctcaccctccaaatccgaacctgctaatacacatgaaagcggagcaaaacgcggatcacatctgcctagcccaagacaatgcacattgggagactacactcgaaagtgacgaaggatcacctgatggtccaagatttctgacatatgggaaaagtaaaatgatttactttgctccagtaaaggttgcattcccatctcttccaaaggctatgcgaacgtccaatta

SEQ ID NO: 682155 - DNA, 644 bp, Homo sapiens
ttaaaggctaggtacgaggaccgcgtgtagatggagtgcagcagcaggtgtgtgtggtcggccagcctgtgggaccagaaggagacttgaggatggggtcacgaatgctccactgcatggaggatgggtgagctcaggtctgcctgttcttggtgtgaacgactcacaagaagacttgcctagagaaattcaagggaccaaccataccacaagagaatacaaatggcacagagcagtaggcatcatggcatgaggtaccggaactgtgcaaggattacacaagcattaaaaatgcagaatggattgcaagaaaaatgccatatattttctgagtagtcagaggaaagtgtgtacgtaaaggtgtcacgagaagcatagtgaaactgaactgaaatgttaagagtaacaacacaggaaagatcagcagcagcagagatgggagacatacaggagaaaggccggagaactctgagccagcaccagcacggttccagggaattccagtgagggaaggcgaggccaggttggtaagtacaaagaggaaacccagatagtcataacaagaaaatgggcatctacccacctgtgtttcaaacaagacatcaacactttaattgaggaggatcttgtaagctgaacccttc

SEQ ID NO: 682156 - DNA, 146 bp, Homo sapiens
aaaaaagaagatggagtctcgctctctatgcccaggatggagtgcacatggccacgttctccagctcactgacaacctccgacctctatgggtacaagacaattctagcagcctcagcactacccgagtacctacggattcaccag

SEQ ID NO: 682157 - DNA, 351 bp, Homo sapiens
cccgcggtctatgagaggaaccgggacagacaccgagatcgggagcgggatcgagagcgggatctagacaaagacagagagcgggacagggatcgtgctcgggatcgagatggagaccgtaaacgggacatggatcgggagcgggatcgagaccgagaccgagagggcgctttccgcaggtcggagtcattccctgaacggggagccgataggaaagggaatactctgtatgtatatggagaagacatgacacccacccttctacgtggggccttctttcctttcggaaacatcattgacctctccatggacccacccagaaactgtgccttcgacacctatgaaaagatg

SEQ ID NO: 682158 - DNA, 103 bp, Homo sapiens
actgtcgtgaccttggtgaacacacccctgtgctgttaccctcaacttaagtctgccattgccagcaccatcccaccatttctgcccagcttggacgtcaata

SEQ ID NO: 682159 - DNA, 550 bp, Homo sapiens
  misc_feature (539)..(539): n is a, c, g, or t
  misc_feature (541)..(541): n is a, c, g, or t
atatatatcagtcaggaaattttacatcagttggtagcatctgcttggcatgttagtgttgggaagcattgtgaggctctaccctggctaagtaagagtgtgcagttaattagtgatacccactaccagcactataaatgagcgttgaactgctgatttgtttttattagtcttggatcacttcccaaggtatcttttcctcatcttgtcttgtctataaatatacgtacttatctgtatttatatttaaaaattcttttggcttggtgcagtggcttaagcctataatcctaccactttaagagccaaagcaggaggatcacttgaggccaagagttcaagactagcctgggcaacatagcaagaccctgtttctacaaaaaaataaaatcagccaggcatggctaattttggtgtgtggctgtagtctcagctacctggaaaactgaggcaggaggatcacttgtgccccaggagttgaaggggctgtagtgagctatgattatgcgattgcacaccagcctaggtaacagaggaanancctgtctct

SEQ ID NO: 682160 - DNA, 390 bp, Homo sapiens
  misc_feature (151)..(151): n is a, c, g, or t
ataagaaagctcttctgctgctctgtggagaagatgactaacgtgtcacggggaagagctcccttctgtgtgcctgcccacccccctgccttccttcagcacccttaagtgcatttgtaagccaggggttaacacattgccttatttatantaggatggtcatggcccacacaaacccgtcataaaaaaaaaaagtgggggttctttttgatttctagtggagatctctttggccgctgtaggactaaaggggacttaatggtactaagtttaaaggccggcccttttccctttaaataaattttttaaaaggggaaaggggttttagccctttttaaaaaccccctttatattacatttggaaccctgaaacttttatcagaaggttag

SEQ ID NO: 682161 - DNA, 831 bp, Homo sapiens
aaagggcgaaaagcgatcttcggagaaaaatccggtgttcgacagaagatccaaagcctttgtctgtaaaccaggcggagggcccccgagcggtctcggaaaagtattaagaaagagtcgtatgaaggtgaatttgtttagaggcgggggacccccgacaatcatgatggtacagcggtgtggagataaggtcaataaaacgcgcgtggttttgccccacagaggggtgaggattcacagataccgctgtcttaaggtcctgctcttaaaggaggatttctcacacagctatcggtcagaaatctgagagggaacaatgagtgattaaatacattctgggagacaaaataagccccgtagcacccggcgcacgttgtcgacccacacagctagataaagagaatgataaaaatatggcgcgcggcagggcgtgggtcacacacatcccagtgtatataccaccaccacccactgtgggtgagagacgcgagcggcgcgcgcactgatcccacgccgagcggatccaagcgagcgttctgacaggagaccccacccgcgggtgccaaacacatcatggtcgggaagccccccggcttctttatacttcaagaaataagcacacaaatttcaaccgcgcggcgtgtgtgggcggagacacactagtgagtagtccacagtaagctccgcggaggagcctgaggaaaaagggaaacatgtcatgaagccactcggggaatgaggatcgttgccacggaggccggggagatcaccaccccccgcaaccccccgccgcggggccaaccgaagccaaggaacccccgtctaaaaaaa

SEQ ID NO: 682162 - DNA, 244 bp, Homo sapiens
ctgatgagcagctagggactacatccatacaccacaaatgtgccgtgtaatttttgtatttatagcgaagctgagattggccttgttggccaggctgctctcaaactcctgacctcaggtgtatgatattctcacttcagcctcccaacgtgctgggattacaggagtgagccaccgcactcgatccaaattatacttaggtctccattcatgatcagcttgagttgagaaaggccttttcttt

SEQ ID NO: 682163 - DNA, 223 bp, Homo sapiens
atgatgggaaaagcgtataaatcttttgtgacattaacagtggttcagaagagccgatatggctttcacacatccaggtcctgttggtggggaaagacatgtgttcgaccctcgcgagtaaggtgagagccccggtccatgaagtgttgggccaaggctgcagccattcgttgtcttcactaacggagtaaaaatcttgcgttaaaaccattatctttaagca

SEQ ID NO: 682164 - DNA, 711 bp, Homo sapiens
ttgataagttttcagtaagcataacctattccatcagatgatgactgtgtttgcacaatagtgttcaagtgatcacgcaaatttgtacacagggaatgtataataaggatcacctgatcagagctattccactgtatcttatagaggaagaggtcggaaacacaagcaagtgatccttagttatgttccttaagcctgatgataactatggtttactctaataagatagcatatcattgataattatatttttgttacgtgtgcccttgcacatgtttggtctgttttggttatatcttcttatggaataacacataagttagtaaccactctactgtttcaagttaatctagtaagtagagctctacatgagtattatgtataactagctatacccactgtaactgaatttattcttacaacacgtgctagaattcttgaaaagttatacgtagtaacaatatccaaacgaagcagtatctgctagaacagtgtgccaaaaagcagtatttctttcccttggttgtagagagtaactaattatataaatagtgtacctcaagaactacatacactggtatcacacagtctttctacaatgtttctgtattctgaaagctcaatattaagtatctatgtttccattcagatattcatattagaatttcctttagaagatggcagtgattataatattaatagagggcatta

SEQ ID NO: 682165 - DNA, 296 bp, Homo sapiens
ttatttgtccagccccttgggtcccgattcggcttgccggccaagctgtcgactttggtggtgaagaggctagcacttgtgggaccactgaagcgaaagtgcggtacctgtagttgcacagactgtaactgcttatggacacggaaatcggaaatgacctaatgcaaatgctcttgcctaaggatccccaaaatttttttctaaactttgggaattaaaaaaggcttccttagggggcaaactttttcccccggggccaaaataaccgggtaaaaagggggcccaaaaaagaaaag

SEQ ID NO: 682166 - DNA, 814 bp, Homo sapiens
ccgccgccgccgccatcatgagtggaaatcgtgcgcttgcagtgcctgggcagtgcaggcaaccaaatctggcgccaagttttggtgatggtgatcagctgatgagcactggcatctgaccccacgtggcacctaccacggggacagctgacctgcagctggaacagcatcaactgtgtactacaatgagtgccacctgtgctgtgcaatgtactgtgcccctgctgcctgtgcatctgtggactcttggagccctggcaccagtgagactcctgtgctgctctgtttgggtgcccattactgaggcatgaatctatcctgtgcctggacaacattctgtattatcatgtgtcatgagtgtgtgctgagtgaacaacgtggtggcacaacgtggggcactaacacaagaagtgctgctggtgagctgtgttgggactcgtgttgcttggatgtttgtgaagaaacgtgagtgcttgagagcttgtgactggatctgcatgtgtgtttccaagcatgaccccacatccctgggtggggtgtgactgggtctaggggatggtgtaccctcctcatcagcaagatccgggaggaggtacccagacatggatcatgatacacgataatagtgtggtgccttcgaccaaattgtgtcagacaacagtggtgggagccctacgactgccaccctctcatgccagcagctcgtaaaaacacacgacgagactactgcatgatacgaagctctctacacgatgctcaaacctaagtgcagccactatgtgctgacactgtgttgacggtggccagtgcggta

SEQ ID NO: 682167 - DNA, 895 bp, Homo sapiens
  misc_feature (423)..(423): n is a, c, g, or t
  misc_feature (819)..(819): n is a, c, g, or t
aacaggcgcatgccactgaagccctgctagttttggtattttggtagagacaatgtttcaccatgttgaccaggatggtctcaagtctcctgaccctgcgatctgcccacctcagcctcccaaagtgctgggattacaggtcgtaagccaccgcgggcctggcctggttctccatgattctgtaagtatgtgtatagccattggattttcatagattcagcctattgtagaatacatatcccttctgaataagttctgtaggacagaatctagcaacatcttacagctcaataattcactagattcaagcaggacatgagatgctagcctatgttgtggcttctaagtctgaatgactgaattatttgctcacttgctcaattaccttggcgtgttagttactcttatgaagagatcctcgcnaacggcttctgtagatgtggtaatgcgactagtccactgatcgacaggaagtgcaaggctatctggtaccgatgatcgctcaagatttatgaggaggaccgaaagcctaatgactagatgaggctttaaacttacaatttcttctcgaagtggacaaacttccggaagtttgaagccacacgggagccaggaagcatgctgcttttggccgaagtttttaagaacgtcccagggtctcttgcttaaggccagtaacttgctatttacccttccatgctgtctacgaccctgcatccctcgtaatttgggtctccaggtgggaaacagagcagagtatggacgatgtaagccccttattgggggttttttaaccttaagggacggctaagttgcaantttaaacttgcctcggaagatcttgcagttcctgcgaaaaggtggttccggcaatcctggggccctcctgggccat

SEQ ID NO: 682168 - DNA, 105 bp, Homo sapiens
acacggaaggcagatacggtgattgtgtgttccatccctcctgtagcatagggacacggctcatcctcccacgtcagattctaaatcagagagagagaaacatgt

SEQ ID NO: 682169 - DNA, 1273 bp, Homo sapiens
  misc_feature (643)..(643): n is a, c, g, or t
gacaacataaagggggcccacataggggctcgtatattgggcgaaatcttctgggtggccacaataaaccgatggcagcttgtgcggaaggggttcttcttctctcggggcttttaatgggaagttgtatagggcgacccactatggggggcacaagatccacaagagatcatggtcgtgtgttatgctctctccatgatggggtcttggtttattgagtataagaccgccgccttatggggtgttgttgcgacgtgctacccttgtcggcgcggaaggttggctgttgaggccccccttggtgtgaaaaagcctccgcttgggaaccattgtgttgtcactaaagaagcggggcttgcggtgttattggcaaagaaggaccccagtggcaccagtgtaaaatggggcccactcctctggcttaatttggggggtcccactacgtaaactaaaaggccttgtccacccacgagatgttgttcctatgcgaattaaattgtgggggaacggggactattttgggagagttccccaatttcacagggaagacatttcgttgggtgtgaatacaacgccctcccccaaagagttagtttaccctcgatttatgaccataggcatcactctggccatttgagatggnagcacatccaggaccgggtgcaaatatgtcgctaacagcacgttgtagacacactaggtattaagttatgcccgacatggactctcgtatgacgaggcttgagttacaatgtgtaggaaagaggatcaccctttatcacttccgcgaaaaattgggggtattaaagggtgccccatacgcgcacaaggtgcactgttatgagaagatattatatgagtctaaacacacgggtcactcttctcggaggcacaggcactgggagatatacccctctaccgagcgacagacaacacctggccacacctggatagcacaggaggtaataggtggaggatactcacgatggatgtgttatgcctacaacaaagagggtgggtgtggactgaagctggctcaaagccccgacaaggtaggttgccgaagacagcacaaaagcggagaaacggaagcgagagacctgagcgagtgaaaagtgagacgagagctctctcccacgacagagctcctcacaggggactccaaagaacggattatagaagaagagttacgaaggatcaagaaggcccaaactaggatttggagtatcggggtctcgaatacctggagatgggggcagtgattctcctccca

SEQ ID NO: 682170 - DNA, 128 bp, Homo sapiens
acacgctcacacataacttactactcctttgctacctgtgccagccatctgctccatttcacagagtgtacaaactaaggcaaagtgagagcaaccacagatcataaagggagaaatgtggcagatgg

SEQ ID NO: 682171 - DNA, 109 bp, Homo sapiens
accgtcctagccgcgcagtgcatctgaactattcgcaaaaaggcgtgattgacgtcttcctgcatgcttggaaaggatacgcaagtttgcatggggcatgacgagctga

SEQ ID NO: 682172 - DNA, 1387 bp, Homo sapiens
  misc_feature (90)..(90): n is a, c, g, or t
  misc_feature (247)..(247): n is a, c, g, or t
  misc_feature (464)..(464): n is a, c, g, or t
  misc_feature (509)..(509): n is a, c, g, or t
  misc_feature (638)..(638): n is a, c, g, or t
  misc_feature (674)..(674): n is a, c, g, or t
  misc_feature (696)..(696): n is a, c, g, or t
  misc_feature (758)..(758): n is a, c, g, or t
  misc_feature (765)..(765): n is a, c, g, or t
  misc_feature (855)..(855): n is a, c, g, or t
  misc_feature (898)..(898): n is a, c, g, or t
  misc_feature (903)..(903): n is a, c, g, or t
  misc_feature (928)..(928): n is a, c, g, or t
  misc_feature (937)..(937): n is a, c, g, or t
  misc_feature (957)..(957): n is a, c, g, or t
  misc_feature (1017)..(1017): n is a, c, g, or t
  misc_feature (1038)..(1038): n is a, c, g, or t
  misc_feature (1047)..(1047): n is a, c, g, or t
  misc_feature (1085)..(1085): n is a, c, g, or t
  misc_feature (1092)..(1092): n is a, c, g, or t
  misc_feature (1094)..(1094): n is a, c, g, or t
  misc_feature (1171)..(1171): n is a, c, g, or t
  misc_feature (1205)..(1205): n is a, c, g, or t
  misc_feature (1235)..(1235): n is a, c, g, or t
  misc_feature (1245)..(1245): n is a, c, g, or t
  misc_feature (1269)..(1269): n is a, c, g, or t
  misc_feature (1296)..(1296): n is a, c, g, or t
  misc_feature (1298)..(1298): n is a, c, g, or t
  misc_feature (1340)..(1340): n is a, c, g, or t
  misc_feature (1350)..(1350): n is a, c, g, or t
cctcctcttgctcccaccctcctcactaaattcggctgatttcggtggacactgcgatgtggccagcatttgtttatttcttggtcactntcacccggtatggggcatattttgaacctacccgtatcatgcgggactcgacaatatttgataaaaatcgctcgtccccgttacctttctctacttctatccatcatctcctctgcttctctacgctcaactctctgatgactccgtcgcacttctngtcgcactttacgacgtactcgtccaccaccagcctcacaccattataacacatgtaataatttatcttcttacatcaccgataactatactctatccatctctttctcttgctatgcaatactggtgccgctacaagcgactcgcacgcgcaatatcattatatctcatacatacatggacgtcataatgttcgtcatcatcacccgactactgtntgtctcgcgttcgcgtgccatcctcgcaggacacgcgtgcgttanactaatcatgctcaacatttgaccgatacgggacatacactctctaactcatcacgaaccacaatgcttagcctactaactatcgctatctcatgctggtactggtctgacgactctccgcaacacccngaatgctatgcttgctcaacctcgctctacatctancgtgattcacgtccggcatgantacatcacgtctacacgcgtgtcctctacttctcgacgcatggtaaattcatagtgtacatntgacgtnttctatcgctgacatatatctgtgttgtatcccgtgcgtttcgtacgtacataaccgacgatgatgtcttatcatgtctcgcaggacacngtgtcgtcaagacgtgcgcgtacatgcttgtgatcactgtacngatgnacatgtaccgtgtgctctactctangacatctgnctatactatatctggactgntctcattacagctagtcgtgcgtacacattagctcgcacgtctcgctatcgttcagtcgnatctcgttactcacgtacacnttccgtctnacgagtatgtgacgatgcgatcggctgtgacaggctangtcgtancntactgtgcgtatactctgctaagtctaactgtcatcacgaactacggctgtattctctgctgtcactactgcgtganctactcgatcggatacttcactagacacgcctantgcgcgcacatctgcgctctgggactcgangctgagcagngcgtcggacaacaactgtcatgtnattgcgtatgtcgcatctacactcgcngncactcttagcacgtacgacgtcgagactatactgtcgtctgngtagcgcacnggtacaatccgcactgggcactcgcgtggtcatacga

SEQ ID NO: 682173 - DNA, 196 bp, Homo sapiens
cctgtatttgtccttaaaatgcttgtttaaaacaatcttactatatatctagaattgtaagaatctcatctactaaagtagttcacccactaagaagggtacttattgatatccttcagcccacaggagacccttgagttaatttttctaagcacctggcttctttaagtggtatgagtctattgtgacaataagg

SEQ ID NO: 682174 - DNA, 176 bp, Homo sapiens
cagcattctcaaatgttgggagattccacataggcttaagctcaatttattactttcatatgcattatacattcatcccccaatgctcgcttacccatgctcatggatttaaattgctatacttatgccaatgattttcactttgtatctcttgaccagaatacttccctgagctc

SEQ ID NO: 682175 - DNA, 256 bp, Homo sapiens
tgaatggagaactaccagagcagagagtgttggttttctggatgtggtacaactttgatcataagtatcttaattgagggaaaacgaaaaaggataatgtggacttagataattacaggtttaattgggaacaaggtgtttggacttatttctcttcccgtggagcagaattataaaacccaccttttcatcttcccttttccccattcagttgcgtgtggaaaagggaaacccaacacagaacagattccctctt

SEQ ID NO: 682176 - DNA, 367 bp, Homo sapiens
taggctgaggaagacgggtaggctgaggaagagaatcgcttgagcccacacggtggaggtgcactgagccacgatggcgccactgcactccagcctgggcaacaaccacaactgaaaaaaaaaatctactgaggccagagtgggttgtcgcgccgagcatgcttagggggtcaggcttagccctagcatctcagaatcacactttcttgtacggtcctcactttatccacctgacccgcgcactggtctgacggtctgaagactgttgatctgaaggtcctaggcaaagacagtcacttgagacgccgatatattgaacatcacggaccgggcccctttcccaggcgactcatttcctagcactctc

SEQ ID NO: 682177 - DNA, 539 bp, Homo sapiens
caagagccagtacagatggatgaagccactgatggagagctggctgcacattcgtaacgtgggagccctgtctccaaggcccgattccatcccaagcccagactctggagtctcaccctaagaattcctctcatagttcttactcttacccggagaccgcatgcttacagtactgagctcttctttgttctcttgctgaggctcgttattttaaatgcaagtcacacctattctgcaactgcaggtcagaaatggttccacagtggagtgccaggaagcagggaagctgcaggagccagttctactggggtgggtgaatggaggtgatggcagacacttttactgaatgtcggcttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagca

SEQ ID NO: 682178 - DNA, 1026 bp, Homo sapiens
  misc_feature (212)..(212): n is a, c, g, or t
tggaaaaagtctgggaggccagggggtgggtttgaaaccagtcttgggggggtttcgattccttcctttattgggtctaaaatttaatggtatacgggttcttcgaatggtgtgggtagggtgggggggcatccatatagtcactccaggttatatggaggtgttctatctactattaggactttctcgctctcagaagcgaaggcttctcnaaaatcatgagaaatatttattaataataactggcgtggtataagaaaaatggaatggacgcctacagatggataaggatggttcccatggtgggtggtatggcatacgggggtaagtccagagtaacggtcggggctattccgggagataaaggccggaagacaagtggttagcgggggcagaaagacaatgtacaagaattcaccgcgccgagatgagaattcatgcagataaggggagacaatggcgactaacgagcgcgagaaagagataacgggcgaaaaagagggtgtgaaacgcccagagggaaccaaataagagggggaaacaaaacacgaggggaacaaaagcgacacgacacaacacatacaaaagaaaggggggcacacaagggacacgagcggcaccaagaaaaaagggaaacaagggaacacacaaaaagagagagaaacaaaaagggagagacaaaaccacagaaatgccaaacacacacaggaaattgaaacgcggaggactaaaccaacagcgcacaattgatacctaaacgcagcacgaggcaagaacaacggcaagctaacaacaaacaaacagccgacccacaagacatcaaggcggcccgacaggccggcaagcagggaaagaaaaaaaaagagagaaagaaagcaggaaagcgcagaagaagcggaggcgacaaggagaacgaccggacggcggagagagggaacctcacgagtaaacagacatcatgtgtgaggaataacggggagaggacaaaaaaggctatacggaagacagagaactaggagcggacac

SEQ ID NO: 682179 - DNA, 315 bp, Homo sapiens
  misc_feature (101)..(101): n is a, c, g, or t
  misc_feature (106)..(106): n is a, c, g, or t
  misc_feature (109)..(110): n is a, c, g, or t
  misc_feature (119)..(119): n is a, c, g, or t
  misc_feature (129)..(129): n is a, c, g, or t
  misc_feature (138)..(138): n is a, c, g, or t
cgtctcctctgtggtcccatcgcaaccagagcccctcaccctttcgaagtccccgccccctccgctggggcttactccagggctggcttttgaataccatnacagnagnncgagcgcanagcattggcnggaggggcnaggtggaacagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagca

SEQ ID NO: 682180 - DNA, 123 bp, Homo sapiens
gtgttgaggcttaaaaaatcccctttcatggtcatattctctacttcctctttccccaactatgtgagccgccattgtaatttccggatccctaaatgaaggctccatggggtttcttgtcca

SEQ ID NO: 682181 - DNA, 355 bp, Homo sapiens
ccccaaaaaaaaaaatttgggggcccttttttttttttgggggggttttatagttcccccccgggggtttaaaaatttcccccggtttacccccaaaaagggccccccccttttaaaaaaaatttttttttttgggttttgggcaaaagggggggaatttttttgtaaaaaaaaaatggggaccccccccctttttttgccccccatttccccggggaaaggggttcctttttttttttttaaaaccccccgggggggggtcccccccgggggtttccttatgggtggggccccaaagggaacccccttgggggggttttaaagccccccccccccccccgtttgggggggggga

SEQ ID NO: 682182 - DNA, 179 bp, Homo sapiens
catacgtggttggagagctcatctggaattttgccgatttcatgactaaccagtgtaagtggcagcttagcgcatgggataatgtacccgtcctcattttgtcaggttgccttgcccattctggacacttctgtggtctgtaagcaattattgaatcacaaaggcggataactctggtt

SEQ ID NO: 682183 - DNA, 115 bp, Homo sapiens
gtcataacccttcatcaaaccctcatcaaaccctgtgaacctgcggaaagcaatataagaaggccccccaaataaccgcgtttggctgtagtggtcgggtttagggtttcgatga

SEQ ID NO: 682184 - DNA, 209 bp, Homo sapiens
gaactactaggagaagatgttggggatctcgggacattgagtccaaatcggcatttatgattcatcttcaggctggtgtcacctgagaaaaaagtctgaggagctgtgagtcccatttaccgtgtcttgggtatgtaaggagtacaagtttatgaattaaaggatcttgagtcagctttaaaggaggtcaaatttccgtgcttatgaga

SEQ ID NO: 682185 - DNA, 371 bp, Homo sapiens
  misc_feature (24)..(24): n is a, c, g, or t
cgaccccagaacgcccacttcgcncaatccaggacaccctaacacacctgaaaaggtagacctggatttaaaagcatatctcatgatgatggtagaggacataaagaaggaattcaataactcacttaaagaaatacaggagaacactgctaaagagttacaagtccttaaagaaaaacaggaaaacactgctaaagagttacaagtccttaaagaaaaacaggaaggcacaaccaaacaggtagaagtccttatagaaaaacaggaaaacacaaccgaacatttgaaggaattgaacaaaaccatgcaagatctaaaaagaaatagaaacaaaaaagaagtcggtcgacgcggccgcgaatttagtagta

SEQ ID NO: 682186 - DNA, 850 bp, Homo sapiens
gtatgttagagatccttcgacaccccggtcatgtacgtggccttccaggtggtgctggccctctacgcctcagggcgcatcactggccatcgtcatggactctggagtacggggctctaaccagcatcggtgcccatctacgagggctacgccctcccccacgccaatccatgcgctctggaccctggctggtcgtggaacttgaccgactaaacttcatgaagagtcctctatctgatgcgaggatagagtcttcatacatacaaggccgagctgggaaattcgtgcgcgacatgtcaacggagaagctgtgctaccgttcgtcctctggtactatcgacgcagtgatgaatggtacaccggtcgacattcctccttcttgcattctagggagtagaggagctacgaagtctgcaccgaatggccagagtcatcaccatgggacaactgaagcggtatccggatgtcccgtgatggacaggctgttccaaggcctattccatttccctgggtgatataggaattcctcttgacgtgccaagtcgcagcgacggatctcaacccttcaaacatcccaattcatcgacacgtcgttcgaacggtggggaaaccatttctcggaatataaaagtaccctggtaactgccactaggaccaccgtgtggctcgttcgagtgactgggtatctcaatcctaattgattaattctcaggggacaatgtgccagaacgagaggatcgccacgtataggaagaattcacccggcacgcgggacgtccccgaagacatacattgacaagatccaagaattcatccgcatccccgcagaggcgcccacgttactcgctgt

SEQ ID NO: 682187 - DNA, 143 bp, Homo sapiens
gagtgcatctgtgcctcagtgatctgctgcctgggcctcccgaagtgctggcattatagtctctctccttatgtgtgtgtgtgtgtgtgtatttaagagtcagggggtctcactgtggtgcccaagcaggtattgaaccccta

SEQ ID NO: 682188 - DNA, 141 bp, Homo sapiens
gtccaccggcacgatataacccaccagctgctggccgctcggccctggctgggcgatcaccgccacttccagtaccgggtcctgctccagcagacgcgcttcgatctcgaacagctcgatacggaagccccgcaccttcac

SEQ ID NO: 682189 - DNA, 185 bp, Homo sapiens
agagatttaaatacatggcagaacttgcaagaaagaaagtgaaatctttaggtgaaagaaatgaagaatgaattgaacacaggacaatgaggacatcagttgacctgcacaaggattaaggaggaatatgtatagtgtgattagaccagtaaagagatgctaaaggactcctaatggatgctgga

SEQ ID NO: 682190 - DNA, 144 bp, Homo sapiens
tgcagtcctaacgggtcgagtcccgtatagagaaaggatactaggactttccctaaagcatcagctgttaagggttagacacagaccagatctacaataaattaaataatacatttgacatgtttgctccctgtaggtactgca

SEQ ID NO: 682191 - DNA, 272 bp, Homo sapiens
tgtggtgatctagcaggagcttatttgcggctgcttttcccaatgaaagtagtatggaaaaaattagaaataattcatctgtgttgtatggacaaatggatcaggggattaggtttgcttaactggagttcaacctcgaaagattctcaaccaagaattctccagtatgaggtacacattctgtatcatgttgaaactctggcatgtgtaagcatgttcacagcacactctcacaaggacatgtggcccttaacgccacaaaagtgaggcca

SEQ ID NO: 682192 - DNA, 156 bp, Homo sapiens
gcctaatagtagacactccatgtgcccttagaaagaaatcggtctggtccccagcttcagtgcctccaaggcagatactcgagagacgttgttgaactgtcagcctttacatttatgcattactattgaaggcctggaataaatggatcgtgtttt

SEQ ID NO: 682193 - DNA, 784 bp, Homo sapiens
  misc_feature (115)..(115): n is a, c, g, or t
  misc_feature (168)..(168): n is a, c, g, or t
  misc_feature (189)..(189): n is a, c, g, or t
  misc_feature (198)..(198): n is a, c, g, or t
  misc_feature (213)..(213): n is a, c, g, or t
  misc_feature (216)..(216): n is a, c, g, or t
  misc_feature (222)..(222): n is a, c, g, or t
  misc_feature (240)..(240): n is a, c, g, or t
  misc_feature (252)..(252): n is a, c, g, or t
  misc_feature (255)..(255): n is a, c, g, or t
  misc_feature (268)..(268): n is a, c, g, or t
  misc_feature (288)..(289): n is a, c, g, or t
  misc_feature (443)..(443): n is a, c, g, or t
  misc_feature (450)..(450): n is a, c, g, or t
  misc_feature (469)..(469): n is a, c, g, or t
  misc_feature (473)..(473): n is a, c, g, or t
  misc_feature (483)..(483): n is a, c, g, or t
  misc_feature (486)..(488): n is a, c, g, or t
  misc_feature (490)..(490): n is a, c, g, or t
  misc_feature (495)..(495): n is a, c, g, or t
agcgggctcctcccctttactcctggctgcggggcgagccgggcgtctgctgcagcggccgcggtggctgaggaggcccgagaggagtcggtggcagcggcggcgggggaccggnagcagcagcagcagcagcagcagcaaccactagcctcctgccccgcgggctgncgaacgagccccacgagccgntcaccccgncgttctcagcgctgnccngacccngatggcgcgccctcccgnccgccagtcccnggnagcgccctcagtngtcctccgactcgccctcgnncttccgcgccagccgcagccacagccggaaggccacccggagcacaggcacagcacagcccccaggcatagcctttcggcacagccccgggttccggctcctgcggcagttcctctgggcaaccgggtcccttgcgccgaaattcctggaggtngggatgntcttgtccaaaaatcaaantcgnttgcccaacntgnnncngccgncgccctgcaacgacctgcagagcccaccacagcatgggctgcccgggcacaggaggacagggacgccccatgggaagtcagacaggtaacaaaggtgtggccgcttccatgtggcaagagcaggcttcgagctccggtctaactcagacgcatcctgggtcatcccgaaaactctgccgggtgggccatcaaaacacgtggagcagggaccgcgatttccgaccgggggagacagtgctaatgagcactcagcgtgcccactggaagtggttctgctgcccgacaggtg

SEQ ID NO: 682194 - DNA, 215 bp, Homo sapiens
agggaaggacgcctggagagagggatcacatgggactcatcatgtacccattattacaccaggcatgaattattcatgggtgcttgtgacctgtggtaggatgaatcactggacagatgcttggatggacggatggatggaaggatgattgatagatggtcaaacaggtgagcaaatgaatccctggttggacaactgtttggatgggtagacag

SEQ ID NO: 682195 - DNA, 935 bp, Homo sapiens
agcggacttcctgtgctcttgcggacacgcgcgcgtcgggttataacgcgtgtctgggccgcacgtaagcccggcctacgggcagtctttgactcgatgagccggcctataggcgcatggaagtgttcccatgagaaacgggaggctgccagacgggggcgcttggccgccgtgcttaaagcacagctcgacgttgccgtacctgaaatgctacctcaggatccgggagctaccgacttcgaaccgcaggtgttgaataaccgcgtcactgcatggaggcctgcaggcaccaaccggtgttccaggcaaacacagtgtcgggcgcgctgatacagcacgtcaatgccatgatcgagaacgaaactggaaccacttgatcacaggactgaagaccagcacgcggaccatgacccagagccgctctgccacttaccatactgcaccatttttcctgggatatacagtccagatgctcatcagttcaggcatccgtgagaccattcgctaccttgttgcagcacaacatggtggacggtcttgggtgatcacagctgagcggacgtggacggaagacctcatcaagtgcctggcgcgcataatacttgggcgagatttagcctcagggggaaggagctccgggagcaacgggatcaatagtgatcggaaatctggtggttgcccaatgacgaattacgtgcaagttgtgaggactggctgatgcgcaattctggagccagatggctgatggcagcaggaacaccagagggtggtaagccgtgacgccctctaagatgaatcgcccggctgggccagcggatcagaaacccgaaatccgcgtattactgggccccaaaaaaacacatacctgtgtttgagtccgcgctttacccaaaggtctctgtgccgaactgaattgttgtcattccataaagaac

SEQ ID NO: 682196 - DNA, 208 bp, Homo sapiens
aatcggctcggtccgcttttgctgaggtctcctgagagctgggtgttctcccctggctctgcccgttggaggccggcatgccagtgcggccctcagaccaggctctgggctcacgggacacgattggatggccggctttactgggttctcagcaggggagccccccgactgatacccactgaccctgttggcctccatggcgagtgtt

SEQ ID NO: 682197 - DNA, 184 bp, Homo sapiens
ccggcgcccggagcggggaagggcgcgggtgcgggcgcggaggacacacgcgggtctccggctctcaaccccgagctggccgggccgaggacctcagagcggggcagccccctcctcccacttcccacgccgggttggttttgtgtttgcttttccggacctcactctgccgtccaaaaagaca

SEQ ID NO: 682198 - DNA, 125 bp, Homo sapiens
tcccagaactatacaacaaaagagctccagacaagggagtgagaggcaggagttctactcttttttcttcttctttttttttagacagagtttctctcttgttgcccaggctgaagtgtcaacgt

SEQ ID NO: 682199 - DNA, 604 bp, Homo sapiens
gcgagagtgggacgaagagcggagcggtgtggagcagtactgcggtctcctctcctctctctaaacctcgctctcgcggtctacctttacccgcccggctgctcggtgaccagaacagcttccaccatgaccacctcagcgaagttcccacttgaaactagagaggcatcaagcacgctgtacatgtcccgtgtctcacggggtgagaaagtccaggccatgtatatctggatcgatggtacgtgggagaaggactgtgctgccgaggacccggacggcgtggtacgaggtgagcccaagtgctgtggcaagagttgcctgagtggacactttgccgagtggcctcatagctcacgtatgtacagctcatgagggtgtccgacaggtgacatgtatctcgtgaccctgcgtgccagtgtgtgtccggggaacccctttcgcgtacatggtagcccatacagcaagtcctggctcgttaatgtcgtagagtattctcaaagtgacacctgcgaagggcctggcacgcatgagcaatcctgagagcagcacctgtctccggctaatggacatggtgagcaagtcgaggacccctgggtgtggcatg

SEQ ID NO: 682200 - DNA, 123 bp, Homo sapiens
ctgatctagaggatctccctgggactctctggcacatcggagctcagcaatgatactgtggctccaagtagcccaataagtcagccacaggtggaagctgccacatgcatgcacccagggggt

SEQ ID NO: 682201 - DNA, 225 bp, Homo sapiens
cgaatcatatttacttataagatctttcatgaggcctgaccagctgtttcgagagaaaaccaaacacagtgattcacacttcataaacagaccttcaatctaaatgaacttggatcatatgtgaggtcactttgttgttgtttgttgttcatcttctcagcatctcttcgttattgccagaaaactttggtgtgcagcctgcatataatcagggacggaagatca

SEQ ID NO: 682202 - DNA, 608 bp, Homo sapiens
  misc_feature (134)..(134): n is a, c, g, or t
  misc_feature (204)..(204): n is a, c, g, or t
  misc_feature (461)..(461): n is a, c, g, or t
  misc_feature (465)..(465): n is a, c, g, or t
  misc_feature (511)..(511): n is a, c, g, or t
cgcgccggaataagctgaacaatagtgcctgaggaccggcaatcgatggtttgcggtcggggaataaggcagctgttgtgcgtgtgtatggacgtgggctttagccatgagttaacgtccatttccttggatantaagaagtccccgatttgaacaaagcaagagaaggatgattaaccactgttgtgtatcatgcgatcaggntgtttgctgtagaacaaggatgatgagttgctttaggtcgctggtttggttacagattggcagctgaccaatcgcccgtttctaggttggggcatccatgtatcagtaaacatactacatggtagtcaccatgactattcctgattgcttacctagcatttttgatttggctggtagtgacattgtaaagcaaaatccaaggcgaggttgcttcaaacagggctgtagcttccgtgcgtatggtcacttagagtcgntagnaaggccaatttggggcaatttggttgcaatttttcccaaaaatcgnaaaatttggaaataaaaatcgaaagaatttaaggggcaaaaacaaagggaaaaaggatcttttggaaaggcaacaagaaaggggctccttagttcga

SEQ ID NO: 682203 - DNA, 313 bp, Homo sapiens
  misc_feature (236)..(236): n is a, c, g, or t
  misc_feature (242)..(242): n is a, c, g, or t
aaattttcccccaaggatttttgcttccttaagcccttttgggtttgtttatggttttcattaaaagaataagcctaactttgtgggtagtcctaaggagaaccctttaaccccaaagtttttatcattgaagacaatattgaacaaccccctattttggggggattgaaaaggggggaataaaggcttgaaactttcctttgtgtgggaggacttggaggagaaatcccctggantttcantaaccctttgacaaactccccacacccagttgatggctttccgtaataaaaaaattgggatttccttttga

SEQ ID NO: 682204 - DNA, 151 bp, Homo sapiens
  misc_feature (115)..(115): n is a, c, g, or t
gagctacaatactactccattgtacccactaaaacactcaccaatgacctcacccctgacccccatgcctcatgatactcctcaatagccatctactgttcctgttgttgatccntctagagtctgaccttgcatgtgcatgcaatgcttg

SEQ ID NO: 682205 - DNA, 581 bp, Homo sapiens
  misc_feature (424)..(424): n is a, c, g, or t
  misc_feature (508)..(508): n is a, c, g, or t
  misc_feature (523)..(523): n is a, c, g, or t
ggagacgggggtctcacatgtgggctaggctgggtctcgaactccggacctcaggtgatctaccggcctcggcctcccaaagggctggggattacacgttggagccacggggccgggccgatctttcgtttcttttcagcataatttagatagtcagatttcagtatctacaaggcacatggaaaagggaaaggcttccccggcaagctgggagaaaataccggttcttcacccggggcattcccggtacggtaacagcacagactcaagacatttttcatcacaggggggccagaggccggtgaatccctcaaaatggtaggtaaaatcttaagagcaaaattgggtggatgttctcaaaaggaaggtgtgactttctagaagggttaagtaagaatatagctagtaaccttccatccacggnccccataatccccaagggtggcggtctccatgggggtatggcttaaatacgtggtaagagaaacatggctaccagatggcctgncacagggattcttgncccgaagcccttaaccgggaaagctaggggtaggggctgagaatcattcatcctaagg

SEQ ID NO: 682206 - DNA, 514 bp, Homo sapiens
tcaaatttttaaaagtatcttaagggggagctgttttttaaaatatccaatttatgcctgcataaacaacatagacatggaacctcccaaagagagaatatatgacgcttcttggaattttacaccagaggctactgcttagcctacataatagtttggaaaacaaggttatgaaataccgaaaccttttcaggatcttgaaaggctccatacacttttagagaggatcaccatagctattgctgagggaaacgtgccggaacacgacgcctgtactatggaggcttagggcacaggagaatcaccgtgaaaaccaacggaggctcttacaaaacacgggcgggaatcatgaacttgtgcgtcattgaacgtgtgacgtatccgctagcttttcagacggagaggctattagattctgatgtaaacctcagagcaggactgtctctgtgtccttttatgacaataaccagagacaaaacgctcaaaatggccaccacgaatcaactgctaaacg

SEQ ID NO: 682207 - DNA, 221 bp, Homo sapiens
ccacgctcgggacacctctggattcagcggcttgagaggcccagcctgggcctgctgcggtttaaccatttatagcactcctgagagccggacgtgcctcctacttgggcccggaagccagtccctccccctaagaccccgcgcctctgacggggcttggccccatgtccgcctgatgcacactccttacttggcgttccttggcgccccccttatcgggg

SEQ ID NO: 682208 - DNA, 1971 bp, Homo sapiens
  misc_feature (403)..(403): n is a, c, g, or t
  misc_feature (555)..(555): n is a, c, g, or t
  misc_feature (701)..(701): n is a, c, g, or t
tcaaactggtaggatgaggaccggctttaacgaagggcgagtccaggcggagacactatgaggtgagtacgcgtggagtatgagagagtagcaccagacgcgtgggccgtacactgacgagtagtagttaccgcgcagagggcaatcgcagtggagcaggggatcagccagcccgatagaatagtaggcacaggggagctcagaacgcgcccctgatagcacgtcttctggcgagtagagtcgacaggtcacagcataggaataaatagaacgtttgtggactagacgcgcaggtacgaccccaaaaaggtcttgagaggcacgcctctcgggatacaaaccgggaaccagtaggacatgaactcctaaaagggtaaccattggtaagagaaaggaattcctnactacctccctgtttccttcactcgtggacgccccaaatataataagggtagagtgcaaaggaagtatttcaattatgggattatgtacgtgtccgcatgggagaggcgctcatcccttgcatgccacatggggcattttgacatgagctcnttgtgggatagggtaccctataattgacctccaagacatgtccatgtaaagcgtctacagaaccctcctgttaaggacctgttgtcgcaccgacgacaggaccaaccgcggcgttccctacagagggtcacccctcttttgtgttntagccatacatttctagaggcgagagactttacgaatacctagaggaccgaaccgggatcccgaagggtcctcgggtggttgggtaacccaacgtttagcgtgtaccaaaaatagtgaccacgctgttggttgaaccccacgccagggacgcgtatacccaggatagctgtggtgacaccaaattccactaactcatgtgtgaaggcgacacggtcataacatacgccaaatgccggctaaccccaacaaggtttggcctggcaaacgagaagggtggctttaccacaaaggcgtgcggagaaaaaccacacgaaacttttaagcggcctaaaaggaccaaaccaataaccaacataggttccacttcattttggactatagggagatgtaacacattgcgagcccagcgctcgaccgcggtggttggcatcgcatgatctctgaagttacaggccccttaagatattgcccacgtgaaaccctctccacaagggtggggagggcacacttaagagggtaaaatacgaactggtacaccggccccattctttgtgtggcgtcctctgaaaaaaataaaaagcgtcggtttgccgattgcaattaggcgccctagggctcaactctggacatgcacgggtggcttaaataaaacaccattgagcccccacgtgaggtgtatgagaaattggagccaacccgatgggtgtccattgtttccgggccaaatgggacaaacccttattggaattgcccacatattcttaaaggacaccttacaagggaggaacgcgggacgccccaggaaagcatcctgtgcaacagcggagagcacaggcaatatcaacaccacagggatcgctactccgatataccagtgtaggattaaacgtggaggccaccccattcagtcgaatgaagaccgcacacacaagcaagataccccggaggaacacgggaacacaacgacaaacgagcgggtgggggcacaacccacaggggcggatgcaaaccgggagaaaggaaacgcgcaactcaagggggtcgacaaccaacagaacacagcgcggcgcccaaagaaacaccagcgggggcaacgaacaccaagacgaccagattgcagaacaggccacgacgcgagcaacaagaagagcgcgcactacacgacgcgacagacgaagagagacgatcaacgaagaaaacgatggaggtgatagaacacacgaacgcgcgagccaagacgatgagtcacgcaagcaagcaacgagccaa

SEQ ID NO: 682209 - DNA, 595 bp, Homo sapiens
tgggaggctgaggcggatggatcacctgaaatcaggagttcaagaccagcctggtcaacatggtgaaacactgtctctgctaaaaatacaaaaattagccgggtgtggtggcacatgcctgtaattccagctacttgggaggctgaggtaggagaatcacttgaacctgggaggcagaggttgcagtgagcagagatcgcgccactgcactccaggctggatgacaagagtgaaactccatctcaaaaaaaaaattataataacaacaaaacaaaatcaagcaattttgaagtgaattttaaaagtgcagtgttgccgggcgctgtggctcacgcctctaatcccagcacttcgggaggccaagacgggtggatcacaaggtcaggaggtcgagaccatcctggctaacatggtgaaaccccgtctctactaaaaatacaaaaaattagccaggcgtggtggtgggcgcctgtagtcccagctactcaggcggctgaggcaggagaatggcatgaacccaggaggcggagcttgcagtgagccaagatcgtgccactgcactccagcttgggccacagagcaagactctgtctca

SEQ ID NO: 682210 - DNA, 724 bp, Homo sapiens
  misc_feature (1)..(1): n is a, c, g, or t
  misc_feature (6)..(8): n is a, c, g, or t
ncggtnnntaatatacggctaggtacgaggctgggttgtgctcacctgccgcggcgactttcagtttcatttccacgggccctcctgcctgggcgcagccgccgccgtgatgcccagtaagttcacgctgccggcagctccgcggatgcgggccagtgtttcgagagtttcctggtcgttgcggggactggtcatggtgacagatcgcgagcggctgcggaccatttataaccgcgagttcaagatcagctttgggacccccgtaccctggtgttctcctccatgctgtatgtgaatgaagattgcaaatctggcctacgtcaccaagactcgggtcaggttcttcagactcgaacgctgggcctgacgtgcggttcccagaaaagaggagaatgaagctggcggtcagataatcaggcaaagaccacaagtcactggtagccaagatctttctatgacagggcttgagtatcttcatgggaaacatggtgtgggattgtggaagtccagggtgcccccatgaagcccgagatgggcagcgtccttattccgcctggatttgagccgcaaagagggtgctgaccctgaggcttcggaatggcgggaacccagtctgttacctcagtcacctcttccactctgccggagacccagttggtttcttacatgaagacaggagttgcctgtccctgtggcccggtgatggttgagcccctgtcgctgg

SEQ ID NO: 682211 - DNA, 501 bp, Homo sapiens
accgtggtcaaatgatattcacatgcatctctaagtatgggccacgagtcacaaaactgcatttaacgtgggaaacgtgccacataagcaaggaggtgatcccaacagtagtgggggcagatacccacaaaccaaagcgctgggacagtcaggacgagctgaaagggttcttcagtcagtttatgaactcgagtggagtgagacctctagactgacacgtacaacagagatgcagatccgtctaattggcaactgtcccttccattacttgctggccttggcttctagtcccatgcagcactgtgcgaccgacaggaataagctttacgattactgggccccagtgtcacaaattcatggttccgagacacttcacaacgctgggtaataaatcagctccatgaaggtaataagaagaccccaggatgtggcctatttacaatcaaccgtatccaagagaactcttgttgatctgttcttggatggctccgtattggcctc

SEQ ID NO: 682212 - DNA, 477 bp, Homo sapiens
tctttgttggattgggttaattcgaagaccttgtctttgagctctgaatttctttcttctacttgttcaattctattgctgaggttttccagagcattttgcatttctaaaagtgtgtccaaagtctcccgaattttttattgtttttttcttcaagctatctatttccttgaatatttctcccttcacttcttgtctcattttttggattttcttgcacggggcttctccttttcttgtccctccctgattagcttaataactaaactcctgaattcttattcaggtaaatcagggatttattcttggtttggagccattcctggtgaactagtgtgattcttggggggtgctgaagagccttgttttgtcatattatcagggttggcgtactgggtccttctcatttaggtaagctctatcagatgaaacgactagggctgaacactgcttttagattcttttttgccttggggt

SEQ ID NO: 682213 - DNA, 239 bp, Homo sapiens
gtcatagtagagagccctgtgaatgatggattctgttcgctgctccggtggcagcgagagggccgagagggccgtgtccacactgagaggagacaggagcacgttggtcgtgggtctcgtgctggatcgcacccggtccacgttcagctgctgaatgttggggaaggacggctgtctgggggcgtgcctgcacacctggcaagtgatgttctggagtatgcgggaggaccatcgtttgt

SEQ ID NO: 682214 - DNA, 1485 bp, Homo sapiens
tgctggggcgccgccccctcgtgggagtatgattgttgccacacaaagggagggggcgcgcttcttctttgcccccggcgtgtgtcgttgttttatattactcccctccaacagattttttgcttctctggtggatggaccacgctgtttcgtggcgattaagagtttcttcctccctctgtagtttttttgatggctcgcgcccccttcagatatgattgtgcgcccagttgttgttgcggcccccgccccagtggtggttgtgttccgccccgcttggttcttgttgttgctcccaccagggcggtatatatcatcacgtggtcttgtctgtcctgggcttttcctcttgtttgtgttgtgttgtgttgtagaaagaacggggcccccccacctgggccccccaacagggggggttaaaccattcttttcttaaaccccttggggtgtaacacacttgtgtggggggatgagaggaatgtcgcgataaagatagcccaccccttatgtcctacagcggggaagtgatcttatctaggattagtgccccacagcggtcttttcctttgtgggggtaattataggccccctccttttcccgttcgtcgctgcccccgtttataccacgtgggggtgggcccccccctcgcttatgtttgtttgagccgacattttgtgtcttggagggtgttgccttcgttttgtgccccgccccacgcttgcccctctttgtgccccgtctttcatatttctcggcctacggattatgtggggggcccccagcatgtcgtctcttggtttggcacacacccctgtggcggtgtttagatgtgagtagagctctctcttgcgggctatataatctcacaacgagggggtgaatacaccccctcctcatcatagataagagaggattgtttttctcttgttgacagagagactcccccccacacaagagggaaacaatcttctcacgcgctgtgcttctatagaggggtgtcccacatgttatatagcgcacttctcttataaaatatatttgtatatcttataaaaaaaagaaaaatatgacgcccggggccctcgtgttcttatggtggccacactataacgcggcccacggttccacatccactgtcttgagaatggagaaaagccgcgaggacctgccacgcacacctgttctccttgggtcttctctccctttggtcttcccactgagatggtggttggttcccctacaatctcctctccacatccacatttcaccctgttggtgtggagtggaatagcacgaggggtgatccaccgcacgtccttgagaggcacagtcctgtgtgaattccactgagtcacgttgtttttgtagtttttactatttccttcccaaaccacgcacgagatgtttggacaattaagggaaaaatttaattctcatcaatcggttgctgttatagtttaatccgtcaagatcttgagtatcca

SEQ ID NO: 682215 - DNA, 203 bp, Homo sapiens
ctacctctatccttcttcttctcttcatgcctcaggccgaacagctatcttccagctgcaggggcagacggggttcagccatactgatcactttacatcttctgaacagtgtatctcaacgtcttgctgtgtacagcttccaattttctgatacacttttctcacagcaccttctacatccacaatgctctctttgttgatgt

SEQ ID NO: 682216 - DNA, 325 bp, Homo sapiens
  misc_feature (251)..(251): n is a, c, g, or t
aaattttccaagtccccactatgattagctagacacgcgtttacaaacctttagctagacacagtgctgattggtgcgtttacaatcctttagctagacacaagttctccaagtccccgctagattagctagacacagagcactgattggtgcgtttacaaaccttgagctagacacagagtgctgattgggtgcatttacaatcctctagctagacataaaagttttcaagtccccaccaggttagttangatacagagtgctgattggtgcatccacaaacccccgaagcctagaccaggagagtgcttggctttgggtggca

SEQ ID NO: 682217 - DNA, 711 bp, Homo sapiens
ataagtcccgtgtccgaacccgtcatctactctagcatctgtgcaggcgcactcatcactgcgctaaagactcgggatgatcctgtctctgagtagggcttgagaacaataaccatgctaggggctagttccacgtgctgggcgtcaagctataccttcgtccctaggaagctgcatcatcgtgtttcctcactgcacagcattcagatctataatccttctaatagctatcctcttcaacaatatactctccggaccaatgaaccataaccaatataccaatgcaatactcatcattaataatcataatggctatagcaataaaagagctaggaatagcccccttggcacattctgagtcccagaggttacccaaggcacccctctgacatccggcctggttcttctcacatgacaagaaactagcccccatctcaatcatataccaaatctcgtccctcactaaagcgtcagccttctcctcactctctcaatctttatccatcatagcaggcagttcgaggtggattacacaaaccagtacgcaaaatcttagcaatactcctcaaattacccacataggatgactaatagcagtctacgtacaaccctaaataacattcttattacctatttatatatcctaatataccggatcctataatcaattaaatcagacaagaccctatatatctcgcgctgaaaaagtac

SEQ ID NO: 682218 - DNA, 179 bp, Homo sapiens
  misc_feature (137)..(137): n is a, c, g, or t
tgagaccaagtctcataatgtagccctggatggcctggaattctctctatcgatgagaatgggctggccttaaactcagatttgccttcctctgccttaggtgtgtacaaccacatctagcttagatggtttttgtnttatttgttttgtcttcttttttcttttggaggtctttgtgg

SEQ ID NO: 682219 - DNA, 929 bp, Homo sapiens
tatatctgactccttgaaagttatagctaattaaaccgtaggattgatctgcagcgtagctatccgataatctggcttatgatgtctagaatactacacaaggacagccaatgctatgtgacctagtgtgacgattcccgaggcaaagtgttgatacgcccgcatatggatcttccactttccgtgcgtctatgactagccacattgtagccatggatactattatatggaagcgctccaagttttgctagggcgttatgcatgaactccataaaagcgaaggtcgtaaacgattgctggttatgaagaggccttgatgtactggagtgctcatgagatgtcttgccacctgtttaaaatgaaccccaaactttggaccccgagcgaagacattggtccgggggatccatggcgtgggatgagaagacccttcaatgaaactgccctcggaagaatggtacgggaatgcacacgaagaatcgttggaatacgtcaagagtggacatggcattgtagacaaattggtcgtgggtgtgtccaataaaaggtcgagctagaaacgacggtggtaatctggagtcccggacagcacttattgctgggttgtgggcccttgaatttattaagctgggtgtggcgacaaagagtgatttttcacgggaagagattctttaactcaaggtgcatgcgtttcccagcccacaaggggaggggcatggcacgtgccatggaatgtgattcgccatataaccaaagaacttggttaaaggcgcatttggcggagcacaggtttcaaaagaaaattttcctccagattaccagattgtggtttaccattagaattggcttcaaagtggtcccccaaatgttcaccctgttccttaaaagggataatccagggcctcagacgggaataaggtcaggctaaa

SEQ ID NO: 682220 - DNA, 553 bp, Homo sapiens
  misc_feature (9)..(9): n is a, c, g, or t
tgagggtanatttaaccctctgggaggttaagtaacttggccaaaatcctcagtgcagtcgtgcattgggtcgtaaatagaactcggatctgctgaggggtctgggtggtgaagtcccgccctggggtcttcccaatgagacgcagacatccccttcccttagaacgggagcctgggacccatagctttaccgggcagaggcagggaaatgcctgactttggactccagcagctcgacacatcccgagccctggcccaccggcctgggtgtaaggaatccctccgactacccagtctctccgccctcccgcgcagcctcgccaggcggcagaggggacgcgcctcaggtggcctagcgccccggcccagctccgggacacatgtggccccgccctccgcggctcgccgggtccctggcctgccctggcagtccctgctctctgggagggcccccgggacaccgttctcaaccgacggaggaagacccagaggaagaaacagcccgggtacccccgcccgacccggtcaggaagccatgggtggttggcggccg

SEQ ID NO: 682221 - DNA, 219 bp, Homo sapiens
  misc_feature (43)..(43): n is a, c, g, or t
  misc_feature (60)..(60): n is a, c, g, or t
  misc_feature (91)..(91): n is a, c, g, or t
  misc_feature (95)..(95): n is a, c, g, or t
  misc_feature (121)..(121): n is a, c, g, or t
  misc_feature (143)..(143): n is a, c, g, or t
  misc_feature (154)..(154): n is a, c, g, or t
  misc_feature (164)..(164): n is a, c, g, or t
  misc_feature (187)..(187): n is a, c, g, or t
  misc_feature (196)..(196): n is a, c, g, or t
  misc_feature (203)..(203): n is a, c, g, or t
  misc_feature (211)..(211): n is a, c, g, or t
gttggttcaagtttaaatgactgttctgccccttttacatcanagaactactgacaacgnaggccgcgcctgctttttccatctttttatntatnttgctggcagggaaagaaagatcttncatgttggtgaaggtagaagtngggtggaagangttgggtggnacgacagttaaatctagagtaanaccaagctngcccaangtgtcctncaggctgt

SEQ ID NO: 682222 - DNA, 267 bp, Homo sapiens
  misc_feature (209)..(209): n is a, c, g, or t
gagatcatgccactgcacactccagcctggacgacagagcgagtccatctcaaaaaaaaaaaaaaaaaaaaaaggtggggaaaagggggagggagggcggggaagtgccccgggagctgagaggtcgggcagggtccagggaagatgagggaccacggggcaaaagtccagagagggattggtccagtatcgcgggaaataggggggtncgggggatagacacgtgggaagggtataaatgcctttggggcaactcagagagttgaa

SEQ ID NO: 682223 - DNA, 279 bp, Homo sapiens
ggaggatgattacggcttcactgtccgtcttgtttaatgagccaatgccttgctggatctccttgttactcggcatgtttagatagagcaggagagaggggcctccccagtgatctcattttaccggatggatctttcacacttaaaacacattttccccttgtttctttttctccaaagaagggcagcaggacaccgctgcttgtgtccagctcctgcagtgacagcggctccttcaggtgctttgtgtcccacagcgccacctgccgctcactcatg

SEQ ID NO: 682224 - DNA, 160 bp, Homo sapiens
atggtatcaaagctcaccgatgtggcaccttgatgagtggtaagctatatatatacccgtccaattccagtatgtgagcaatattatgttcgctaggacctcttgcatggtcggattcctactgcttctctgtgtcgtagacattttgtggatggatgat

SEQ ID NO: 682225 - DNA, 454 bp, Homo sapiens
  misc_feature (255)..(256): n is a, c, g, or t
  misc_feature (323)..(323): n is a, c, g, or t
agagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaanntgggattgctgcattttgggtaagctgtaggagcctgataataccctggagtccttgaataaagatnagaagcatcacttgagattataccttgaaagcaattataatgtttcttaactcttccaaataagatttcttctctggaggctacttggctggtttattccttacaggatatttgtagagttaaccatttaa

SEQ ID NO: 682226 - DNA, 1459 bp, Homo sapiens
  misc_feature (726)..(726): n is a, c, g, or t
  misc_feature (1223)..(1223): n is a, c, g, or t
gtgcagagggatgtcggagagtgcaggatacgactaaagtacgaagtgctcagtttcactcttagataaaaagagctctagaagatgtaggtggtgatgaacaagcagcatctagagaagagcagtggttgacttgtcataagagatttcccaaagtctctcgaccgataatagtgtgagagtataaagggggttgtcaaaatgcattgcgatttctgacacagatatcatcaacagtcatggggattaatccgaattatccaaatgctgaatgagtaaacagtctctgaatatagcaaaaacaaaagcctacgaaaaagggtaactaagattgggctaagacctggagaaggaggtactatgaaaaaggcactgcgagtggtttaaaagtctttaacacatgtgaggtaatattgctaagcaatatgttgaaaggaccaggtagtttgggtaggggccaagcaccattatgtgtgtggtggtgtgtgagagaaagtagacctgtgggagggcccaacttatgggtctacagaaactctagtactaatccatgcacagctgaactcgacgtatcttgatctgcgaattgctttgccaggctggcagcagtgagtggcttagtttttccaatagattataattttgaaaatgctttggaacctgcgaaaaagcggggggggagggggggaaaggcaaaaatactttgaaaaattttggaaaaaaccnctaaaagccttgtgtgggtagcgacaatttgtaaagttttgcaactttcaagcaaattttttcttgtaaggatataagaaggttttattaactttgactgtaggtttaaaatttggaaccaaataaaccaatttgtgttgaactcggaggcagggtacatttataggcctggcagaaacaaaagtgtattgctaacggaaatttttgtaacaaaaattaaagaagtcctgaaaaaggttggggtggataacgtctgcgagtccaattttcctggtattataatggtgaactcccctataaagagactggcggggaaaagattttgacaaagggagggggttaaaccttggcgttaatatttaagtaaaaatgagagttctgttgggacagcgggggaattcccccccccaacttaaaccaggtgacacaccgaccttggggcaaacgaggcggtcccatcatggagctgcagaatgagtgtgtggcgaacaaagganccccactaatctgtgggcacaacacaagcgggcgagttgaacagaagaggctgccacacgaaacgaacaacaaacaaagacaaaaacacaaatggtgtggccgcggccgcgtgcccgcccagaacgagtatacaacacacaggatgcggggcgcgaccccacgagcatcgaacaagcgtgcaccgagcacatccagaacgcatgaccaaagagaaggaggggcacacaccaaacgt

SEQ ID NO: 682227 - DNA, 1058 bp, Homo sapiens
gagcgcgacgagaaggtggctcgccggcagtgcctgattctcctcgatgtcgtattcctgcccagatccgggaggaactgcaagagtgtggtgcatctgacttccaatatacttcccggtccggtcagcgattgagggggaacagcactctggcccagcgtcggcgcagtgaggagacggtcgtggacctccacgaatacccgccgactgaatataacatgaaacgtctctgtccaagacacgctaggcgcagccagtcgtacgaaggaattggtacatctaatcgtgcgagggtctacatgatattgacatcaccaccctggaaggaaggaatcgagtcccatcattcaaatttcctcaggcaagaaatggtgtgaactatgtcttcagacagatggtgcaagttatatgcagcagatacggaactgtatgtggtcaaaggaagtgcagtggtgtagcttgtcttgttaaggacaatccacagagatcttatttttctaagaatatttgacattaacggatgggaaactattgtgggaacaagagctataccaataactttgtgctcataatacataggttcccttagaggggattatttttcaattaggcccctttttgctgggaagatttaacttggttcaaaggttttgcgtcccttaaagtttttgggcccaatggaagacggaaaagaaagggcaagacaaactgacgacacgcgagccagcacaaccaaggcgaacaaccatttgttgggcgcccgcacatgggacgccatctcgagaaagaagccgttcagcgtgaaacacactaagttatgggggcgcggggcagccccagatgaagcgcagtgagaaaccggtggccaaggaggtggctcctctcgaagaagaccgcgtggggcaggcaaagagcgctggcgggtattcgcccgcgaatataaagaaggccccggggtggaacaccagcagcgtttcgcaaccaacaactccaacggtggagcctcgagaggaccatacacggaattctagaccgaggagcactgagcaagcccagaa

SEQ ID NO: 682228 - DNA, 185 bp, Homo sapiens
ggttatgacctgccgccgcgctggcatggtagagatggtagcgtatccactctggagggctatacactcgggtcccatcgaagtccgtgtcgacggtgtccttgagaagcgcccccgagccgaagtcgatgagcttgagctcgacgcgattgaggtcgataaggatgtctcagtccttgatgtcg

SEQ ID NO: 682229 - DNA, 959 bp, Homo sapiens
cgttagccctgtatgtataccaacactgccaaagtaaaacattaggtcaggcatggtggctcaggcctgtaatcccagcatttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaccaaagtgaaacattaaaaattccctatagattttttccaggaaatattttaatggggctgatttaaataaggcggtatcatggatgataacgggaatcgattttatgtcttgggtataaaatcactggagtaaatcaaccatgggaaatcccattggacaaagattagcttggtaaaaaacagatactggggtagatttctagaaatgcgttcacatttaagacttctacatggataatagccttgtgtcatgagcatatgcgaccccgtatatgaattacgcatttaaggtcccaaatcaaggagactttagtctaggaatttgcagaaatattacggtgccaaggcacaaaagggtcttgtggaaactacatgcaggtcactagcctatgggagtcccttaaggtgtggactgaagggaatgggtgaagctggccagtgaatgggggggtgggatgaggttgtaacagtacgggggagtgacaaccagataagtcaatgattgaaaaagaagtgtaacatgttggtggagtgagatataaacagagaataatgagagggaggtcaaaaagaggaggggcaatacggagagaagtgaacttgatcatataaataaag

SEQ ID NO: 682230 - DNA, 611 bp, Homo sapiens
tgggagaacagaatctcactctatggcccaagtggagtgcaagggcacaatttgggatttacgggcaagctcaagttcctaggtttaaggtgattctccgtgacatcagactccaaagatagcggggattacaggacgtgtgccagcagtaccgggactagtgtaggatatatatgggatggaaatggggtttacaccgatgctgtgtcaaggcgtgggtcgtttagactcctgttacacatcgggcgaatcaaccacagctacaggacgtcccaaagatgaggggaataacaggcattgagccaccaggattggggcaagaaacttggacgacttttaaaagttctaacagttaaaatggtaaataaggggctagaacgatctaggggaacgaaccaatcactattataatacctgatggggtataaacagccagtagaacgttggggtaataaccgcctgttcataaagaagacagagttgtgagataaaatggtggttgagcaaacagtcaggtgtaacaagtagtgtaccatatgtccattagatttaaagttaaattcaccatatacaggggaaattagtagtgacacagagaacataagtcagat

SEQ ID NO: 682231 - DNA, 495 bp, Homo sapiens
tgtgtgggtccaggatcaccattagggaagacagagtagctcaaaaatcaacagtgaggaggaggacagcactttgagtggtatcttgctctaggagcattttcaagccatcagaagtgggactcttgaagactatttctgactttctcagcacaaattaagataataggagatggtggctccatttgaaaaacattttggttgtataatggttagcataaaacatacttttttcaagttaactcaggcactagagtatggggggcggagggaaatgtactgcagcattaaataaaactagagctgggagaatgtgtccctccttgaataaattgcaaatgcatgtgcaccgtatttgaccatgagggaaaaatgagaagccccttttccaaaaccagtggaagaagtttttcttagggacaaccgtttacttcgtgaacttactttggtgtcttacaggggaaagttaaaaaggtcccctgcctgttgtttgga

SEQ ID NO: 682232 - DNA, 198 bp, Homo sapiens
gagattgatacaagtatatgggattttgaacaggcaaagaggaaacaaagaattaaggtatccctgttgaagtggtgcaagaaaggagtgccccacccatagtgttatctacaataggtactccggggaaaggaccccaaggagtcagaccacaaatgtatgaccagcacaattctatgatcaaactctacctctagc

SEQ ID NO: 682233 - DNA, 1139 bp, Homo sapiens
  misc_feature (792)..(792): n is a, c, g, or t
gagaggggccgatgaggtgcggaggcgttggcagttgacttttgctgatggagcctctctgaagggcatattcaaagtacagctgggtgctgcagcgactggagtgcgaacttgtaggctgtggttatgaaggagcctcgtcagctatgcctttagcccctggtgaagcagttgccagtcacagtttgccaagtcaatgcggagaggcaagcagtatgtaagaccatgagcaaaatcaaatgcataaccaagctaaaccacggggcaatggagacacagagtttcattcttgtcaccctggctggagtgcagatgcagtggacattgatgatagtgcacatactaatttggcaattcctggagtctcaagccatcttccctccatgtgctctccaagtagctggggactacaggtcatgtgagcacacagcataaaggcagctgcccacaagccaggaagagaagcatcatcagaaaccgaccatactggcttcctgatctcagactttcagcctccagaatgagatgggggtgtgaaaggaaatgaaatcttgggaccctaaactcattaagccaaagggaaaagctgggccgagaactggatgatgcaacctgcttgcacctttttgcttcctaaataagatggctacaagatgaaaagctatacatctctgccatattttgcccacaaggaaattcctagtgagcttcaagatcttttaaggtgtttctgttaaaatttcacaatttcgccattgcaatgtaaatttatagcttatccttacaggtgcngtcatctccctgcccaccagacacaaaggcatatctgattgttctcctgccccattttgtctatgttatcttatgtaaaatacagataccctgcatttttcctctgccccatttgtctatatcaccttatataaaaaaatgcagagtcactgagccggacaaaggcatgaacgactatttttccctacccccgctcttacatgaaaattgtgtacttctgaatatcctgccctttcccctttaaatttggagccctcagaatcatcttcagagaaaggcatagacctgtctcccgggcatacatccttaactgtggcaaataaacctcctaaaatgataaaaaaaaa

SEQ ID NO: 682234 - DNA, 840 bp, Homo sapiens
gagaggggccgatgaggtgcggaggcgttggcagttgacttttgctgatggagcctctctgaagggcatattcaaagtacagctgggtgctgcagcgactggagtgcgaacttgtaggctgtggttatgaaggagcctcgtcagctatgcctttagcccctggtgaagcagttgccagtcacagtttgccaagtcaatgcggagaggcaagcagtatgtaagaccatgagcaaaatcaaatgcataaccaagctaaaccacggggcaatggagacacagagtttcattcttgtcaccctggctggagtgcagatgcagtggacattgatgatagtgcacatactaatttggcaattcctggagtctcaagccatcttccctccatgtgctctccaagtagctggggactacaggtcatgtgagcacacagcataaaggcagctgcccacaagccaggaagagaagcatcatcagaaaccgaccatactggcttcctgatctcagactttcagcctccagaatgatcattgcctgctcctccaagcccttcactgtagaatggacagcctgtgattttcctggcatcatgcattgactgagaaggtcagtgtggctaacttctgagctttcaacatcaggaaacccgtagttcttcacacttgaagcggctcctggcaggcacgagtcgatccttgggtacattaaaggctgatatttgaaacagaaaacaaagagaacaacaccatcaacaccactgtgtcgcgccgcccgcgccctctcaaacagttttaaaacacactgttgagagcgccggggccccatatggtagcacagtggcga

SEQ ID NO: 682235 - DNA, 204 bp, Homo sapiens
tcgattctacaggatcccctcttggtgaggacatacattcatgatggtcgatgccactaaccacatggaagcagttactcgcgatgaactttatgtggtcgtgacttgcataagtccagtccggaccctcctttggtgctggctgtgcgaagtaaaacagcccgatcacagaagaccctacctgtggtattaaattggtctcca

SEQ ID NO: 682236 - DNA, 118 bp, Homo sapiens
tggcctctgcaccagccataggtatactccctcacatccccctcttccagccagatacccgccttgacaaacgccctaatgcccgaggccctgtcaggatggccattcaacgcctccg

SEQ ID NO: 682237 - DNA, 335 bp, Homo sapiens
tgacttgttattgattagcttattgtaatttaaattttaaaaatgcagtccaggccaggtgtgagccatcatgtctggcccatggggtgtctaaaatagtcaaactcatggaatcagagagtagaatggtactggggctgaggggaagagaaatggtggggaattgctattccataggtataaagtcatagttatgcaagatgaataagttctagagaacggctgcataaaattgtgcctgtagttaacaatatggtactgtacccttacaaatttgttcagacggtagaactcacattaagcgctcttaccacaataaaataaaaattaggaaa

SEQ ID NO: 682238 - DNA, 199 bp, Homo sapiens
attaccgggctttgtagatgaagggagatatctgaagtgggcgttaaagtctagaagaatgtacagcagccgggtagctaggaaggagagaggcagaactgtaatttgaatgcataagacagcctcagaagaatttcccagtcactattccgtttaaatccagggatttaaaacccagtgtgtttttagcgtcacttgg

SEQ ID NO: 682239 - DNA, 241 bp, Homo sapiens
  misc_feature (10)..(10): n is a, c, g, or t
ccgaaagctnattatcctcacctaatttggcattttatgcttattttacaaagctgtgcaagcttggggtcctaggggtttactatggagtataaagttctaaacagaaagctcttctatcagattttggccgctttcagatagtgaaagtgctctgaaatgctgacgttacctttgaggagaaaatattagatgtcaccattttagcttaaattattggacacactaatttcaccagaat

SEQ ID NO: 682240 - DNA, 508 bp, Homo sapiens
  misc_feature (77)..(77): n is a, c, g, or t
  misc_feature (84)..(84): n is a, c, g, or t
  misc_feature (103)..(103): n is a, c, g, or t
  misc_feature (108)..(109): n is a, c, g, or t
  misc_feature (132)..(132): n is a, c, g, or t
  misc_feature (201)..(201): n is a, c, g, or t
  misc_feature (237)..(237): n is a, c, g, or t
  misc_feature (258)..(258): n is a, c, g, or t
  misc_feature (265)..(265): n is a, c, g, or t
agaggatccccgaaggtgtctgagtgctggtaaagttctgcatcttaaccctggttgtggattacacaggtctattnaattaanaaaaaactcatcaagtganaggtnnataagtgtgcttttcgttatatntcaataaaacatttaaaaacatgcattttatatatctgtttttatatatctggccatgaagtccatgtnggtcaaaaacactgagaagtaattatatgccatttngtaccttgatacaaatagctngtgtatnattagttccctaggtgaggtactgttttaatctaacttctttcacggatacaaataccctctagatactcccggggaaaaagagggggaaaagagaaagaaagaagggagagtgggtaacaggttggcactatgtgaattaccacagcaatttatttcctttccctaagtctatggtcaggcaaagggcttacctctaacaactcatcaactgctctgtttgaaggatccctggttagtaggt

SEQ ID NO: 682241 - DNA, 279 bp, Homo sapiens
ttcttagggagcactgacaggtgtttttagttagaatatgaacctaaaaagggtagactttctccatcctctgccaaatcaatgaaaaagaaaagctggttgccactaattactacagggtaggatttctgaactcagacttggaaaggtattttgatttattctttaaaactgtgcttttttcactgcctcaggagaaaagggtgttttcttaccttggtgacctttacctcccttaagttcctggaaaactgtttcttttctctccctaagacccta

SEQ ID NO: 682242 - DNA, 681 bp, Homo sapiens
gcagatggaaacaattctagtaattccactattttgaagggtgaatatgtattcacgaactgctgtcaatgagcagcaacctataaattttagctacctggtcttctgtagcatgtcaaagaatgtagaagactgctaatgcagcttctaaaactcatgttatatcttataagctatacttctagagaaaagtcataaattattaattatggcttgacaatgcgtacattctttcattatccgaaagtttaaagctagagaagaaggagagattatccaggattctatcagttctctatacgtatagctgagacagacttttccggagagtgccactccaggtatgcctttcattggcaggtaacaactttgtagtatcttggtattatctaagaggatccatgtgggtgtatgagaacatcgtctgggattgtttagtttagaaactgagattaagtaactttagcatagaccaggaggaaacagcatactcacgtgttatggctcagaaaaaaaagttcaaagatggaacattcgtagttccactttctttcattggccattacataatagtagtccttaatattctaagtatcatttgctggggagcagaatcgggtgcttgaaggacccataagcgtagatctgacaaaatctgacatgtgacacgaacctcctgca

SEQ ID NO: 682243 - DNA, 739 bp, Homo sapiens
gcgtaaaccagcgcaactcatacacctcgccacgcggcacgaaaaacgcggtttccgagaggttgttctcggcggcgatgttgtgcaattgctcggtgggcagccactcggtgagcgggcagacggccgccgggttgccgccaaaggcctgttggctgaaagcatcgacttggtagatgtccaatttcatcgcaggcgctccatgtgaggggaggctggacactagcagtggggttacggcagcgtcaaagtacagatggcgcctttttttcagcgcatgaaccctgcacggtccaggatcaaccgcgctcaacccaggcgcaacagcatcgccccgacggcaatgacgcacgcggcaacgatgcgaacgcgcgtgagaggctctttgagcacccaggctgaaatcaccacgccgaacaggatcgacgtttctcgcagtgccgaaaccgtggcgatcggtgcctgggtcattgcccacagggccaggccgtatgacgccacggtgcccataccggcaacgacgcccagccgccaataacgcgcgacgtagccacaaaacacggcacgccgtgtcactaacgcccacgcggcaagcgggatgccggtgagcaggaaaatccacagggtgtaagccgcggcgcgccggattgcgcacgccaaaaccatcattcagggtgtaaccggcaatcacaccggcgttgatcagcgcaagaacaagccctttctgtgccctgcgaag

SEQ ID NO: 682244 - DNA, 442 bp, Homo sapiens
ataaacctcgcgtcacctctcagcctcatacacatccttgctacgttgtggtgggaagactcagaagatccgagctctgagggtcacttaaccatcctacaaagcgtagagctcaggcccagactcacaacacaccaactcccagatggattcatctccctgaaatcctcaccttcttgcagttgacactggaccgatcacctgataagagctaccacaaatggatcatcaaacctatatacgtagtgctaacagtgtaaaatcactactgagtgaatactcagatacgtacttagtgtggtgctgtcaaaccatgacctcatagaccatcacaaccactccttatgaggcagatttaactgtccccattttcaaggtacgaaattgaggtaggtaatgtgcctgacccaggatcacacacccagtgagtgattgaactgag

SEQ ID NO: 682245 - DNA, 964 bp, Homo sapiens
  misc_feature (25)..(25): n is a, c, g, or t
  misc_feature (110)..(110): n is a, c, g, or t
  misc_feature (112)..(113): n is a, c, g, or t
  misc_feature (138)..(138): n is a, c, g, or t
  misc_feature (169)..(169): n is a, c, g, or t
  misc_feature (180)..(180): n is a, c, g, or t
  misc_feature (185)..(185): n is a, c, g, or t
  misc_feature (190)..(190): n is a, c, g, or t
  misc_feature (214)..(214): n is a, c, g, or t
  misc_feature (253)..(254): n is a, c, g, or t
  misc_feature (273)..(273): n is a, c, g, or t
  misc_feature (275)..(275): n is a, c, g, or t
  misc_feature (286)..(286): n is a, c, g, or t
  misc_feature (290)..(290): n is a, c, g, or t
  misc_feature (365)..(366): n is a, c, g, or t
  misc_feature (372)..(372): n is a, c, g, or t
  misc_feature (400)..(400): n is a, c, g, or t
  misc_feature (403)..(403): n is a, c, g, or t
  misc_feature (413)..(413): n is a, c, g, or t
  misc_feature (416)..(417): n is a, c, g, or t
  misc_feature (463)..(463): n is a, c, g, or t
  misc_feature (489)..(489): n is a, c, g, or t
  misc_feature (499)..(499): n is a, c, g, or t
  misc_feature (510)..(510): n is a, c, g, or t
  misc_feature (526)..(526): n is a, c, g, or t
  misc_feature (541)..(541): n is a, c, g, or t
  misc_feature (551)..(551): n is a, c, g, or t
  misc_feature (840)..(840): n is a, c, g, or t
  misc_feature (868)..(868): n is a, c, g, or t
  misc_feature (900)..(900): n is a, c, g, or t
  misc_feature (952)..(952): n is a, c, g, or t
agcatctggttacagaaagcaaaantggcttattgcagtgggacaaataaccagtttattattcaatctgaaaccaaatttcaggtgaacaatcacgtggatttagaaananntcccatggacacaatgttaaaccanttggttactaaaggcaactttagactaagcnactgtgttaantgggnaaganatgaaatcatgctggatgaaatanattcaaccatttaatgaaaactatcaagggcagaccatnnggtttcagaaaagtgaaantntcttaccagantggngatcactgcaaacatgtcaacccactatgtctgccttgggcaatatagtagggaaagttctatgttatgtcaggnnggggtnctctacattggggcaaagttgcgcaagnggnaatgggtgtnttnnattctctccatgttcctcttcagtgtccttcatccgtgtgtgtttnttggacaacatccctcctccccaggnactttgaganatatgtaaacnaagtggaccctttgcnaagggcttagatgcnattccgaagnaacagcccagtctctgtgctcctgtcgccccttctccctggtgagtgcctctactttcctccactcttctgcactcacaatgcatcttagcatctaaggatgcaaacctaagaaggagcttgatggagtgtcatcaagagagaaatcatacattttcctaaggcaagaggaaacatttgtgcaagaaatgtctggggtagggaggaaaagaaggaagggaggaagggaggaaggaagaaatctacagacagatttttggaaaaaaagggttttttttttctttactgcnctttctagtaggttagccagctctcctnaatgagtcatgaaaatttggtgtatgtgtgtntgtaaaacatatacatatttaatatatatagatgtaaaatacagatgccatntgaaaatgtaaa

SEQ ID NO: 682246 - DNA, 287 bp, Homo sapiens
gggaaggcaccctggctgcttcacctcccagccagaccctcccctgaccgcgagcgccaacatgagctgggcgtgtcgttgtgtgcagttcttgagtgctgctgtcagcgccgctgcggaccagcgtgccgcaccagcgggaggagccctgcgcgcggacgctgacgtgcagggccggagctgccggagatacattctgccgcgttcacgttatggcgccttttcttgcagcaagcaggtgcaccatgctaaggctgtgattcccacgggcgttggatgagccgggc

SEQ ID NO: 682247 - DNA, 95 bp, Homo sapiens
  misc_feature (31)..(31): n is a, c, g, or t
taatttttaagaatataaataattatatttncctattaagtaatatatagccatatatatatatatatatatatatatatatatatatatatata

SEQ ID NO: 682248 - DNA, 547 bp, Homo sapiens
  misc_feature (367)..(367): n is a, c, g, or t
  misc_feature (510)..(510): n is a, c, g, or t
gggattacaggcacgccccaccacacctggctaatttttgtatttttagtagagatggggtttcaccatgttggctaggctggtctcaaactcccgacctcaggtgatccacccacctcagcctcccaaagtggtgggattacaggcatgagccaccgtgccgagccttccttgaagttttttgttggttttgatttgttttgtttagttttgtttagttttgtttagtttttggggatggggtctcgctctgttgcccatgctggagtgcagtggcacaatcttggctcagagcaacctctgcatcccaggctcaagcgatcctcccacttcagtctgagtagctgggactacaggcgcgtgccgncaggcccagctaattttggtgtttgtcagagatgaggttttgccatgttgcccaggctcgtcttgaacaccggggctcaaggaatctggccatcttcgcctcccaaagttctgagcatggcaggtgtgagtcatcatgcccangctccttgaagtttactaaccaattgggataactgag

SEQ ID NO: 682249 - DNA, 382 bp, Homo sapiens
ctacaagcaatcctatgtacaccgcttataagttagctggcaaaagattagacattaggtcaacaatcttatttattagggctgagagtggtaacacattatagtaacagtattagaacaagtgaccctcaaggtgtatcaattataaagcagatgaaaacttgcatgacaaatatctagtaacattctctcgtaaccaagtcgatgcaagccatgctaacaaaataatagtgagaaagccatataactacagcagaatacatgttctaggctttccggtactgacagtaagtcagttgaaaaaatacaaatacaacagaacaattctagaatcggaataaatctacagtgaagtcttgcttgttccgctggggtaccgagc

SEQ ID NO: 682250 - DNA, 539 bp, Homo sapiens
ttcgagctgcattgcaagcagtgcatgtctgacacacaccatagattgtccatgaagaagcatctgtagggaatccagataggagcgttcatgagaggtgtacaagcccggaagaattacacaagcactgagctgtttattgcgccggaggatcccacagaacagcagtgagcctcaacttgtcaggcttagggagttgagcagctagacaccaattgagcgagtagtgatgtaaccagtagactaagttacatcttaccttacttctcagccgttacactagatttgaaatcactgtaaataccgtacattaaactgccaaccacaggaaacagcgaggagcagattctaagtgtaggcactgaccggcagagactaaatagagtcctcatgggcccaaggagcatccagaaaaggcactacaaagaggtaggaaggcagacgcatcagagagggaacaggatgcccaggcatctgtgacagaacacttgccgaagaaaaaaggctcggaagtcagccccatggagctgaacacctca

SEQ ID NO: 682251 - DNA, 238 bp, Homo sapiens
gtggccccatgattataatagcccagactatccttctgtgatgtctgtccctggaaagcgtagaacatccccacacagtgcccacttttgttctgacagtgttggagagcctggacacacccaccttcttcacctgggtctctgcgttatcccccgagtcttgacgggaagtatgacagcctaatactgattgtactcaggcagctgaagggtgcctgcatgagcgagcccagctcaa

SEQ ID NO: 682252 - DNA, 173 bp, Homo sapiens
gttacgacggatcttagtgaagataggaaaggcaggctcacccctttatgacatgcagttagagagacgggggcttccctattcactttggacgagtaaaaagaaggctctgaggtatcaacagcctgggctgttgggaaaaggacacagaatctgtgtatcctgcaacgcca

SEQ ID NO: 682253 - DNA, 667 bp, Homo sapiens
tgtagaaaaaaggtgacactcttaaaaagaaacccccccctttgggtttctagccccccgagaaaaaggcccccccaaatcattcttatattactttctcccgacgtatcctcgtgggcgaaaaaatatggtggcctctacaacagatagaagcggtggtcgtcttgtgggaagttattcctcctttcagacaaaatcttggttagataacgcccgcagttcgccccactctacaatgtgtgtggagacgcagcccccagttcttgtataaagacaacacaattcaccgccgcgcgtgtgttgtgtctcaccgcatcgaacacacaaagagtgccacacacacagtgtgtgtcacacagggtcgtgcgcaccacacaagagagatgagaacagcgccactcatagaggtgggtctacgcgcgcgccccacgcgacaccatgcagggcgcgtggggagtctcacgcacggatccccctccagagagacaatgttatagcccgcgcacacatctcgcggcgcacaactgcgagagaaattcctcacaaagagagagacagcgcggcggcgcaatgctcgcgcactactatatacgcagagagagagcgtccctataactaaccgcggcggcgccccccagaaacacccccgcaagcgtgcgtgacacgc

SEQ ID NO: 682254 - DNA, 1044 bp, Homo sapiens
gggacgcgtgggtattttctctttttaggaaatataaaaggtctgctattcatatttacaattgacataatggacacatgcacggcccacacggtggacagcgtggccgggggcccctttccccctctaacggcacggcccccctcaccggcaccaggccctcgtgtggcccccgactctagggcactggaaccggccctagctgcccaacatggacctgggggccaccctgctgagccggaggcgtcacggtcctctgtgcaggcacgtggggagggggtcccaggttccctgacagacgggaggcaggcacgggggagcctgactcacccagcgagacagccacggggccggcggcagcacagagcatgggaccctagggcccacgagacgcgcgtccagcggcttcccaccacccggggacacagggcccaagcaccgtgccacctacagatgggggtcgtgcaaggaggcagaaagcccctcgcgtggcaaggccgtcctcccacaacgccctgccgagagaatgggccggcgagggcccggccaaccggtgagcctcagccgcggcggtaaactcccgtgggatactgccggagacgcgtgcctccgcccacctaacggcgcctggggcgaaccaccaacagggcagagagagtctaggggatgagcccagaactgcgccccgcaaggaagccacagacgcagtggggcctgcgcgaggggggcaacacggcaagagagacgacccacgcgaaacccccccgggccaccccgcgctccagagcatcccgggcggctgccccgctagccatacaaagcaaacaaccgggcgaggaacgggcgccccccctgtggggcagccccgaggagaagcccctcccccaagtcggacacggcgccgccggccccggggggccccccctgggagcgggagcgcagcagaggcggggaacaggatcgcgggaagacacagggggagtggcactcctaaaggaagggcggcaccccagccagagggggacacccccctcagacgccaag

SEQ ID NO: 682255 - DNA, 538 bp, Homo sapiens
ttggaggcaaagaccggctgacctgccaagctggtggaggggctgaagcggctggccaagtccgaccccatggtgcagtgcatcatcgaggagtcggcgagagcacatcatcgcagggcgccggcgaagctgcacctggcaaatctgccctgaaggacctgcgcggaggaccacgccttgcatccccattcaagaaaatctgacccgggtcgtctacgtacccgcgacgacggtcacgtgaagtatgtcgaacgtgctctagcctctccaagttcccccatacaagcacaaccgggttgtacatgacaggcgctggcccttcccgcgacggccttggccgagggacaatcggataaaggcgaggatgtccagcccgatcaggaagctcaagccagcggcgcgcgactacctggaccgaaaagatacgagtgggacgtggctgaggcccgcaaggatctggtgctttgggcccgaaggcacccgggcccaaaatcctcaccgacatcaccaaggttgttgcagtacctcaacgagatgg

SEQ ID NO: 682256 - DNA, 274 bp, Homo sapiens
gatagatgcaacggaggaagtgtaagtttatttgtaggtgacatatatgttagtaaggtggcgtgattttgaagcacaatggaatacctttaaaacaggttcctatcttctggaaagaaatattgttgttgcccttggacacttgcagcgtgattggaaaggtgagggacagggcaaggcgtgacggatcaaagtcctctaatacttgtggagataggtaagggagaaatgcgtggggttagacgaggcaagttccagaggctagcgtccattc

SEQ ID NO: 682257 - DNA, 908 bp, Homo sapiens
  misc_feature (52)..(52): n is a, c, g, or t
  misc_feature (63)..(63): n is a, c, g, or t
  misc_feature (484)..(484): n is a, c, g, or t
  misc_feature (497)..(497): n is a, c, g, or t
  misc_feature (546)..(547): n is a, c, g, or t
  misc_feature (549)..(549): n is a, c, g, or t
  misc_feature (554)..(554): n is a, c, g, or t
  misc_feature (556)..(557): n is a, c, g, or t
  misc_feature (568)..(569): n is a, c, g, or t
  misc_feature (596)..(596): n is a, c, g, or t
  misc_feature (662)..(662): n is a, c, g, or t
  misc_feature (674)..(674): n is a, c, g, or t
  misc_feature (684)..(684): n is a, c, g, or t
  misc_feature (721)..(721): n is a, c, g, or t
  misc_feature (755)..(755): n is a, c, g, or t
  misc_feature (764)..(764): n is a, c, g, or t
  misc_feature (772)..(772): n is a, c, g, or t
  misc_feature (774)..(774): n is a, c, g, or t
  misc_feature (790)..(790): n is a, c, g, or t
  misc_feature (828)..(828): n is a, c, g, or t
  misc_feature (880)..(880): n is a, c, g, or t
cgggctccgaagcggctcgggggcgccctttcggtcaacatcgtagtccacnccctccccatncccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacgacagccagccctggacatctgatgaaacagtggtggctggtggcaccgtggtgctcaagtgccaagtgaaagatcacgaggactcatccctgcaatggtctaaccctgctcagcagactctctactttggggagaagagagcccttcgagataatcgaattcagctggttacctctacgccccacgagctcagcatcagcatcagcaatgtggccctggcagacgagggcgagtacacctgctcaatcttcactatgcctgtgcgaactgccnaagctccctcgcncactgctgctatgtgcaattccacagcaagcccattcatgcactgggtnnanaaaancnntcaattacgcnncaaaaaagcacacagcccacccctaanactgctcagctctttctgggcagcaaagccctgccagccccgcgcctcaccctggcagcaaagggntgaccaaagaanctccacgcgngcaaccaaacccgcaatacaggcaagatcccaaatgnctaaaacctttcactgctcagcagctcggctganattccaggnttacccgngnaggatgatgggggcgngcattgtgtgctctgtgaaccatgaatctctaaagggngctgacagatccacctctcaacgcattgaagttttatacacaccaactgcgntgattaggccagaccctccccatcctcg

SEQ ID NO: 682258 - DNA, 639 bp, Homo sapiens
gagttttggcctcagtaactgaggtgcgatcactgagatgggaaaacttgatagagaaggtttggggaggaacagcagaagctcagcttgagacacctattggatatgcaggtggaaatgttgatagggaacgagttatatgaatctgaagtgaaaggattcagcctagagttacaagccatagggaatatttaagccatgaggagcctggatatgctgtcacataggaagagagtagatacagaagttggaaaactgagctctttatttagaagtcagggagtaaagagcctaaccaaggagatgggacaggaatggtcagtgagggaggaagaaaaccaggagagtatggtagctgaaagccaagtgaagaaaggagcatgtggtcagtgtgtcagcaagccccgttctaggttaaggtcaaaggaagacagaatcgaccactggatttagcatctctgtggaggctcctggtgagcttgatgagtggtcttaagtggagtggtagggacagagtctgactggaatgggtgcaaactgagaacagcagggagacgaatgcgagagagcaatatggcccagagaacggactccaccagaggtcacatagtgagtcaaggggcaacagcctggaccaga

SEQ ID NO: 682259 - DNA, 555 bp, Homo sapiens
  misc_feature (11)..(11): n is a, c, g, or t
  misc_feature (66)..(66): n is a, c, g, or t
  misc_feature (87)..(87): n is a, c, g, or t
  misc_feature (97)..(97): n is a, c, g, or t
  misc_feature (108)..(108): n is a, c, g, or t
  misc_feature (120)..(120): n is a, c, g, or t
  misc_feature (136)..(137): n is a, c, g, or t
  misc_feature (142)..(142): n is a, c, g, or t
  misc_feature (150)..(150): n is a, c, g, or t
  misc_feature (156)..(158): n is a, c, g, or t
  misc_feature (162)..(162): n is a, c, g, or t
  misc_feature (170)..(170): n is a, c, g, or t
  misc_feature (175)..(175): n is a, c, g, or t
  misc_feature (187)..(187): n is a, c, g, or t
  misc_feature (189)..(190): n is a, c, g, or t
  misc_feature (192)..(192): n is a, c, g, or t
  misc_feature (229)..(229): n is a, c, g, or t
  misc_feature (234)..(234): n is a, c, g, or t
  misc_feature (246)..(246): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (266)..(266): n is a, c, g, or t
  misc_feature (268)..(268): n is a, c, g, or t
  misc_feature (272)..(272): n is a, c, g, or t
  misc_feature (282)..(282): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (299)..(299): n is a, c, g, or t
  misc_feature (316)..(317): n is a, c, g, or t
  misc_feature (321)..(321): n is a, c, g, or t
  misc_feature (330)..(330): n is a, c, g, or t
  misc_feature (332)..(332): n is a, c, g, or t
  misc_feature (336)..(336): n is a, c, g, or t
  misc_feature (345)..(345): n is a, c, g, or t
  misc_feature (410)..(410): n is a, c, g, or t
  misc_feature (444)..(444): n is a, c, g, or t
  misc_feature (459)..(459): n is a, c, g, or t
  misc_feature (474)..(474): n is a, c, g, or t
  misc_feature (486)..(486): n is a, c, g, or t
  misc_feature (522)..(522): n is a, c, g, or t
aggataactcnatgcttaagaaaatgattagctttctaattatgccattaactatgagatttatancggatgtttccacatttactnaggggggttnaggtagtcaanaggctctgtgantccccccccgagccannccgcnacccgccnaggttnnngcanctgcgcgnccccnccggccgcgccncnncngccggtgtcccccccaggcgcgcggggtccccccccnttacnccccctcccganagcccgcccngnttngcagncntctnctgctgatgnagagccctccncngnangctcagacctcccacgnntggngtgccagtngntggngtgaaagangggtccagtccgtcaacatcaaaacttagatgaattggccttttctttcttcctagtagatagcngagtgtttcttccatcaccttgccaattcctagnctgtccacttcagtnattgaaaagtatttnatgcctagagtnttcaaaatgtagtgttccccagggtccacgtctctnaagccaatatacacaatatccttggcagatata

SEQ ID NO: 682260 - DNA, 229 bp, Homo sapiens
catacatgatgacctgagaggatggacacagagactgactatgggcaaatccatcaaccaaacaagaaaggggagacatagccatgccacatgaagaaacaggtcatgaaggtggagactagctctccaaggggagctactagacaaggggagctactgaccaaagggagctactgccaaggggagctctgacaaggggagctctgccaaggggagctctgccaagggg

SEQ ID NO: 682261 - DNA, 597 bp, Homo sapiens
agcgagtaagggccagagactctccgaggcggcggtggagcacagaagagcggggtcgtgggccagtgctggaccaggaacctgggcgagcagtgaggggtggcccgaggtgatctgaaggaagatttccattaggtaagtttgttgaatcagtgcgaagcgaaatgaagggaaaatggttgtgagaattatgagcagatactgaatgtaaacgcgtgtagatcctgataacttaagtgactctcatgttttccggtgatggaagaacaatgttgggattgaggaagtaaagaatgaacataaatggatcttggatttcatggatcctccagttaacgaagctagaattagatgccgaggcaaaaaggcgactaaggaaaaactcatcccgggactctggcagaggcgattcggtcagcgacagtgggagtgacgcccttagaagtggattatcctgttgccagacgctaagtcccaaaaaggggcaaagggtttgtctggatatggctgatccgagatctgggattgggacacggggactacctatagaccaggtggtgcaggaggcacaggtgtctggggtacacctggacaggt

SEQ ID NO: 682262 - DNA, 272 bp, Homo sapiens
cgacatgttttcgaccaaatactcatgtgtctgggcaacccactcgaggactgtatttgtgactacatgtataacaggttattttcgtttctgttctgtggaaagtgtacagcattccaacaaagggttttactgtcgcttttttttttggcaccccacggctgtggactggctacaatgtaccagtctgactcgtgacgctgactctacatgtcttttttttttttttttgtttttttttttttttttttttattttttttttgttttttt

SEQ ID NO: 682263 - DNA, 589 bp, Homo sapiens
ggcacacaccagtgatcccagctactcaggaggctgaagcacgagatatgcttgaacctgtgaggcagaggttgcagtgagccaagattgcgccgctgtacttcagactgggcaacagagcaagagccatcttaagcaggtctgttttctcctatgccctgagttttctgaatctctgggtttgctttgttggcaaggagccagggaattctgacctgagccagaccttaagctctatgggtatttagctggccattcaagtataaggcaaggtggtgtacctgctggcactattcagatggaggcaccaaacacccacatacctgtgccaaccagacattttccgtgagccacgcaaaggttgtcatctgtcaactgtgctactcatattcctctcagaccttcttgtgggtaagctgagtacctgaaggacagctgaacccctgtggtagcctcctatacaccactgtttaagagcctatgggaatgtgggtctgcacctttggccctcatatgatgggaccgcatttagtgcacagaggccccatcataggctgtagactcatcattttcccatatggacctgggc

SEQ ID NO: 682264 - DNA, 684 bp, Homo sapiens
  misc_feature (457)..(457): n is a, c, g, or t
  misc_feature (464)..(464): n is a, c, g, or t
  misc_feature (469)..(471): n is a, c, g, or t
  misc_feature (480)..(480): n is a, c, g, or t
  misc_feature (496)..(496): n is a, c, g, or t
  misc_feature (499)..(499): n is a, c, g, or t
  misc_feature (513)..(513): n is a, c, g, or t
  misc_feature (515)..(515): n is a, c, g, or t
  misc_feature (521)..(521): n is a, c, g, or t
  misc_feature (528)..(528): n is a, c, g, or t
  misc_feature (539)..(539): n is a, c, g, or t
  misc_feature (546)..(547): n is a, c, g, or t
  misc_feature (549)..(549): n is a, c, g, or t
  misc_feature (570)..(570): n is a, c, g, or t
ctatgcttttatcttttctttttcttgtcatgcagctcttttattgggttgttgcgttttgtgttctgtgtttgcatcattgtgtgccgtatggcctttatctcttttattagttgtttttttttgccttgcctcagtatgtttttatctatcatgttaccttaatgttatgatagctgtacattgtctaatcgtgttaagatacctgctgattccaaatgttgagtcatcttcagtggctctcttatcttttggaccttggagcacccccaccctgccccccaccgtgcccgtggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatctggacnaggtctntcttnnntgtcccccngtttttctccccatgnccnacccctgtgccgcngnccctcncctgccncgttggtgtgnttatttnntntgttagatgtggctgttttgngtagcatcgtgtgccaccctgccctccagattccggagccgtcacctgatgcaatgatgccctgcccttctccattctataatttatatagatcatattgtacggctggtaata

SEQ ID NO: 682265 - DNA, 749 bp, Homo sapiens
  misc_feature (457)..(457): n is a, c, g, or t
  misc_feature (464)..(464): n is a, c, g, or t
  misc_feature (469)..(471): n is a, c, g, or t
  misc_feature (480)..(480): n is a, c, g, or t
  misc_feature (496)..(496): n is a, c, g, or t
  misc_feature (499)..(499): n is a, c, g, or t
  misc_feature (513)..(513): n is a, c, g, or t
  misc_feature (515)..(515): n is a, c, g, or t
  misc_feature (521)..(521): n is a, c, g, or t
  misc_feature (528)..(528): n is a, c, g, or t
  misc_feature (539)..(539): n is a, c, g, or t
  misc_feature (546)..(547): n is a, c, g, or t
  misc_feature (549)..(549): n is a, c, g, or t
  misc_feature (570)..(570): n is a, c, g, or t
ctatgcttttatcttttctttttcttgtcatgcagctcttttattgggttgttgcgttttgtgttctgtgtttgcatcattgtgtgccgtatggcctttatctcttttattagttgtttttttttgccttgcctcagtatgtttttatctatcatgttaccttaatgttatgatagctgtacattgtctaatcgtgttaagatacctgctgattccaaatgttgagtcatcttcagtggctctcttatcttttggaccttggagcacccccaccctgccccccaccgtgcccgtggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatctggacnaggtctntcttnnntgtcccccngtttttctccccatgnccnacccctgtgccgcngnccctcncctgccncgttggtgtgnttatttnntntgttagatgtggctgttttgngtagcatcgtgtgccaccctgccccttcccggtgcctgtgggggcgccccatgtggaaggtatgcgccttgccccttccccacagtgatggtttatatatataaatatctatatgatgattttgaggggacatcccaaccaaaaccaaccaaacaaaaacatcctcacaactccccagg

SEQ ID NO: 682266 - DNA, 158 bp, Homo sapiens
tactctccgtgcccgtacactgaacattatcagacagatctgcccagctgccagctcccactttgctacaggggcccttccttaggagtcacccagcatgcggcagaagacaatggcatcagaattccgacactcgtcatcgcaaattgtcccccagg

SEQ ID NO: 682267 - DNA, 761 bp, Homo sapiens
  misc_feature (106)..(106): n is a, c, g, or t
  misc_feature (117)..(117): n is a, c, g, or t
  misc_feature (199)..(199): n is a, c, g, or t
agaaatccattcctcaggaaacccttaactgagccgagcattaacgacgttattacctgcgcactcactcaaggctctccttgtatgcaagacttgattcatgctncccagtcgttnatggacatcgtccacgcatggcgtcagccttcagcattacacgagtctaccgagtctaggagtccgcaagggtcagcagtgnaccctcgatcatgagtgttctctgtcgtaatattcgcacaaagctgccatagctgaatgcatcagcagccacggaacgtagtgactggcgacaaacagcaagagctaatcctacatgctgtacgatgcgtgacccagcagcacatccgcacctgtggtctgacaataactctcgtggccatcacagacggtggtcagctactccaagtcagcacgcacagcgtcaaatccgcactggaggctgacggtatcgatgatcgtctcaatcagccctctgctctccgttacctcgtcatgtgcacgtgtgtactgcatctagacttcaagctcggatactgcggtgtctgcgctccctcgtccatcgattcgtacgaccttctatcagctgctcggatctctaccggcctcagaactccatccggtccgtccgtgtctgcagctctcagtactcacagtcctcacagtacacgtgtgcacccacagtgtccacagcttggccagcagtcgtcactcctatctgtcgttccaagctggtggtggtcttgatgcgctcgccattggac

SEQ ID NO: 682268 - DNA, 149 bp, Homo sapiens
cggggagactatagaatatcccccagtcatgtctgagacaggcgcttttgctgagaccagcaattcgagacagggcctgccacgtaggggatcgtttgtcaaaagtggccccagactgatcttcggtggagtcagcctcatggatttgg

SEQ ID NO: 682269 - DNA, 215 bp, Homo sapiens
cccttttgggggggcccccccccccccttggggggaaaccccccccatttgccaggggggggggttggggggtgtagggtttttttcccccccccagcccccccccaaaaagggggcccccccacccccccccccccaaaattttttttcccccggggggggggtggggggcaaaggggtttggaacctttaaccgtgatttttccccttgggta

SEQ ID NO: 682270 - DNA, 106 bp, Homo sapiens
accacttgtgttttcgtcaccacggacgtctttgtcactgcttgtccacgttgactgtcgactgctcacctgctatctgctttttcttatctttttacttttacac

SEQ ID NO: 682271 - DNA, 1682 bp, Homo sapiens
tggcgtggtggtgcgctgagtgatcagccgcttcctgcctggattccacagtcttcgcgccgtgtagcttgtctgccccatcccgtgcgctgcccatgcctgccaaggcatgctgtgcccctggttgcatggctgtcagtgcacgctgtggctgctgaccccagctgctctgtgggctgcgtgctgcttgactcttgacttgtgtgcttgctcctgctggtgcctgacgtgattgtgctgctggtgctttggctgctgattgctcagtggagggcttttgtgcgtctcctgtggagtggctgcttggagatgcctgttgcggacctgctgctgttgctactttgtgcgccattgtggcttgctgccgtcctgacgcctgccccagtggttgcccgcggggacgcttgtgttgctgcagagggccctgtgggccttggcagtgcattgccattggactgtgtaccgttgcctgcaatgtggatggcggacgtgcgcccagcgcacctgtgccagtggcagagtcctacgctacacagaaggcctggcttgtgggtgggcttccgtggtgccccttttcctggctgtggcccagcggcccgtggtccggcgcgccatgacctgcatgtgctgtcttgagcgctgctttggccattgtggcctggcttgtggcgttgggcacctgggtgccttggcggtgggcgctccctttgcttgttccgaccgtgcgttcactgttgccctgggtccagggaagccgtatgcatttggcgccgccttggcccgttaagcccgattggcttatgcacagaggagcatagcccaggccccacggccgtcccaatgtggacatacgtgtcctaatggatcggaaggatccagagacaggcgcacagctgaacgccgagtcgatgtgtgcggcccctggtggcaaacactttgtttcggacgcaatggcacccgctgggataccccggtgtctctttccccgtggttagcagctgggccagcccctgggggaggttggttcagttggacttccgccgagtaaggggtttcccaagcgtcgcccgcgattcgcaaagatattgcacaacacggaactaacagcttcacattccaagttccgaacggcaccacacgtctggttcctgtttgcctgtaaacgtggaacacagtgagccagaggcggctctacacaaagcaagtatatgaacggttcgccgcaaggtttcttcaacgaatggcccacagggagattaccccaagaacagcctatacattcctttccggacaattccaaaggactggagcaatgagacagcgacaagctaagttgcgttcccccgttgccccggacagtaggcaacacttggtgacagccaccgcgctgtggaacttgcaggccttgaaagacatcaccttccacatggttggcttcgtgattcccccgacggggggtttccaccaatattccccccaactgtggtgtaccaacgagtcacggcgtacatcatgttcagcgagaaaacaaaagaccaggtgtttcgagacgctctaccagaaaggtgatcgggcacagacgacgagactcccgtcatagagctcagcgggcagaacgacgtaatgtgcgaagatttaccttcacacctgatgaccaaaccacagcgggaacagatcacatc

SEQ ID NO: 682272 - DNA, 365 bp, Homo sapiens
tacgtatcgccaatctcggcgagacgacgcaggaaacgctcaacgcgcagcagtttgcacaacagaatggccagcagccgatgcaacagtatcaggcgcaacagtcatacgcgacgcagcaatatgcaggtcaaccggtcaacaacactcagcctgttacgcgccccgtgccagtcctgccggtcaatgccccggcacccattccgcagacccatgccgcaccggcgagagtgccctcgaaagccgtcagcgtgtcatcgcggagtgcaaggccgcagcgtggctgctcgaccacggtcgatcccgatgatctgccgccgggcacggcgctcagccgcggctggtgcctgatggagctcaatcgt

SEQ ID NO: 682273 - DNA, 88 bp, Homo sapiens
tacatcctccgagctggtccagtgtgcagcagccgtctgagggggtgtgaggtggcgctggccgaaatctccgctgagctcattcgct

SEQ ID NO: 682274 - DNA, 262 bp, Homo sapiens
gttcttgaagatcctccaccatggtccgtgcatgccatctgagctctgagtccaggcggccccaattccccgacaaatgctgtccagctgcctcctgaggatgttgatgtacttgctcgaacaaaggctccaggttctgcctcacagtcttggtgccctgctcctgcagaacggtccactttgtatccagaaccttgtacctgctgctccaggaaccgcaccttgtcgataaaggaggcacacttgtagtagagggtctaga

SEQ ID NO: 682275 - DNA, 943 bp, Homo sapiens
ggcgttctgtagtggcagtctgcttgtggcccttgagcggattgtaatctgctggtattgcggctgctgaacgagtcgggagagggttcggcattttcgtgcgggatccccgcgaaggatagagctgcgtgccagagagtctcacccgtatggtgtgaagtgttcagatctccccagaacgacgtagtctgggaatctacgcaattcggtgatggcagccagacttgggtatatggaattagagaatagcataatagtttcttagagacttcatgggtgcggagtagatagagatagagaccatactggtcgtcttgggttacttggaggatcacaaatcagaatctcacttccgaagcgggggagaatgactagcaagtttgatgagggaactggagtctcccatatcgagcagggtctggacggtaacttctcgagggcagatactcgtgcgtacattgtgcgacttggcttcagtgaggtatgaagaccgtgatggacgaaggtgcttgtggctggacgatgatggatgatgacgatgatgattcactgattctgtaagttcacatgattctgcacatgcgattcagagtcgcagacaccaaggatcttgtgagaagtccatgctgtgacacctgccggagttggaggtcgcataatagggaatatgtggaagggcattttaacttgtgtcggacctccactggttcctggtccaaaggcaaatgatgatgaaggaagcctatgtcattgcagtggcgctgctttaaccgcgacgtcgttctaatttcaccggctcaatataacagcgggtggcacacagcacggttcgtatgacagataccttggagcggcgtgaaaacacgcgacccatgtcacacaacacaggggataagggataacacacgaacagacgccacacagaaagagagagggatgataa

SEQ ID NO: 682276 - DNA, 1333 bp, Homo sapiens
  misc_feature (1079)..(1079): n is a, c, g, or t
agcgggctggggcaatgcgctccatgacaaggctctgcagaaagcgcctgaaacaccgggctggcagacactgcgtggcgaggtaggctggggtcacccgagtcactgagcccccatccattggcggaggtgcgtcccgagtcacccagctacagtgacgggcgcgcgagcgaacggtaaatgagacgcactgcgacgagagcacgcagtacggcaagacatgcgagcgatcaatggatgtctgtcaggaacccgtggtgatgcatgtccacgcctggggatggaatgtcgtgtctcttctacgcttgatggtctcgacaagggaatagtgcaaaccgagagtacctcgtactcacagctggaggtatgcgctcacttgctacgtagagaaggtccaccatgggagcttgctaatagctagtacaggtaatcaattccgcgtcttcctcggaaggaaactgccattgcaagacggaatgtagttgccaacgcggactggtcgcgttcccagaaggacgggcttccacggcatacagatggactgtggcgcgtacttgggggaccccgagtgaattctttcctctgcacggagaaatagtctgctgcgtgggacgggccagcttgaattcacatgtgcaatgggcttcgcatgggaggcccaagcgcccaattgtaccgcgcagaaacgggaacgtgtaatagggtgcgaggtttcgcgcttgcaaattttattggcattggtgaaacttcttgggcgaggtggggctagattggtgtgcgaaattcgagatacatctctcttgtagcatgtggagattgatctagccattgacgaggatctacactttcggggaggggcgataaatcggttaggacagaggactttgaggctaatatttggcccttctgggtcggattgtcgacctaatgatgttggtacaaaaaaacttcgccaaatgtagcaccggtgggattggggcggcgttggatctgtgtcccctattagatttggccaactgtggtttgtagaacattggagatcgaaattctggggccaccgcgtccatggcattgtgggnaccttaaacagcaaaccgaacaggagtacctcgcgagtctcgtaagtttctatgacagtgtggccgctgaatgtttgcacagagccccacagtccctaggccataatgtacgcgctggacctccgcatttaccacagtctagcgccctttaaacggtctccttgggaacggtaagcgggttaccacattcccaagcgtaaatgtgtgggacgcggcgcatggatcgcccatagggctttagtggggcgatagag

SEQ ID NO: 682277 - DNA, 547 bp, Homo sapiens
acaggtggggcatctatggtgacagaactaggttccaattctgtcccttcacctgtcccaggttcctcatctgaaaactgtgacccattaaacctaatttcatgagcagctttcattaaaattgaaataatggtggaaaatgccttgtaaccgtgcttgatgtacagtagttacttagccagttatttcctctcttgttcccattcctaacaaaatggaaaaacgtttggttgctaggaaagagccttaaggggattttgttgttgtttgactctatcgcccaggatggagtgcaatggcacaatctgtgctcagtgcaacctccggcatagacaggagccaagcgtagtggtgtgcacctgtacgtaggttcagcctgttatgatgctgaggcaagacgattgtttgttgccaagaatttgagtctggcttgggcattaaatttgaacccttgcctttttaaaaaaaagaaaataaaacccgggggggggcccgggccccagtattccctatggtgggttttttcccggccccattggccggggtt

SEQ ID NO: 682278 - DNA, 319 bp, Homo sapiens
  misc_feature (56)..(56): n is a, c, g, or t
tggggccccccccaggggggcccctggtccccagaagcgggccttgggtttccagntgccttcccccccgggggcaatgggggggatgccccccggggtcctccaggcgggggttgggaaaggcctggcccccgggtggcctgggggtttgccaaaccccggggggggggggggcccccggccccccttcctgccccccgccctcaaagggggggggggccctttccccccctgggattttccccctgggagggggttccccggggttttatttggttttcccaaagcccccccctttaatccaaacggtttttcccca

SEQ ID NO: 682279 - DNA, 252 bp, Homo sapiens
aattcggcacgaggcactgcaggatccaagatgcagggctggtgttggcagacacgctccggaaattcttattcgatctgagtgtggcctagcagctgttggttactccaaagctgatatccccgccactagtgaaagggaacgctgcccccaggaaaggggtcaccaagcgttgcaccccggtcccagtcagaaggggggtcttgccttcctcttttttaaggcttcaattgaaacctgtattaattggta

SEQ ID NO: 682280 - DNA, 322 bp, Homo sapiens
taagcagcctgccagaaactcctgtgtacccacgcgcaagtgcccagagccatgtccacccccgaagtgccctgagcgctgccgcatcaccaacagtgtacacagccctgcgcaccatcagcagtgccagacagaaatatcctaccagtgacaccttccccaccctgccagccaaagtgtccatccaagagcaagtaacagcttcaggattcatcaggagcatgagaggatacggataattggctcacctcgttccacagctccacttgcatcttctcaccaaagccttccatggatgcacagggagcttctatctccttaa

SEQ ID NO: 682281 - DNA, 861 bp, Homo sapiens
gcatgccagaagcgatgggacgcgtgtgtgagcagcagccaaccagccgcggcccgaacaactgcgtgggaccacccttttaggggggccggggtgcatcccggcaagacgcggcccgctataaacgggggcgctaaactctggctttccgggatctcccgccgcaggacacccaccgccgcggagtgggtaagacagcggcgggtctccgtccaaatgttcggcgcacacatgcgcgctgcacgggtcctttcaaacaaaaatggcgggcgatgtgtgcaaaaaaacgcaggacccgtcgaaatgtgtgaaccgggggagtcgaccaaacagtgtagcaacaggagcggctccccaaaagcgagcgactccttgctatcccaagtcacatgcaaaccgccactgctctcaggagagccacaaagcgatggtgatcttcctcggcccacaacggggccaggggagacctctgcgcaggtttggcgcaccacgcggtaatcaagggctccccgggccccctctggagccgggcaaataaaaagttgcgtgaatttggtagttcagacacaggagaagagggctcgcaccgccaggagcagaagcgccagtgcgactcgccagccccggaaaggaggcctcatgtctcccgggcgcacctcggtcaccagacgtactcgtgcattgggtgtgttttgtgcctccaagaaggattcctggtattggttagttagatcacattccggaacgcacatcaggcccaaaaaaaatacccgtgctagaaatggtgctgtcgctttaccaaaaagacaggacccccctcccgtgacacactctttaaaaacattttagccaacaaataaa

SEQ ID NO: 682282 - DNA, 463 bp, Homo sapiens
actatagaggatccaggacagtcttaaacagcagctctcattgctctgcgacaggctgcagagggcagcaccaggtcagcacgcaggagtgagaagcacagtccaagtcacagaatgcagtctgagctggtcctgccacccggagagtagcgaggggcactggctgtgaatgcctgtctctggcagtggatgatttcctcgttcttctacgatagagactctaatgcctctcaggcccctgatggtctacaggccgggtgacgtaatcccaatgagggtaagaaaattattcctgcttttctccaggttataactggtgattatgtaggcttgtctgctttaatcttcttttctcaaagtctagtagaacacctgcttaacaacttcctgcccacccatcactcagacaaaaatgcagcgtcccaagaacaatggagagccacctccgcagccagacctaggg

SEQ ID NO: 682283 - DNA, 469 bp, Homo sapiens
caaggaccacattttaaatagcaaggcagtatataatttcagttttcaacctttccaagttttaaaggacttgactttctcgtcatttttagtgcacacgattaaaagaaacacattatttgccattttataatctctataatgcttacatttatttcaaatcttttctttttaaaagcaagctggatgcgatcatgttttaaactcaaaagcccggagagataaatgtggggtttgtggtggcgataattcttcatgcaaaacagtggcaggaacatttaatacagtacattatggtaagaatctgctcctaagaaccatgagaaggaatatggtcaaagtttgaaaattgttaaccacatgtaatatgcaaaaatattaatgtcgagcataaaaatcagtctcgttatggtggattatccatcgactagaaggcacctaatagaattatatgagaattatattctaa

SEQ ID NO: 682284 - DNA, 313 bp, Homo sapiens
tgtgctgggtcatctaagactctgtgctcctctcagaacagaatgcatcttgaatcctcttttgtagctaaattgaagtacgcgggatgtggctgtaattccagcacttgggaaggcaaagcaggcggatcacttgaggtcaggagttcgagaccagcctgggcaatatggtgaaaacccatttctactaaaaaacacaaaattaagccggtgtgatggcacgtgcctgcaatcccagctactttggggaggctgaggcaggaaaaatcgcttgaagaggggaggcagccaggggtaccgaagctcgaaattc

SEQ ID NO: 682285 - DNA, 435 bp, Homo sapiens
atcactcaaatagggatctcaacatcttctgtgtcaataaaaggtgtggaattagtagattcgatgaagacctgttagccgtgccacatggacttccagacgccattaggatagggtttagaagatggggaaatttagaagacgtttctgggcctgagtctcttaagagtagagatgcagaagagagagtgagaccacgaagagactggctgttgactgcagggcaccaccagccgccttggtggtggcattagttggatttggggccaacccagagttggaagtactctgggaggagttacttgaagttccagttgttgtttcactggaataaatctgcgtgggtaggagcagtgccagcagcagcagccccagcccgagcctggccaccattgctctgcccatgtcccctccgtcggtgcgcggcgcgtctag

SEQ ID NO: 682286 - DNA, 387 bp, Homo sapiens
  misc_feature (228)..(228): n is a, c, g, or t
  misc_feature (383)..(383): n is a, c, g, or t
gccaatctgaagtgggagcggcctctgcctcccgggttcaagctattctgctgccttagcctcccgagtagctgggattgcaggcacacgccaccacgcccggctggtttttgtatttttggtagagacggggtttcaccatgtcagccaggcttttcttgaacttctgatctcgggtgatcctcccgcctcagcctcccaaattgctgggattacaggcgtgacacncaacgcccacctgtaaccaattattttttaaagattgctaccaattggatagttctggtcatgggtccaaactttttgggatatttaaaaattgatccctggtggtgggctaacaggaattaaatggtttccaaaaaatggttggaaaattaatnatag

SEQ ID NO: 682287 - DNA, 114 bp, Homo sapiens
gtgtggtaacttttgtacataccaggatctagtggagctgagtgcaagcctcctccccatgccatctgcagagcctgtttggctaagatgggatgccagcgcggtatccatggc

SEQ ID NO: 682288 - DNA, 321 bp, Homo sapiens
  misc_feature (40)..(40): n is a, c, g, or t
  misc_feature (59)..(59): n is a, c, g, or t
  misc_feature (90)..(90): n is a, c, g, or t
  misc_feature (97)..(97): n is a, c, g, or t
  misc_feature (137)..(137): n is a, c, g, or t
  misc_feature (187)..(187): n is a, c, g, or t
  misc_feature (210)..(210): n is a, c, g, or t
  misc_feature (243)..(243): n is a, c, g, or t
  misc_feature (265)..(265): n is a, c, g, or t
tcctaaatttatatggaaatacaagaatctagacaagccnacaacaggtttgaaacagnatgagttggagggctcaggctgcctgatttnaaaactnactataaagtgtgagtggcaggccaggcatggtggctcanacctgtagtcccagcactttgggaggccgaggcagggagatcacaaggtnaggagttcaagaccggcctgggnaatatgctgaaatcccgtctctactaaaagtanaaaagttggccaggtgtggtgncgggtgtctgtggtcccagctactcgggaggctgaagcagaagaactgcttgaacc

SEQ ID NO: 682289 - DNA, 353 bp, Homo sapiens
gctcccatgattcccagcgttgtgcgagggacccagtgtcagataactgaatcatggaggcgtcttcccccatgctgttctcatggttataagtctcatatgatctgatgatcacataatgggtttcccctttcacttgattgtcattctctctcgcctgccaacatgagacatgcctttcagcttctgctgtgatgataaggcctctccggccacatgaaagtgtgtgagtttattatgcctctttttcatagtaaattacccagtcttgagtatgtctttatcaactagtgtgaatcatggactatgacaccctgtccccatcatctctcttgtccaatgctgcatcttta

SEQ ID NO: 682290 - DNA, 1814 bp, Homo sapiens
  misc_feature (625)..(625): n is a, c, g, or t
tggttgtgttgtgtttcgttatctgtggattcgtatgttggtgtgttgtgagtgtgtgagtgtaggtgtattgtgtagtagctgtgtgatttttgtagtgtgtgttgtttgtggtgtccagttgttatatgagactgggagtatgtgcattgagtgaagtagtgcatttgtgctgtgagatattttttctgtatagttcatgcattgtgagttatgtctataattgattggttgttatgtgattgtgttgtgtgtagtgtatcgttattgtggtattgttgcttgggtgggattcggtgagcttagtaatggtagtatgtgcagttatatctggttgcgggtttgtcgcgttgtgtggacgtttttctcgtcgtctcctgtttgtcgtccgtatagtggttcgtctattgttagctcatcctgatttctgttgtcgcgacgggcgctctcgcctcgtagcgtacctcgtccggctgtctacgttcgatcgcgctgcgtgttgctgtacgggcctcgattgctgctgttcctctcgttgtggtgtgatagttgtctcgtttgttgctgctggatgtagttgagttatcgtttgtctgctcttgtgttttgcatgatgtctgatatntagattattttcagcgcctgcgagagttgcgcgtggacgcactgttattgtgcgggctactcgttggtatctatggtcgcctcgtgattgtatgtatcgggggccgcccccccaggggtgtgactcgggccgtggttcctcttcttcacgtgcgataaggcgtggttgccactaaccagggggggcacccaccttaaattctggccgttgccgggctgttggtgggccaccccgcggaggccatgctgcccagctgtggtggtctcccacgccctaggctttttcgggcttgcgtggtttgcgaggcgccttcgccccctctggggacgtttgggtgtcctgtgtgtctcccgatctttgtttccccgccttttcctggtgggttgcccacctctcccggtgcgcctcgccgtgtgtgtccggggccccatcgagatgtagtgggcttttgggttgctgaagccccattgctcgaggaggatctgctgctttgggagttgtgcccttgtccgggtgtctggtctcttcggagcctttcgccccggtttcgcccacgcctctcaggacccctgtctttgggttttagaagagcccgagtttgtggggaagaaccgcaggcgacccagcctttgccagaccgattgggtcccgttttagcgcctgttggaccacccagcctggggggatcccagggtctcaggcgcccctccgtcggtcccccagatgttcgccgtcttgcttgtgtggttttgggcgtggttctcagtagtcttctccacccacgtttaaggatggtcttttaacccgtggacgttccagagatagatagctgggggtagctcctgggccatggcccaccatgtgttacatagtgaccagaacatttgttgtaccagcgcaccaaattgtaagtgttataataaaacccccagtggactggtgattgtaatagctgatcgtgactgattaaggtgattttataattgtataatgacttcagagacgcgtatgttaataaaaggaccgccctccctcccagtggtgccacatcccagttctacccccgagggtcgggccggttgaccatatttatttttgtctattttgtaggcttcccagtccccgaatcctgcttaaggttttagggtacccttccagtactttttgccaataaaagtatttcctatcc

SEQ ID NO: 682291 - DNA, 182 bp, Homo sapiens
  misc_feature (23)..(23): n is a, c, g, or t
  misc_feature (42)..(42): n is a, c, g, or t
  misc_feature (99)..(99): n is a, c, g, or t
  misc_feature (139)..(139): n is a, c, g, or t
  misc_feature (158)..(158): n is a, c, g, or t
  misc_feature (177)..(177): n is a, c, g, or t
acacccatgcccgggcaagaacncaggacgctgaatggctcncagatgctcctggtgttgccggtgctctcgtggctgccccatgggggcgccctgtcnctggccgaggcgagccgcgccaagtttcccgggaccctcngagttgcacaccgaagacnccagattccgagagttgcngaaac

SEQ ID NO: 682292 - DNA, 280 bp, Homo sapiens
aaattccagctcggtttccttcccagtcctgttgagttcacgccattcttctgcctcagtctcccgagtagttgggactacaggcgcccgccaccatgcccgactaattttttatatttttagtagagacggggtttcactgtgttagccaggatggtctcgatcttctgacctcgtgatccgcctgccttggccttccaaagtgctgagattacaggcgtgagccaccgtgaccggccagagagtgcactattttttttttttttttttgaaacggatt

SEQ ID NO: 682293 - DNA, 458 bp, Homo sapiens
cagcctttctccccagcatacagtgagctgccttttggggagcaatgccatgatcaggagcatacgtgcatgttttccgtactttcagaatagagtgccttagctaggccagaggctcgtattgtgtttctgctgaccgcagttgcatacacctgttagaagtgtctttttaggttatggtattacagaaagtcgtttcaggcttatcagatgatacttctcctatatttgaggggggcctgggattaaaagatttaatactacctggatagagaatggcttatgcggccgtttgcgctcctttaatcttatccatgcttttatttagtccagtacacattttgtcattgccacagtttactgtgtcattcttccccgaataggtaattgatagagtttatgggttttagtattaagggtaacagagtgaataccttccaaataaaaagataaatatt

SEQ ID NO: 682294 - DNA, 654 bp, Homo sapiens
  misc_feature (19)..(19): n is a, c, g, or t
ctgaccccaatgactgtcntgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctcgggaggctgaggcaggagaaccacttgaacccaggagctgaaggttgcagtgagctgagatcatgccactgcactccagcctggacgacaagagcaagactctatctcaagaaaaaaaaaaaaaaaagaattcaattgtattagtctgttctcacactgctataaagaactgcatttcatttatagcacagtgctttggttttgctttgctgaaaagttcaatttttaaaaaatgtaccagaaagtggcagtatcttggctcactacaacctccacctcctgaggcaggagaaccacttgaacccaggagctgaaggttgcagtgagctgagatcatgccactgcactccagcctggacgacaagagcaagactctatctc

SEQ ID NO: 682295 - DNA, 334 bp, Homo sapiens
  misc_feature (52)..(52): n is a, c, g, or t
  misc_feature (56)..(57): n is a, c, g, or t
  misc_feature (59)..(59): n is a, c, g, or t
  misc_feature (78)..(78): n is a, c, g, or t
  misc_feature (80)..(81): n is a, c, g, or t
  misc_feature (282)..(282): n is a, c, g, or t
  misc_feature (319)..(319): n is a, c, g, or t
tgctgcctcggacttggacctgctgctgacatgaacaacgcgcgctacctgngggnncngactttgcgcgcgtcaccntnnacccgctgcgggtgctcggggcgctgagggagttgcgggcgacacggtctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgctnttccggcagcacctgctgggcaccttacccgagcgcntcgtgcagcacctgt

SEQ ID NO: 682296 - DNA, 1104 bp, Homo sapiens
ggagagagaggaactagtctcgagtatttatatgtttctatgggtttataaaccctttattaaggtgattccggggggtaattccccacctaagtgcacagataaaagcgaggtattcctgggtataatggcacggaggccagtggggttacatgggtgtctggggcactgtggccaaggggcgatgtaccaaggttttctagagtcagacccggccagagaccctgcgctgaagtgtggactattgtcctaacattgcccgctgcttactcctcacagttggccacagccgacaaggacattctctttcaacagtataaactcatttcagccgaagtgtttaggggaaccagaccgttaacacgcaattgtgggaaggctggtgctccgtgggtgcggcctcagacgtgatggcgtgacttacaataagttcataacatagcatgtgtggtaaaccacaagagtttgtcagagacattagttcgcagtggtaagccaatgtaggagcccacagaaggccgaatacaaagctcgtggtgatcatttcctcgccctacgagtggacgcctccttgtggccgtgtgtgtcattcccaaattaccgtgaaattccccagtgttttataaagcaccggggtgggaactcccgtgacgtgcgtggcacgttcttccagtggcgcactaccacagggaaacagacgctcttttctcccggaattggcaccacagaagctatctctgtgggccttcccaaggaaaatttccccatttcaaacggagaatatttccctcgttggcagttgtgagtgggactcactccaaagagaccgaagaagggctacatccatgagatagcgggcagtaacacctccctcgtgctcgcaacaaagggagcgcctattacgaccccccttgaaacacaagtgtggcccctaaatgcggacagggccctcacattttaaaggaacagcatgcggcaacttaacacaggccaacgcccgacaatgtgtgcaaatcacccccattcgtgggaaagacgaaaaactccccagaaagatcaataagcttcaacactcttccactcattggggggggcccaaatcaa

SEQ ID NO: 682297 - DNA, 739 bp, Homo sapiens
  misc_feature (655)..(655): n is a, c, g, or t
  misc_feature (683)..(683): n is a, c, g, or t
gacagagagactgcaagcgaggaacttgataataaaagtgtagcagagattatgaacagcattcctcctcccccgcctacagcattgaccactgaagctggagctcctcggcttatgataactcatatcgtagaccagaacttgatatcctatgctggggagaaataactgggaccgttacataagcgcttttcctgtattatcagggccacatgggagaggcgaatccaatgtgattgatactatgctttctgtgtctggctatcgagcacaactaataagatctaaaaaactctcagtgttaatacatacttctgatgaacacacggacattcatagttgtacacgagaaggtcatcttctacagataattgataatgaaaaggatgattatgaagtcattcctaacactgagatctatgtatccagagcgacctgcagagaaatactcctgtctatcacataagaggaaggagaaagacatttaaggatgttgtaaatcttgttcgaagccatgggattgacttggaccatactagatatttaattctacagggtgaagttgaacaacttgctgtgatgagaccaaaaggccagactgaacactatgagggcatgcttgaatatttagaacatataattgcttgtggacgcntaaatgaacctatcttaagccttgtgtnggagagtcgaaatattaaatgaacacacaggagaggttcagggtacagtggttggg

SEQ ID NO: 682298 - DNA, 130 bp, Homo sapiens
tcagtagcggagcacgcctgctggggtatgttgtgttgttcatgtggtgggtgagtgagccccattgtgttgtggtaaactatgtcgagggagtatagggctgtgactagtatgttgagtcctgtaagta

SEQ ID NO: 682299 - DNA, 109 bp, Homo sapiens
cccatgcatataacataccgagatcagacgagatcgggacgcagtcagggtggtatggccgtagacggcagaggcaggaaggcttccatgcttctgcccctcaccaaga

SEQ ID NO: 682300 - DNA, 1057 bp, Homo sapiens
gagcagatcttctgctcttcccagtagcatcagttaagacatcctcgtgatgtcctgctgcactctacaggcaaggatgagctcatacacttgaacagctttactacttgcgatcctgcatgtctgcggtcccaggcattctccgttagactcgcgaataatggctgacagcgcaatgcatccgaggagtaggcgcatggcgtgccaaacgaggctaggggacctcttcagcagtgatgattgcggaagacgatgttctaagcaagatcacgtgttgcgagttctccctgtgcctggagtcagtaccttaggcctcggcgagcggcgcagtgtagcatgtccctatagtacgttccccttgcgagcaagaaagcatcgccacgtagcgaggcaccatggagaggtgccacgctttgcattcaacttattgggcccttgaggggaccaagatcgcatccttgactgccaatagacgccggtcaaaggtgaacccatagcttagttggcccccccaggacttccagaagcctgtgaagttgtgaaggaaaacaccaggagaagacatcacgttctaaaaggttcgacccccttcgatagaggttacctcgtgaatagcattgcctagaattagcacaaccacccaagcgacaagagacacggaacgcgaggaaaccggaccaagaggcccctagtttgaaggcccacccaagacacaacagggttcctagatcagagttgggtccccaaggtcgtagcggcaacagtcttagccccccgttggggcctggagtcccagaattctaaagcattcccttggacttgaagtggaactcgtagaccaagcgtcaattagcccttttaaggccgaaacctttggatttgaaggccctccctttggtggtcaccccttcccaataccggattatccctgtggccttagttcactagccagagggacattcccgacaaagcgttgggtggataggtttgggtcccaaaggggcacactagggggtgggtcggaaagaggataggaccatcgctgattagccccaca

SEQ ID NO: 682301 - DNA, 940 bp, Homo sapiens
ggtaaatcgcccaggaagcaactggctacaaaggccggctcgcgaagaggtgcagccctcatagcatggcaggggtgtaagataacctcatcgtttaggcagagcactggatactgtgtgacgctctcagtgtaaattagtatgttctcatgaaggttccatcatgaatcttcgtgaatgcgctaaagttcccttccagacagttctggtgcgcaagaagttgcttcaggacatttataatgcaagatctgcgacttacctagagatcgcgcgcataatgcggtggcatttgccgggcagcgtcaacgtgatggacgtatcgtgtggtagagccatgcttggatatgcactggcagatcctagtgttggttattccaatagaccaaaaatgtggtagccaaatgtgatgcacagagggaccatccaatgcatatgacaccggctcggcaaatagacgctgggagcaaacggatgacttaaagaatgtcccagcctcaatgcatgggggaagactaatttacgtttccatccattaaaaaaacgacttgtaagggtgcaatttcacaaaatacctttttgtagaggggcggatcctgtgcgtaccccccaggagcaaattcactgcgaaaggcccagcatctcatgtgaggcacccgttggagaacctccccatggatcggccagggcgcagcacactttcggcgcgtctccaagtttagagatggcccctaaggagtgaaaacgccgtttggtacctaaagaaccggttcgtgaccggaggagatttgcgaccccgcacctatactcatgcagaaggctggggtaggggattgaaccacaaagttttgcgtagaaaaggcaattcccaccacctttggtacagtgttggtcaacaaggtgtggaacgagcgggactgctaccccggcacagggcggaccc

SEQ ID NO: 682302 - DNA, 410 bp, Homo sapiens
tgcactgtacactggaaaatgattaagctgtttctcaggcagaaggctaagatcacgtgcaaaaatggataaaaatgataaatttgacactatatatatttaacacaataaaaatctaaatgattaaaatggtatatttagtgtacgtatattttacaataaatttttaatataaaaaagtggggaaaagagagagagagatgggacagtcattgtgatcacatagacatacatgaaacaaaatttctctatggagagacttgaacatggaagtctgcaaactcctagctggatctgacgttagatctaagttgaacaagtttctggttattagataatgtcttgtactgaacaaaagaataactcagagtgctaaattgctgccctttgcagctcctcaaaaagttaaa

SEQ ID NO: 682303 - DNA, 422 bp, Homo sapiens
ctactgaacaaaatattatgtggagaaaagctgatggatagattgtcccagcacatcactctctattattttatatgtgcggtccgttggctgtcaaaagggaacatgctggggccgcaaaatgaaatacttgtaaatgtatattgtaaaatgttttgtgaaatttattatagaaaaaaaatcttactacattaaaaaaaatctggtgtgaacatcatacgactttccttatcctcaaagcggtcgaaatcacgcagccagaagcacacaataaaggaactgatattttgacattgaattaaggatgttaactactacttctaggggggggggtcaactctcatacatttttcgatatctctaaccgtttagctgcaacagccatatttgtcgcaaaagtcggttgaaatcacgccgtccgg

SEQ ID NO: 682304 - DNA, 189 bp, Homo sapiens
acatcagaggacaacgatagcctatgagtgcgacacaaatacagcttgctctatcggtaaatccatgctaactcctagcgagagcaacataaatcctcacactaaaggctctactagcaatgcaaagaaaaccaaacccagctgggcgagaggcctcacacctgcaaccccagctgctagagaggctga

SEQ ID NO: 682305 - DNA, 793 bp, Homo sapiens
tacgtgaaagtatatcgtatggcatagcttaaacagttatcagcggtagctagtgtatatcctctcgtcacacagatctctgatagcaacgtgtcagctcttctagagagaggtgagagatcttccataaggcttcagtagctcgtatgacgcgtgagcgtgtgttcacgagatcggagagacacgtaggtgtgttgattgatctctcctcgccagagagtgtgcatatatgtgcatctaaggttcatataacagcgttcaactctaagtgaaagtatgatcatcgtcttacagagctatgtagcatgatcagctctctccagtcattgtgctcagtatgtcgcatgtagtcaatggcggatatttgtcatgcaacactgagccctgttagagtaacatgtatctatagtgttgtgcacagcgcatcagtctgttcagattgttcacaacataggatcacacttatcttaggtgtttgagtcatatacatagagctgtagtatacacttcgcgctatgtgtaggtgtagccagataatagatcattatgcgatatgtgctctaagatatgctatgatagctcactaatttgtgtcatgagatatgaggctatccacaagaggtgttattgagtgtggtgagtcatgcaagaattgtgatagtagtattatgcctcagagtcacaggcaggctgctattcactcatctggacagtcatcattcgtatatgcttcatagtctgagccgcatgaatagatagagatcaatgccgttatgtcacgatacattcggcc

SEQ ID NO: 682306 - DNA, 355 bp, Homo sapiens
  misc_feature (1)..(1): n is a, c, g, or t
ncattatacgattcgtgctcggtacccctctgatcaggctgatgctcacatgctcacttgtctattctccacgaaatttagttttattagtagtcctaaagtgttgatctcaaacaagtacatcagaaaaatcatgttgctttctctcatcttactttttcttctcagatttctcccttcctagaacatttctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctg

SEQ ID NO: 682307 - DNA, 240 bp, Homo sapiens
gagccggtaccgaatctcgacgagtggtgcctgtttcctggctgtgtctatcacacttcgtatatatcaccttcacctctctgtgttctatagatttgtgcaaagagcgggatcgatttagaagggttatcaaagaagctgttattaaattgtggtagggttgattattattctcaagatggtattgtttaatgttgaggtggcaactttctcctctatggcccttagagcgttggcctg

SEQ ID NO: 682308 - DNA, 645 bp, Homo sapiens
  misc_feature (11)..(11): n is a, c, g, or t
gagcagaagancgacgaggatgactagacagcaaaaaaggaaaagttacactaaaaaaaaaaaggccgccgtgacctattcaccctccacttcccgtctcagaatctaaacgtggtcaccttcgagtagagaggcccgcccgcccaccgtgggcagtgccacccgccagatgacacgcgctctccaccgaccccaaccccaaacccatgagaattttgcccaaccaggggaaggacaaaaagaacctaaaattccaaggccctgcttttatttcttaaaagtactttaacaaaggaaatttggttcggtattccttctattatcacattttatatataaggtacatcatcgttcagggtcagccattttaaatgatctcggatgaccaaaaccagccattcgcgagcgtcctctgtccctactgtctgactttactcgtggtgtggaccatgtccattatcaatctcaaaggagcaacccaaacaccctgtgtaaaaacaagccaaaacatgaccaaccgacaaacaccatcttattccgagcataccagacaacttcgggggtatgtaccttagctggtcactcatacaacatagatagcggcagcactagcagccatggttactacaggccacaacataacag

SEQ ID NO: 682309 - DNA, 381 bp, Homo sapiens
gaaccagttctacaagtgactgtgttttgtattactgcgaagatatggaaaatgtagtgcattaccaatttaaagtaattgtaataataacgtcttgatttctacattccttttctgaaccttcttggaggtttcctttcagaagcaacttttccatgctcttactacaaattcctttttagtaggaatccagaagtgttagattgaatgggaaagcgcttaatgcatccgggcttggggtcacagatcgaaatgtctcctgtgtcacatattctggaggttacatctttctgtgacaacagggagtttccttatgcattcttcatttgctgctgtttaagttgacaacttccttcccaataaaaattcacttacacctcc

SEQ ID NO: 682310 - DNA, 623 bp, Homo sapiens
  misc_feature (553)..(553): n is a, c, g, or t
  misc_feature (579)..(579): n is a, c, g, or t
  misc_feature (581)..(581): n is a, c, g, or t
  misc_feature (601)..(601): n is a, c, g, or t
  misc_feature (613)..(613): n is a, c, g, or t
aataccccctttcttggtttctctcttccccctaaaaaatcatttttccccggttcccaattgcttcttgtctccccaaaaaagaactttttttcatttatccccccctcccgttccccctttacaaatccccttcctttcttttcattctcccacatcccattccctctcagccttttcattttcggaagcctccttggcaaacgcctcccacttctcttctccagtaacaggttgtctctttcttccatttccaattctattgctgcccctgccactctctccatcagtacggtgctcttacatatccttcatcctctattgccatcctattctctctaaggtaatcctcctcttcctcttccaccataccagcaccctgatcccttctctccccaatatccaaatttctccttgtttctcagctgttctcttataaacattgtttctccctgtacactgccctctccaaatcacatgatggctttgtctttcctcctcctcgcaaacaactccatcccatttcaatataaataacatcttattttttccntatccaccccgcagggttccaacccngnccgttcagtcatcattaacngccgccgcctgnggattgaata

SEQ ID NO: 682311 - DNA, 391 bp, Homo sapiens
tcaagtgatcctcccacctcagcttccgtagtagctgcaactacaggtacatgccaccacacctggctaattacttttaagtttattgtagatatcaggtcttgctatgttgcccagactgatttcaaactcctggattcaagcgattctcatgcctgaggcgactctcatgcctcagcctcccgagtagctggaattacaggcatgcaccaccacgcccggctagagtccttgtctcttttaaaaaaaaaaaaaaaagaaaggcctggagcagtggctcacacctgtaatcccagcactttgggaggcctaagaggcaggatcacatgaaaccaggagttcgagaccagcctgggcaacatggcaaaatcccatctctacaaaaaagacc

SEQ ID NO: 682312 - DNA, 985 bp, Homo sapiens
ggagagagagagagaactagtctcgagttgttttttttttttgggtggcgttgtttgtttaaactgaccacttggaaaaaaccccgtggttatctggtggattttcattgcccgttgctcccgtgcctctacccccacccctttttgagtcgggtgactcatttttctctgtgctagagactcggtggcccaggcaggaggtgaacagcatgccactccggaaggcccgtggggacccttgtgcctgtgctcgccttcaggtcaccagctgagctgcgataggaacaactctgatatggatgtcagcaaacagccaaaacaaatctttccccacccggccctgtgctttatgaagtctttcttcccccaacttcttgaacgatgatgattattcagacaaagcattggatgcttatggacagcacaagaaagaaacaacacaaaaaatatattatattatgtccaaaaacgagacaaatccaagggtgtgaggtaccacgagtgtctgcatttagattcccacaaaaccacaaatccatgttgcaacaagagttcaagtccgtacacgtgtgacttttggggtagacccgtgtgtgtatagacatgaagtgtgtgtgcctcaagccctgtttccctgtgaagatacttacgagtgcgcaaccatatttctccaggtgaaccaaagcgtctcgaagcacaagacaggcctctcaagggccatagactctcacgctattcacgtggttaacccggaacaaatgtcatgaactgtcgtaccccggtggtgtctcccgacgcattttggtctaccttgagccgcccccttgtgttttgccccagacaaccactggggccccaacgtagaggttttctactcttaatcatctccagttgaatatcccccatttgcaccggtgagacactcgaggggcctacttctctgccccctttacattgacggctgtctcggcacccgtttgctcct

SEQ ID NO: 682313 - DNA, 416 bp, Homo sapiens
  misc_feature (8)..(8): n is a, c, g, or t
ccacgatnccctctccctctttccacggtctccctctgatgccgagccgaagctggactgtactgctgccatctcggctcactgcaacctccctgcctgattctcctgcctcagcctgcccagcgcctgcgaccgcaggcgcgcgctgccacgcctgaccggttttcgcatttttttggtggagacggggtttcgctgtgtcggccgggctggtctccagctcctaaccgcgagtgatccgccagcctcggcctccagaggtgccgggactgcagacggtgtctggttcactcagtgctcaatggtgcccaggctggagtgcagtggcatgagaggatgatgggaatccctggtcgcccgtgggccctggcaagaccccactcccagacctcactaaagtgatcgtggggttgtaa

SEQ ID NO: 682314 - DNA, 865 bp, Homo sapiens
  misc_feature (322)..(322): n is a, c, g, or t
  misc_feature (340)..(340): n is a, c, g, or t
  misc_feature (354)..(354): n is a, c, g, or t
  misc_feature (364)..(364): n is a, c, g, or t
tcctgggactgggtgagtggcgtcgtgcccaccatgcacttaactatcgctgagggcttgtcaaggccaccacagtgggccagatgggctgtgcttcctcatggtctgtgatgtacatcactggagctggcctttatgctgctcgaattcctgagggcttctttcctggaaaatttgacatatggttccagtctcatcagattttccatgtcctggtggtggcagcagcctttgtccacttctatggagtctccaacttcaggatcgtacggctaaaggcggtgtacgatgacacctttctctgagcttccacctgcggggnggaggaggaacttcccangtgctttaaaatantcttgctgangtgagagacgagtctgatgtctgttctagaagaactctaagaatcagtacaacaagcttcagccattcacacccatggcaataattccattccatctcctactggggatggggctggcaacttagcatcccctcctcagaggatctaccgccctcacagagacgattgaactcatgtgagattacctctcctcaccatttggaaatatggaacggactcttcgaaaatctgtctttcttctgagaacatgtccctcccttaccctatccttaacttgtatcctggcttataacaggcatccattttgtcagcacacttttcacacaacaattatatacccggtcccatctttctagggcctggatctgcttatcgagccaggaagaatagagccaccaacttttagcttagccgggctaatcatggaacgtgtgtcccacggttcaaggtaaccttgagtttaaaattgttctattggcagagtaatgtaacatttaaagg

SEQ ID NO: 682315 - DNA, 549 bp, Homo sapiens
  misc_feature (474)..(474): n is a, c, g, or t
  misc_feature (476)..(476): n is a, c, g, or t
  misc_feature (480)..(480): n is a, c, g, or t
  misc_feature (499)..(499): n is a, c, g, or t
  misc_feature (504)..(504): n is a, c, g, or t
  misc_feature (520)..(520): n is a, c, g, or t
gagatgtgcggcggaaacgctgctgtccgagttatgttaggactgctgcttctgggactcctgtatacccgcgaagtctgacctggtggtgtcgtggagcctgaatcctggaggagctgagtgagatgcgttatgggatcgagatcctgccgttgcctgtcatgtgggacgtggcaagagcgcaatcttcaggacggtgtgtgattggtacgtccgtctaagtacaaacagcgctatgagtgtcagcctgccagactggagctattcagttccagcgtgacagggaggaggaaacaacctgcttaccaagggcctgggatccctgaggttgttgagcccaatgagagatgctccctgcttgctgaagacgaaggactggtggacatatgaatactgtaatggacgccacatccagcaataccacatggaagattcagagatcaaaggtgaagtcctctatctcggctactaccnancagncttcgactgggatgatganacagncaagcctccaagcagnatcgtctatacgctacaacagccagacct

SEQ ID NO: 682316 - DNA, 141 bp, Homo sapiens
tctgacgcagtcgcgtggcatgcatagtcgtggctgtttgtgagatctgccacctgctcctggttcaattcatccatgtccacctccacgtcgatgtcggggatgacctcatcttcgtccgagttgcgctcctcctcagct

SEQ ID NO: 682317 - DNA, 168 bp, Homo sapiens
actgcatccaattgcatgccattgcacgccgggcagcttcctgtgaaaccaaagtctttggtgttcctggggggagtatggtatgcaaatgctgaaacttaaatgtgaattgactggaatgtggcaccaccatgtgatgatggatgcctgctgtgctgttgataagca

SEQ ID NO: 682318 - DNA, 310 bp, Homo sapiens
  misc_feature (46)..(46): n is a, c, g, or t
  misc_feature (142)..(142): n is a, c, g, or t
  misc_feature (229)..(229): n is a, c, g, or t
  misc_feature (279)..(279): n is a, c, g, or t
tttaaacgttataaataaaaatactatgctgcccgggcgcggtggntcacacctgtaatcccagcactttgggaggccaatgtgggtggatcatgaggtcaggagttcaagaccagcctagccaagatggtgaaaccccgtntttagtaaagataacaaaaaattagctgggcttgatggcatgcgcctgtaatcccagctactcgggaggttgaggcaggagaatcgnttaaacccaggcggcagaggttgcagtgagccaagatcgcgccattgcantccagcttcagcaatagagtgagactgtctc

SEQ ID NO: 682319 - DNA, 117 bp, Homo sapiens
  misc_feature (2)..(2): n is a, c, g, or t
antactccttgacgttccgtcgctggtatcgcagcgtggcggctcagcaagcacaatataaagaccaggtcgctttctttcacggctgcttcgttaactacaaccatccgcagttag

SEQ ID NO: 682320 - DNA, 460 bp, Homo sapiens
  misc_feature (91)..(91): n is a, c, g, or t
  misc_feature (167)..(167): n is a, c, g, or t
  misc_feature (202)..(202): n is a, c, g, or t
  misc_feature (291)..(291): n is a, c, g, or t
  misc_feature (296)..(296): n is a, c, g, or t
  misc_feature (425)..(425): n is a, c, g, or t
  misc_feature (453)..(453): n is a, c, g, or t
  misc_feature (460)..(460): n is a, c, g, or t
gtctggaggatgcctctcttcgaacattatacaagacaggttgtagattgcagctgctgatgttaacaacattggaaaatacagatctgcnggagcatgtacagctgcagcattcctgaaagaattcgtaactcatcctaagtgggcacatttagacatagcaggcntgatgaccaacaaagatgaagttccctatctacgnaaaggcatgactgggaggcccacaaggactctcagtcatgcctttccgtagatagggaaaggcatgactggggaggcccacaaggactntcatngagttcttacttctttcaatcaagacaatgcttattcagatactcaaaaacgtttcactctgtcttaaatgaacaattgaatttaaaagtttttgaataaatgatgaaaattttttaactggagaccanaggatggtattttaaaaaattgtaggancacaatn

SEQ ID NO: 682321 - DNA, 105 bp, Homo sapiens
agagagagagggaggagggaggttcctcctgtcccagaaacccttaagagagagcgagggaatttcgcagagctgtaggatgcaacgcgcctatagaagagaggt

SEQ ID NO: 682322 - DNA, 401 bp, Homo sapiens
  misc_feature (91)..(91): n is a, c, g, or t
  misc_feature (167)..(167): n is a, c, g, or t
  misc_feature (202)..(202): n is a, c, g, or t
  misc_feature (232)..(232): n is a, c, g, or t
  misc_feature (237)..(237): n is a, c, g, or t
  misc_feature (366)..(366): n is a, c, g, or t
  misc_feature (394)..(394): n is a, c, g, or t
  misc_feature (401)..(401): n is a, c, g, or t
gtctggaggatgcctctcttcgaacattatacaagacaggttgtagattgcagctgctgatgttaacaacattggaaaatacagatctgcnggagcatgtacagctgcagcattcctgaaagaattcgtaactcatcctaagtgggcacatttagacatagcaggcntgatgaccaacaaagatgaagttccctatctacgnaaaggcatgactgggaggcccacaagactntcatngagttcttacttctttcaatcaagacaatgcttattcagatactcaaaaacgtttcactctgtcttaaatgaacaattgaatttaaaagtttttgaataaatgatgaaaattttttaactggagaccanaggatggtattttaaaaaattgtaggancacaatn

SEQ ID NO: 682323 - DNA, 92 bp, Homo sapiens
gcattcggcacgaggaggcagttactacagtggcagggttcttaataacaaggtctacctagcatgaaggatttaacattctcccatccctt

SEQ ID NO: 682324 - DNA, 672 bp, Homo sapiens
cgtgtagcggtgatctgatggtggtgaattctatcagctttggttatgtgttaaaaggccttatctcatctacactttttattgtgacataattcatataccatacaattcacccatttaaagtgcacaattctatggcttttagcatattcagagttatactaccataatcaaaatcaattttagaacactttatcacccccaaaagaaaccttatactcattagaaacaacttctgattaagtgtaggaggaatggggtatagggagagatttgttacaggatacaaaactatagctagataggaggaataagttctaatgttctataccactgcagcacaactataattaacaataatttttagtctccagtaactaagaggatactaaatggtcccaatgcaacaaaataatacaatttgagatggatatgctaattaccctcatctgatcattacacattagagtatcaaaacatcatcactatgtaacccataaatatattccattattatattatgtcaattttttaaaaaaggctgagtgtagaggcatgtgcctatattcccagccactcaggaggctgaggttggaggactgccagagcctgagttcaagaacgcagtaagctaagatacaccactgtgtccagcctgggaaccaagatcct

SEQ ID NO: 682325 - DNA, 837 bp, Homo sapiens
ggtgaggaggatggatcacctaaggtcaggagttcacgaccacccggggccaacatggtgaaaccttgtctttaataaaacagcaaagaattagctgggcatggatggcgggtgccgtgtaagtctcagcctacttgggaggctgagggaggagaatcgcgttgagccagggaggccgaagagattgcagtgggccgatggatcacaccactggagctccagccgtgggcgacagagtgagactcgtgcctcaactaagaaaaaccatagaaaagcaagaaaaaaaaggaagggggtgggccgccgagcgccgaaggaaggtcaacaccctcctgtaggggcaggggccaccgagcatccggaatgaggggagaacggcgtcccgaagggaagatctggcgtccagaaggcaggggcggggattgcacacagtaaaaagagctggggggacacagggagtttcggacaggatgccagagaggaagccgcaggagctcaggctgctgcaagccgagctctccaggcggacccatataacaattggctccggggcgggggaataaagcagcacaaggatgaagtgaagacatctgctgagactcatgggcataccttatctagatgcgccaagtgagggaacaagccagtgtgagcctgggaagatggcacagctaatcctgcgggtaccgacgaagtgggatgccaacatccggagccgggcatatggaaacgatgcaacgaagcacagcgccaacacggatacactgagccgattgacaactgggcgacaagaaacagcgggacgggaccggaaagcggacaggacaaacagcgagc

SEQ ID NO: 682326 - DNA, 491 bp, Homo sapiens
gggtgccttgggttcacttctaagaagatactactacatgggggagaaatgggtgggctcagcaggacaggtctggcgcctgcccttctgggctgcttgggctggcgaggtgagggtcctgtgctgacctctgccatggcctgccccgtacacattatgagcgtaggagcctgctggtgacagacctaggagacccattccattcatgcccagaatcttttcaggacccgggtgccaagggcagaatgtggggtatgatggacaatgccctctccccacccttcaaggggccgggggttttcttaggtgaaaggcccctttggccgaaatcttggacttgaggggccaaattcccttttggtgaggtggggtgaaaattcgtaaatcatgttccaaacctgcttccctgtggggaaagtggttatccgctttacaatttgccccaccacattcccaaacccggagacatataagtgtgaaaaacccgggca

SEQ ID NO: 682327 - DNA, 864 bp, Homo sapiens
  misc_feature (430)..(430): n is a, c, g, or t
  misc_feature (739)..(739): n is a, c, g, or t
tggaactgtccagtctggtgtccacaccagggaaacgtctggcttccagtatagtcagcctcatattccacttaccgacaaatgttgtcgatacactccaaagggtgcccatgtgtacactttggttaacctacactatcctaacacactaggcagggggacgatcacatatacccaagacaagtactgcaggacctgtgggaccccgtgcaaacctgaaatcgaacttgggactacgacacacatatagtatagcgcaagcgccacaactaaagatatatgtatagtcatgatcggtctctgccttcgatagacgcccgatagtaacaagtatcctccactcacactagtgcccggggacatggacacactctacgccacgacagcactaacgacagcctcgttctttctcccaagacttacttcactnctaagactgtaaccgggttcgatgtagcacagacggcaccgacgtatctaactaccgacagcgacaaacttatctgaccatccatggaccactgtaaccacgttccattaggggtacttgacatacaaactagtgatacatcgggtctcacacctacgggaacattccccacaggggttgcggcgatctctgtacaacaactggattgggatgcccctatcgtgtatctctccgatgtgtttatttcgccacaaagagtatgatttggtagtgaaacatcgacatgtaaatttaagggggaaaagggtntgttataaattacggttgtaaagaaaaatactacggttaggtgtaagtagcacaagagttaatgtggagaaaagtaagtatgggtgtagttattataagggggcgtcatagattatgcgtgttac

SEQ ID NO: 682328 - DNA, 120 bp, Homo sapiens
ttaacttagggaaccaaagactggaaacgacagcgggggggaggcagaaggagctgatgagcatccaggagaggaggaagtaggaagagcagtgtcctactgtgtgcccctacgcaggta

SEQ ID NO: 682329 - DNA, 424 bp, Homo sapiens
  misc_feature (4)..(4): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (93)..(94): n is a, c, g, or t
  misc_feature (112)..(113): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (135)..(135): n is a, c, g, or t
  misc_feature (139)..(139): n is a, c, g, or t
  misc_feature (164)..(164): n is a, c, g, or t
  misc_feature (188)..(188): n is a, c, g, or t
  misc_feature (416)..(416): n is a, c, g, or t
tgtngggggcaacagagaattcccccaaactgacatgaccgtgaccctctgcccagagggcactatcgacagcccacaggngcnanacaaatnncccccccccccccccccnnagccccccncncncngcctgcnctcngtgtcaggtagtagctgtggcgggnggtgtccagcctaaaacacgtgancattccaattcatcttcagctgccaagtgtatttagtccctgaacctggatccaaggcatctccctgtaggaaacatcagaccggggcagagattgacaaagcaacccacaacagcagctgccaacggccgttgtgcccacctcatcagcagctctgcaggggcctcactccaccctcaccacacacgaggagccagcactcctggccccattccactggacaggaangcgtgaga

SEQ ID NO: 682330 - DNA, 411 bp, Homo sapiens
gctgccgcctactactactaaaattcgcggccgcgtcgaccaatctccagacttcatcaggcttttgactcaggataaaaacacatccctgagctgttctcccttcctccctcctctccccctctgggagcagggaagctagcctaccgccctgttaaaagtctcaagggggactgggcgaggtggctcacgcctgtaatgccagcacttctggaggctgaggcaggtggatcacttgaggtcatgagttcgaagccagcctgaccaacatggtgaaaccctgtctctaccaaaaatacaagaattagctaggtgtggtggtgtgcgcctttaatcccagctactcgggaggttgaggcaggagacccgcgtgaacccaagaggcagagattgcagtgagctgagatcatg

SEQ ID NO: 682331 - DNA, 164 bp, Homo sapiens
gtatgctaatggcgaagggttggacaagtcaacatctctgtggtgcagtccaacgtctccagtgactatggcgtgtgccagtggtgtctggcagtggcttaggcctgggtggagtaagcagctactcctatggcagtggtcttggcgtttgaggtggcttcagt

SEQ ID NO: 682332 - DNA, 559 bp, Homo sapiens
catttcaatgtgaaggtcctataaagaaggaaattgtcagaagagttctgcagggtttccagctccaggagccgatgtaagtagggagaagaacagtgccaaggagaaactgctgttgccaaagaggagggaggaagaagaggaaggaggaaagaggcaaacatacaaaacctcagacaaaacgcagctttgctagcacacagatggataatgggaagacaaagatatggagagttggatgcctttggcagtaagtatatcggaaaggctcattcaggcgacatcacccaagatctctgctctgggtaaaaagagaacatcagcttgaaaagcttaaaattctactggcagacactgtctgacatggaaatatctctaaccgcaagatgatttgcaattagcattctttctagtggcacagtaactgcctcatatgattgctaaggagattaaataaggtagagcttgagaaagaccccattaaactgtaatgggctattcaatgttagctattgtcattttcagagttaccaaataaaattcgacttgcataaaaaaa

SEQ ID NO: 682333 - DNA, 124 bp, Homo sapiens
aagaagtccacctatcgggcattattggattcagctcacaacagatgaagacagcaccaggttccaaattcattcaagtgaggcaagtacgcctagttttgtaacctgttcaggggagaaaaaa

SEQ ID NO: 682334 - DNA, 874 bp, Homo sapiens
gggaactggatcgggttgctgccagcgggtgagcttcggccgccattttaccaacagctccactcgcgcggacacagggagcagcgagcacgcgttccggaaaccggataccatgggacaggatttctccgcctcagcccaagaggagatctcgtggaaacatggctacagaacattgttcagtggacacgtggttacgtgaagagcccatggatactattctgcagttatccattcagaaaatttcagacatggctgtgatgttggttcaacccacagaaagtggctgaccacactagatgaaatttacggtggcagggttagtgggcaacatagtgattagaatgacggacgctatggacgctttaacaagattgcagtgaagagggtgcatgggcagttcttcaacaagtttacagaccgagggatctctctcatgttcagaaacaaagggtgccttttaatgtgggtcatggaagaattacaggcagagagaacaacagggcccacagggtagcagaatctagtacgcggaccacgatgacggcacacatacgcgcactcctggcaaggaaacagtgtaacaaccttggatgggacccatggaccggaggcaagtgggcgaggaacaactcaggattcggaatcaggctagaagccttcgggggcacgcgattttgggggaagatcccagaagattatgggggacgagtggtccatacttggaaagcgacctattggatcggcgcaagggggcccccaggtccataaggttgggtggccgtgtcagagcacgcagggggtgacgttaaactcgtgcaggtgggacatggtggatctgcaacaggctggggctcatagaacgcgactggcg

SEQ ID NO: 682335 - DNA, 171 bp, Homo sapiens
cataactttttcaaagattgatcatttttataaccatggttttcctgaaatcctaaattcatcaatatgaaggaaatgacccacatagactttatgcaataaatacaagtgcaagtgagtatacccttacctgatgtcccaaaacaatttttgattcaggttgatgatgta

SEQ ID NO: 682336 - DNA, 1026 bp, Homo sapiens
  misc_feature (3)..(3): n is a, c, g, or t
  misc_feature (7)..(7): n is a, c, g, or t
  misc_feature (16)..(16): n is a, c, g, or t
  misc_feature (37)..(37): n is a, c, g, or t
  misc_feature (42)..(42): n is a, c, g, or t
  misc_feature (68)..(68): n is a, c, g, or t
  misc_feature (88)..(88): n is a, c, g, or t
  misc_feature (98)..(98): n is a, c, g, or t
  misc_feature (123)..(123): n is a, c, g, or t
  misc_feature (125)..(125): n is a, c, g, or t
  misc_feature (127)..(127): n is a, c, g, or t
  misc_feature (144)..(144): n is a, c, g, or t
  misc_feature (260)..(260): n is a, c, g, or t
  misc_feature (269)..(269): n is a, c, g, or t
  misc_feature (285)..(285): n is a, c, g, or t
  misc_feature (311)..(311): n is a, c, g, or t
  misc_feature (318)..(318): n is a, c, g, or t
  misc_feature (321)..(321): n is a, c, g, or t
  misc_feature (358)..(358): n is a, c, g, or t
  misc_feature (373)..(373): n is a, c, g, or t
  misc_feature (429)..(429): n is a, c, g, or t
  misc_feature (685)..(685): n is a, c, g, or t
  misc_feature (939)..(939): n is a, c, g, or t
  misc_feature (1012)..(1012): n is a, c, g, or t
tangtgngattcttantcgggtcgatcccgtacgtgnagtgnctctcgagacgctgcgacatactttnctgataccagtaatatctcntctcacacantatcacgacatcctatgcaacccantncngcatctttttcactatnttgtcttgatcgcctccacgcgaggctcatcacgcatcaggaccacgttctccatacgctgcatcatactcgcatcatcgactcgattctctggtagtactcaaagatagacacgntgactatcnacacatctacacgccnacagtgtcgcgctctcacagacgtcntacatangtnatatgatcatacatgttcgtgtatcatcatcacacgncgcgcgcatgtctcncggatcatcagcaatatacgctactctattctgcacatgacttctcacaagaacancacagaacatatcctcgcgccgggcgcgaactcgcgtgaagcacaacgctcgcctctctctggatactacttaagatgaacacacacaagtcccaccatgtgatttatcctcacctctagttccgttctctactacgagcgctccacgacattggcactctggcgccacgctattacgtgacgaggtgcattatcgtgaactcgcatctaacattgtcgcgccgctcacgtacgtaacaaataaatttgcgccgtntggctcttgctcgatactcacaaaggcctctggatcactgacctctacctcctgtactcttctaatacgaggactatctcagcaacatatgtgccactgtgccactaatggtgagttactctcgtacactctattacctctgctagatgcttacctgtgcgcgcttacctgaagcacacttcactcggaaactagaatcgaatggccaatcaccattcaggcactgttgaatcacacaaataaccgcgaagaanacctcgacggcatcgcgcgcgctgcactaatacacggctatgctcgtgcgggtgtctcaccgcaacccatggngcagctactacacg

SEQ ID NO: 682337 - DNA, 267 bp, Homo sapiens
gtgtttctcctcctcggcatgggcggttactgtgaccaggcggttccagcacctttgtgaacattgtctcatttatgtccctgtagaggagcgtgagatatgatttatatgtcttcagtgtccgttaaggagacaagctgcagcagagtaatttgccccaagtgacctcgctcgtgtatgtgtgtgcgtgcatatgtgcacgtgtgtgtgtgtgtgaaggtgtctgtctgtcccagaggcagatgccatgagacatggggactcttg

SEQ ID NO: 682338 - DNA, 236 bp, Homo sapiens
gtagagcgagttataattagtgcctcatatgagtatagtacaacggaagtgattaagctatgtgcattgtcagagtggttgagaatgattgtgaggcgtactaataccatagccgcctagttttaagagtactgcggcatgtactattgacccagcgattggagcttcgacatgggcttaagggagccataagtggagtccgtacagaggtatctttactatacgacattgtgata

SEQ ID NO: 682339 - DNA, 378 bp, Homo sapiens
gggattataggcatgagccaccgcccccagcctaatttttgtatttttagtagaggcggggtttcaccacatagtccaggctggtcttgaacttctggcctaagtgatccgtgcccccctcagcctcccaaggtgctaggattacaggcatgaaccactgcacctggccacttgttttgaatatataatttcaacttttattttacattcggggggtacatgtgcaagtttgttacatgggtatactgtgtgacgctgaggtttgtgggacgattggtctcatcacccaggtagtgaacatagcaaataggtttcttcaacaatcaccccaccctctctctgccccctctgatagtctcatgtttgtgttcaccatgt

SEQ ID NO: 682340 - DNA, 594 bp, Homo sapiens
tacctatgtcgaggctagtctgaggattaagttaaagctcctagtctggaccacccttaagaggagcttaaagaagggtggcaacaggccagacgctggtggctcacacctgtaatcccagcattttgggaggccaaggcaggcggatcacgaggtcaggagatcgagaccatcctggccaacatggcgaaaccccgtctctactaaaaataccaaaattaattggccaaagttgggggtgcctgtaatcccagctacttgggaggttgaggcaggagaatcgcttgaatccaggaggcggaggttgcagtgagccgagatgatgccactgcactccagcctgggtgacagagcaagactccgtccgggaaaaaaaaaaagggcaggttagcaagtgtccgggagggtgtaaatgacctaggctagcaccaatttgagactcgatgaaattaaaacacctgaaaacaaattagaaagagaataccttctactaggtgattctgctgcgttgaatgctggaggggtacctttcatgtaaagtggcctgcatcatcgacaattctctcacgtactggtgagtctgccactctaaat

SEQ ID NO: 682341 - DNA, 804 bp, Homo sapiens
cgggccggagcgggccctgggcggccaggagaagcagttcccgtccggcgctgctgagctttcttcatctacaacccggcgcttcgggccgcgcgaaggacaggaggaaaataagattttatttgtatgcatccaaatgtagcgtagtaaaagaatgagaagattagagatgtcgggatcgtgtgaagctatcgtacagtgtacgacggcacatgtacggcccatcgaaagagcctgcatagaatcttctacataacagcagaagaacagacagttcttcaatgaaccacaagaaagtttctggatggtcatggttgttcggagtcctatgattgaaaaacagagtagagatggaaataccagtctattgaatatcaagtaggatggagtggtccgtgacaaggtttatagcgtcggatgcatgactggctaggtagtctcacgagcagtgtactaagctttgatagtggtagcataatctgaaagccgtggaatgacggaggcgtcccgcgttctgagacaaggattggagacagcttcggttccatcggtggtcttgccaacgctacatttgccagtcatgtgaccttacttgacatttttggtgcgtacctcacgcttcttgcccgttggtataccttgcacgttgatttgggaatcccgtcctctcatctattagatattggtcgggacacgcctgtatatggtccccttgacgctgcttttctctgtaaacgatcagctcatctgggggtgggtttaggcccgatgccgtgattgatttgctgcccttaccttacacct

SEQ ID NO: 682342 - DNA, 621 bp, Homo sapiens
gtagaaaactatgaatgtgggatagccttctgaaaaagccacaagactttatgaaacattacgacgaattcttccaaggtgacaaattatatgatgaaaaagctgattaccagaaactttcagcagacatcttattgatagtatctaatcagcattgctcattgaaatctgaaacaaggtatcttccatcagcataagcaacagcaatcacttgagctcctagcgcaatgtattaagtaaggaaatactaagtatcaatgaagaactattaaagtaacttttatacaagaaataattagaaaagtgtgttgatagaagaagctaagaataaatacaacaatgagttaggtcttaatcaagttataaaaatgttgaaaggcacaaaagaacacctgaaagaatgatattttggtctgacaagacttggacattgtcacaaatataatttctctcccaaatcactaagtttaatatacttctgaagtttacatcagttttattttaacggaacttcataaacttatccaaaaattggatgtggaaaagttaagaaatcataaataggtgaaacagacttgacgaaagcaagtagagaagatacactctattattagatatatc

SEQ ID NO: 682343 - DNA, 280 bp, Homo sapiens
  misc_feature (3)..(3): n is a, c, g, or t
  misc_feature (27)..(27): n is a, c, g, or t
  misc_feature (186)..(186): n is a, c, g, or t
  misc_feature (192)..(192): n is a, c, g, or t
  misc_feature (218)..(219): n is a, c, g, or t
ccnttgtcccagtgacacccataaggncaggcccccctgctgactcttttcctaccttcctatttgtaatagaaacctaccgaatgtatgactaaaaagtcactttgagattgacttttttaaaaagttattaccttctgctgttccaaagtgcaaaactgtgagtggaattgccttattctgacntaatgngttagaaacctagagaatacagtggnnggatttttagacattgctgctgctgttaccccaggtctttccgatcaaaaattttaaataa

SEQ ID NO: 682344 - DNA, 880 bp, Homo sapiens
cggctcccacgccgcctctccctgcccgcgtgtgaccctggtgccgtggtgcgcctgcatgcccgccctgtgcctcctgtggaggtggcgttccgggcgcgggggtgaacggcctgagggctggatgaccctaaatggcgcctcctacggccagagggtgacgcctccggcgggagccacctctccggtggcgcatcatccgtgccccccagtaagaggaaggctccagaatggagctcaggaattaggagtctcgagtgcgtagggccgggttactgccactctgggagccgatccgaccagcgctgtcccgagggcagaaggctggcacggtgtctggaggagttcacggctgctcccggcaggggctggctggacagggcgcctgcgtccccacccactgcagggcctggccccattcctgggggatgcatgcggcagggtgttgagaccgagaggactcggcgaaagccagaacgagagggtctggcggcagaggggctcggagacctgctggtggacagagtcgcaccgcttggagttcccagcctggccctcacccggcatcttcctgggccaagcgaacgatcaggccggttatattctaagcgaacgtgtgcgtgtccttattcccagtccagtcaagagctaccggggctggcctagtcatgggggagcccagtagagaggagtataaaatccaggtccttggattgcagagacccaggcagactgcatgaagagcagcacttcaaaagccccgtctcttggaatgcaacaaggttgccctggcttttgaccacagcaaggatggcagacataattcccgtattgccagaaggagctatcagtagattggctctcgcctgatggccttccc

SEQ ID NO: 682345 - DNA, 299 bp, Homo sapiens
ttccccctatctccaagctggagccctttaatctaagcactattctcacctgggtccagccattagatggaaacccttatagggccagattaccaagaggcccaactccccaactccgagttccccaaactggcctgatcatataattcaccggaaacacttgataaggatttccagatcccaccccagatctaaagaccaagagcctaacaggcaccgcccctatccaaacacacagccctataatgccccaggagatccttctcttaccagcctttaactccccctgcaaaaagctg

SEQ ID NO: 682346 - DNA, 975 bp, Homo sapiens
aaatgtgaccctcgccatgtgtatatacatggcttgcgttgcatgttgtaccgtggtgaagtggtgcccaatagatgttctattgctgccgagtggccatccatcaaaaacaagctgcagcatctcagttagtggatgggtggcccacgtggcttcgaaggttggcatctaaacgtaccagctctcccacttgtggtgccctgggggagacctggtcaaggttacagagagcttgtgtgctattgcgtgagctaacgaccaacagccattgctgaggcctgtggctctgcgcatggaccaggaagtttgaccatgtatgtatgccaagctgtgccattggttcacttgtgtaccgtgggtgaggggatggaggagggcggagtttgtctggaaggcccgtgaagatactgggttgtcctctctgagcaagggattattgaggaggtgtggtgtcggattcggtttgaaggacggggggtgaggaacgaacgggagtaggtaatactaattatccatgcctttctggtgcctgcagccatgtcatgctcccagaattgacagcttcagtcttaggtgatcagatgttaaaggctttctggttagattgtttcccgttggtgatcatgtcttgtccatgtgttgcctgtaattgttgttccatcagtatctcaacagttaagagttcattacatgcgtacaacgggaatgggcaacgtcaccacgcaaacgaatggggaggggcgagtgaaacacatcctcgctgggaggcactggattagggtcttcaccagcatgttggtacaagtgggggcgccatagggacacggtctacaaggaaggagacaacgagcggggggatacagagctggtccctggtggacagcgtgagcgggtatttggagaaggactgatggcggtgggggacatatgggcacacacagagttgagacgggcagaaacctagtgtgtctggca

SEQ ID NO: 682347 - DNA, 412 bp, Homo sapiens
atcagaggatccctccctatagacatctcaccaaagaatgtatacaatggcaaataagcatagaagaaatgatcattcgtcatcatagaaatgcaaattaaaacaactactacacacctataaaaatagctaaattacaaccaactggcaataccagtgctgatgaagatgcagagcaacagaaactgtcactcattgctagtgggaatgaaaaatggtactttggaagtacggtttggaagtttggctgtttcttataaagttaaacattgatttaccatacaatctagaaattatgtccctaggtatttactcaactgataaggaatcttatgtctacacaaaaacctgcacacaatgtttatagcagctttattcataataaagccagatgcaactaagatgtctaata

SEQ ID NO: 682348 - DNA, 433 bp, Homo sapiens
tggaaaaaattctaaaccatttatttccaacacggggacaaaaaagaacctaaaaaaccaaacatttttaaaaccccaaaaacaggtggaacccattggcaaatttaaatttggaaaaaaaagcggccacggcccccaaaaaccaaggggacaaggttaaaaaccaaatttaggccaccgaaaccccccaaaaaaaaaaaaatccggctgggttcaagctccagtattaggacccccaaaaaggctttggggacccccaagggaaaaaaaaagatccaacaaggttcaacctgaaaaattaccaaccccaaattgaagctgaagtataaccaaccccaaaaaaggcttcggggacccccaaaaaaaaaaaatccggctgggtggaacctgaagtattaccaaccccaaaaaaggcgggggggacccccaaagg

SEQ ID NO: 682349 - DNA, 607 bp, Homo sapiens
  misc_feature (36)..(36): n is a, c, g, or t
  misc_feature (61)..(61): n is a, c, g, or t
  misc_feature (90)..(90): n is a, c, g, or t
  misc_feature (136)..(136): n is a, c, g, or t
  misc_feature (139)..(139): n is a, c, g, or t
  misc_feature (173)..(173): n is a, c, g, or t
  misc_feature (217)..(217): n is a, c, g, or t
  misc_feature (264)..(264): n is a, c, g, or t
  misc_feature (424)..(424): n is a, c, g, or t
  misc_feature (461)..(461): n is a, c, g, or t
  misc_feature (491)..(491): n is a, c, g, or t
  misc_feature (539)..(539): n is a, c, g, or t
  misc_feature (579)..(579): n is a, c, g, or t
gggggactaagttttgtaggtacttcccagcggttnagggtttttcttttcctcttgttcncttgctggggctgggggcccaggggtctnactcctcggaggccatgtgggccaagagggccaccaccctgttgcngtngccaaaaccgttgtaaaaccaggaaatgagcctnaaaaagtggtcgttgagggcaatgccagccccagcgtcaaaggnggaggagtgggtttcgctgttgaagttagaagagaccacctggtgcncagtttagcccaggatgcccttcagggggccctccgacgcctgctttaccacctccttgatgtaatcaaaattggcaggtttttctagaaggcagggcaggcccaccacttaaacgttggcagttgggacacggaaggccatgccagtaagcctcccgtncagctcagggatgaccttgcccacagccttggcagcncagttgaggcagggatgaagttctggaganccccgcggccatcacgccacactttcccggagggccacccacagtctnctgggtggcagttatggcatggactgttgtcatgagttcntccacgaaaccaaagttgttatggatta

SEQ ID NO: 682350 - DNA, 134 bp, Homo sapiens
ctggagaacccatgaggttcgaagtgcttgaccacctccaggttatcatcttagagacctaggctttcttcagcccccaaacccgactggtctaagggggacatcaagttctccaccaacacctagctgcttag

SEQ ID NO: 682351 - DNA, 364 bp, Homo sapiens
aaggagggtctactacaataaacaaggtgctgtatttagttggggaaaatcctatgtagaaattattggcaaggcagacaataatcttagtgtgattatccaaggatggtcaaaaagtggattctgcaatactaccaacttcatgcgtataacctcgcgtttcagagcttataatctcacattgataatgagagtcagaaaatcacgatcagaacgttcatccagtggatttttattttgttagtgaaaagccatcgcccgttctatcagggatagttttcttttttcatatgagcgcgggaccctgtggaccaatgaggcaacacccctagtgacataaggtcgacagaaaaaagcgacagcg

SEQ ID NO: 682352 - DNA, 846 bp, Homo sapiens
tgtggtggcaggagcctgtagtcccagctactcggaaggtgaggcaggagaatggcttgaacccgggaggtggagcttgcagtgagctgagatcgcgccactgcactccagcctggtgacagactgagattccatctcaaaaaatacatagcatcaataaataatttagctgtgtgtggtggcgtgtgcctatcgtcctagctacttgggaagccgaggcaggagaatctcttgaacccgggaagtggaggttgcagtgagccgatatcacgccactgcactccagtccgggaggttgcactgagctgagatcatgccactgaactccagcctgggcacacagagtgagactctgtctcaaacaaacaaacaaaaaaaaaaaaaaaattcccaaccttttagcttaaccaaggtggggcaatcaaagctgtaacaagagtggttacaaccatgaacagcaggtccagtgtggttttcaaaagctagaaagatgacgggcagattaccctagtctttctgtggtgccaaagagacgacgacaacgtgttcggtcctggaccatatgaccatgcgaccctgcagtacattacacggatgtgggatgtggcctaagtatgtgaagaacacctggagttttttactaattacggaggccagcgttgttcacacctggtatttccgctctggtcttgaccgattggaccttgtgacatatggggccgtttaaataaattgcggggggagcgcctaaccggaagggggggcggaaacggggaaacgggctgtagctctaaaaacagggcggggccccacgcggacacggggggaccctcagcaaaaaagggg

SEQ ID NO: 682353 - DNA, 166 bp, Homo sapiens
acttataacgaaccctgaactactttaagtatgggacgactattgcctgatattcttcagtcttgtaactcactactgattaagctttgtaatctcatatatgggccttagatgaatccatacatgaatgacttggtagtttcctcgatgtttttttttttcttat

SEQ ID NO: 682354 - DNA, 862 bp, Homo sapiens
acttatggattctttttcttttttttttgagatggagtttcgctctgtggccaggctggagtgcactggggctaggctcactgctacctccgcctcccaggttcaggcaattctcctgcctcagcctccgtgagtagctgggactacaggcacccagcaccagcacccagcgttagtttttgtgtgtttagtagagacgggtttcaccagtgttggccaggatggtctcgatctcttgaccttgtgatccgcccgtctcagcctcccaaagtgctgggattacaggcgtgagccagccaggccgtggctccttttccactttcatggtgcctcgtgatgtgcattggatctccccgggtaatctgggatgttctgccgtgggcctagaggctcagccgacttaggcgaccttagttgtcatctgcgagtctccgcattactctgtggtggctgaagtcacgtcaagtattcaggagtcccaggggcaggaggttggcccttcgtttgggggcacattattccgcccaccagaatatcgcaggagcagccatcaggccctagatgaggcggggaaggagtgctgctgtcggccggttgagagatgaacctggtgtcgtgatccccttcccgagggaggatatgagagagagccgacttcggcagattgcttgtcacggacccaagtacggaggctattgtcggtcggtttggcgcaatagaccctcgcgggtgaaatccttgtgggccggggcgcgttagttgggtgggtctctctcccgggcgtttattgtttccgccgcggtgtgtttatctcggtgggacccccctgtctctgctccactggttccccagtatagcggcc

SEQ ID NO: 682355 - DNA, 151 bp, Homo sapiens
ttgactatagtgatataacagtagcgttgactatagtgatgtaacagtagcggtgactatgtgatgtaacagtagcggtgactatagtgatgtaacagtagcggtgactccagtgatgtaacagtagcgttgactccagtgatgtaacagt

SEQ ID NO: 682356 - DNA, 720 bp, Homo sapiens
caaaccatcaggctagtacgaggctgcgtggttgaatctggactctgggttgcgatcaggtgtaggaatggaaaggatggagcatcaacagcaggttgggcttgtggggcctgggaggggcaactcctcgaaatgcggggctgggggcagcacagtgagggcggtgctccttctgagctacctgtacccctgctacacctattagtcccaggctggcctagattcaggggaaagtgggacagctgtaggggaggggctcctttccataaatcctggatgagttgacaactgcccatttttccttttgccgagccccagagagtattcgggagttgtaggttgatcatcaagagaatttggggcttccaacgttgtctctgcgtgccataggatcctgagcacctgacacgggttcgacgtttagcccacttggggtgggagtgttgagcatctgtcccgcctttagatctctgaagccacaaataggatgcttgggtaatgactcctagctgtcctttctctaccgtctgcctacacagtgtctcaaggtccagcttatagtcatatatatcacccagacgaaagaggaaaggacacatgtcctaggaaaggtggttaataaagagaaaattgacaaaggatccatttgacggaccccgtaacccttgggtgtgctctccattctgctccttccccatcgttgcccacattactgagggg

SEQ ID NO: 682357 - DNA, 914 bp, Homo sapiens
gacgagctgcggcgaacagagtggcagggttgacccaatcgcatggtcaggtggaaaggtgggccgaccctgagagccccggagaccacaaccggtgggcgcccccaacacagctgtggggacaccaggcgcgcgcgtgagaaccgcggggatgtcgcggagaggccgaaagtgatgcccaacgacggaccattgtggcgcccaagttgtcccagggttgcgcgcccccatgacaacgaggtctgcaaaacagtggtcgaggccgcgtccccaacaggggttgtgacagggggaaccgggccaccagacggcgactgccccaacattcccgcggggctcgcggtcgccccccagggtgctgagccccgtggggccgcccacccacaaccctgtgagcgactgcgcggcttttatcatagtggcccggaacaaggaaccacagacatttcccccgcggatgatggaaggaaacacaaggggcggttcgatactaaagcggggcctaagggaatatttcttcaggtacacgggcgaccccccaaggacgtgtcacaagacagcggcgaagagtcttcctagttccaacatggggcgcatccaggcgccccaagcacgcacggtggggacaagaactcaaggggacgatcggcgaacgaagtcccgaggcccacactcgaaagacccgaagagctaagaggcgatgggaccaacacaatgcagccggtggagatgatggaacagcacaaaccacctcggggatgacccaacctccaagacacaccgcccggacggagtcgtgccccggacctctgggggaacaacaacgccctctggcaagagggtttcttttaacacccctagcggccacaattccccccaaaaaaaagggttcaaataaaacgggaacaataaca

SEQ ID NO: 682358 - DNA, 236 bp, Homo sapiens
gggtacccgagactgaaatgtgttgttcattgctatgaaagtgggctcatcaatctagggataataacttagtctaaggataaccgtaagataaacagttatctagggataataaggctgagtgaaatcagctccatgtgtcgtgccttacttccaggggccttatgcccaaagagctagctcatactctcaaggcatcctacacattgccttggccctcaaggacgggaggatga

SEQ ID NO: 682359 - DNA, 98 bp, Homo sapiens
aacgtgggaaaagaatggtatgtgggggaaatgcatccccccaaagggctgaggcatagtttttcatttggtattgaataaaaaccctctttttttga

SEQ ID NO: 682360 - DNA, 125 bp, Homo sapiens
ggtcgatcagaggacccggctcgcgagcagatactccgatgcgagtaatacggatgtgtttaggagtgtgcagcattatgtggtgtggatgtgtgttgtggtgtggatgtggggtaccgagctcg

SEQ ID NO: 682361 - DNA, 989 bp, Homo sapiens
ctcgctatgtcactgctctcgctgtgtttatcgggtgctcgcgtaggcggtgttttggctgtccctggttgttcacctgtgggcgttgcgcccttcctgtctgttcggtccgtggctttggcccaatgtgaccccacaggaggggttcttgccctccccctttgatgtgacctcctgggtcttgcctttatttctccctgcccgcgggtctgcgcctccctgagactcgtttgctgggtctgttgatcgggccgccctggtgcgccagtttcccggggaccacccgtacacagcgggggtcggccgcctattctagcccgcctctgtgaccggcggctttttatacccacaagtcgcacggcgcattggtgcccgctccccccgtgtaccaaggtgcgccgtctgttgtctcccgggcgtcgattgcgcccccgtcgtgccggtcccggtgttcctcccggggcggccccggtgttttcagggttcccccccccgtgctatattcgggggcaaagccacgcatcgtctcgttatcacgaggtctctcggatggtgtagccacaccatttgcatcgcccccggaggcagactgctcgtgaccccgcatgcgcgcgacggaactagcagtgccaccctcagaacactagggggcgcccaccaatttcttccccccgaccctcgggggaccagtttccacgaacacacaagtgtttaacaactctttccttcttttaccacttctatatacaaagattcgctgcccatcagaagatttccttgaatttgtagcacatatatctaaacctcgtatcttctccccgcttcccaccctacgctgtcagtttctcctcctcctcggagctcaactatatctttgcgctcctctccctccttattccgcaaagacaacactatcattcatgcggatgattcatgctagactaggcacccccccccgaaaaaaaatttcgcacacccccaacatgaca

SEQ ID NO: 682362 - DNA, 383 bp, Homo sapiens
  misc_feature (130)..(130): n is a, c, g, or t
  misc_feature (242)..(242): n is a, c, g, or t
  misc_feature (312)..(312): n is a, c, g, or t
acaacaaacaggaaccccctttactcttatggacctcatttcaatatacggtttacggttggatggaatggtataatttaatatttctctggtacggtagtttatatttatttacagattttttggtacngtgtgattggaacttttggttcctggctatgatcaaggtttatgtagtagagcacttatgatcacaaattaagtttttgggttggatggcactacattaaattttttaatgnagttctgattttggacgggactaaaacggtgtcttaaggtatgtgatgagtacttaaaattttaatccangtggtcccccccctttttttttttggcttggtttgtcaaaagcgctggtccttccgggcaggtgtagggat

SEQ ID NO: 682363 - DNA, 363 bp, Homo sapiens
  misc_feature (359)..(359): n is a, c, g, or t
aattaacaggcatgagcacatgcacctgtcctaaaaaaaaacacaaaaaaatttttttcaagagagggtcttgttctgtcacccaggttggagtgcagtggtgtgatctcagctcactgcagccttgacagcccaggctcaagtgatcctcccacctcagcctcccaagtagctgggattacaggcatgtgcaccacacccagctaatatttaaatttttttgtagagatgggagtctcagtatgttacccaggctggtctcaaattcctggcctcaagtgattctcctgccttggcctcccgaagtgctggaattagacatgagccaccatgactagcctaaaaaataataatgtatngatt

SEQ ID NO: 682364 - DNA, 245 bp, Homo sapiens
  misc_feature (36)..(36): n is a, c, g, or t
  misc_feature (142)..(142): n is a, c, g, or t
  misc_feature (195)..(195): n is a, c, g, or t
  misc_feature (228)..(228): n is a, c, g, or t
  misc_feature (234)..(234): n is a, c, g, or t
acatttggccctcagactgtaatttccatactactntgactgatactagatgacctggctgcctaggggctgtgctggtctgattttttgtgagacaaaaaccactctaaacctcctggtgcactgaggctgtacacaccgncagaacagggcactgcgtttaaaagtttctgaccaagtggtgacaacagaggncaaacgtaaggctgtctggataagttgaacctngctgancggtagcacca

SEQ ID NO: 682365 - DNA, 972 bp, Homo sapiens
agcggggcggggttctggtaatagccgaggctgctgctgtgtcggagacccccggctgaagtcaccgtcatcatgtctgatcaggaagccaaaccttcagacctgaagactgtgtcgggattccgaaggaatggtgaatatacttcacagaacctcccacaggtcgacttgcgaccagcgactagcgatctcgcaggatctcctgttcacaagtgaaacatgacaatcacattcatcaaggaaactcaaagtaatcgatatctgtcacagagacagggtgctatcccaatgaacttcactccaggctctctcgtgcttcgcagggctccaggagcacattgcatgagtgagagtccaatacgtccgaagacagcagacgtggaggacagtggcagggacaagaagaaagtgtgcactgtgaaagggttctgaatcgaggggaaagcgaaaaaccgggggagggtcgagttcgaaactgagctgttcaggaagttaatttcctttgtctctgatctccggtctccagttctccctctctggtcgcgcggttccaaaccttcacagttttagtgtccagttttatcgttcacacaagaaacctacggttgtcctatttgggtggagtacactggtttggctgtttgtcgaaccataaccgggaacagtctgcacacccgagctgggcgtatcccccgcgaaattcccttcgtgttttgagaccaaagccaattcttgggctatacttctgtgggacaagttttccctgaagaattggccataccaatataatttctactttcactatgtttgtgcgatttctataccagtgtgggtggcctggaattttttctgagggcctggaattcaaaggaccgtgctagttgccccgcgtttcaattaattgtaacccgcctccttccctttgtgttagagcagaaaccttgtaacctgtggtgtgcagcaacgtaagga

SEQ ID NO: 682366 - DNA, 189 bp, Homo sapiens
tgaggttgataggaagcaggcaccgtccttgctctcgctgaatgaagtacaagtcattctccgagagctcgtagaagagggagatggcagttgacttgatggtgatgcaacgttcctactcgtcttccgggtatcagtaaagcgtgtctccccggcccgggccgagccgattatgcccgccctccccgg

SEQ ID NO: 682367 - DNA, 331 bp, Homo sapiens
  misc_feature (35)..(35): n is a, c, g, or t
  misc_feature (49)..(49): n is a, c, g, or t
  misc_feature (123)..(123): n is a, c, g, or t
  misc_feature (194)..(194): n is a, c, g, or t
  misc_feature (203)..(203): n is a, c, g, or t
  misc_feature (206)..(206): n is a, c, g, or t
  misc_feature (221)..(221): n is a, c, g, or t
  misc_feature (223)..(224): n is a, c, g, or t
  misc_feature (281)..(281): n is a, c, g, or t
  misc_feature (320)..(320): n is a, c, g, or t
  misc_feature (325)..(325): n is a, c, g, or t
  misc_feature (329)..(330): n is a, c, g, or t
gtcattggggtccaaactaggggacaacaaaacanaggagaggcctgantctctgccttgctcttgctggctgattcgtcatctccctggcccggcagtgaaatgaccacacagtcccaaaanatgtgctaaagcctggcctctccaaacaactcaggcttccaaggctgggttgagggagtccaccaccagangtgcaaaanggngtctcttcctaattntnngagttctcaatttgagtttttctccacaaatttcttaaactttttcatacctattanccctagcattctgctagaggcggctaccagataacacanatganaagnng

SEQ ID NO: 682368 - DNA, 908 bp, Homo sapiens
tgggaagcccgtggggcttgcaaaggaaaggacgtggaacgggcgcgaagcccaagacgggggcgcggcaaaggagtctcccccaggagcgtcggcgaagcctgggcagcaaacaggcacaagaaagatgcctgcgtgcctgcagaagaaagcggatcaaaagatgaatccgtagggaggaaagcaattcacaggcatcactttggcacaagggacagtccggttcagagtgcgggttcccgccagcccgactcgagtccagggagcatatgagatgggtcatgacagatgtgggttgacaatagtctgacagccctgaaacctttggttaattttgaagtcagcatgcgaggctatgacgctcagtgatattgtggacatgcacccaaggaatatgtacatgtcacaaagattactcgattcagagacctattgagaccctctctcgcactagtcatccttggaggggattcgcaagtggacagtctctgttgattaatctctacatcatttttacagctggtatggccattaccatatgggtgaaactaaccaaataatgaccatcgatggctcaaagatgtggcgttgaatatatcccatgggttatctcgtatggagcgtgaggctgggttataatgaaagtgactatgccacatactagcatcatagtgccttaatctgtctttatgtcttggggctggggtaggtagataccaaatgaaacagctttcaggaccttccttcatcttgcagttgttgctctaatctcctttactagaggagataaatattctgcatataatgaagtaatttttctaggtatataacgaacaggccttttattttcatagtaatgatgatagtataaaaatgttaggataacagaatgcttctagaattttcca

SEQ ID NO: 682369 - DNA, 396 bp, Homo sapiens
ttggaacacattttgccattttctaattgatataaacaagagttcagttcctacagtttatttctggtcacaaaaatatcaccaaattttaaaaacaaaacacttctaatattaaactctgaaataaatgtgagctgtacatacattgattaataaaaacaagataattcttgactcacttattccagttcaggttcactggtgaccagagcttatcccggcagctcagggcacaaggcaggagccaaccctgcacaggccgccatcccatctcagggcacactcacacatatccacactcatactgggaccatgtagacacaccagtttacctaacatgcacatctttgggatgtgggaagccagaatagttggagcccacacagatgtgcgggc

SEQ ID NO: 682370 - DNA, 293 bp, Homo sapiens
tgggaggcacagaaggttggggtggctgtggcaattccttaaagacaaccatgaagtttgccacatctgttgacccctccgttcataaaagatttctctgtagcatgtggtgatgtttgatagcatttttatccacagtagaactttcaaaattggagttcattttctcaaaccctgtgctgctctatcaagtatggttgtgtaatagtctctcttttttggccttttttttttttcttttttcctttttgtagagaatggagtctcgctccattcattgccccggggtaccg

SEQ ID NO: 682371 - DNA, 462 bp, Homo sapiens
gttggctggtggtcgatctagaaggatcccctggccaggttctctaaccgggaaagggggtgacgggtagcctaggcctctgaggaaccagtctggtcatcaatcttggcaaagcaaagctggttctttttccaactttattacagaaggttctgccttcaaggtactggatggcacacaggaaatgtaccaggtatagtaacggagcgggggccaccaagggagatggagcacggcagacccctaagagttcaagccaggcgggagggggaagacctatccaccttctgaacatacgaggcagaaggctcagagtccgggaggcagactctcgccgggtttgcctggggcggagggcaaaatactaaacaagtcttctctccgtcacttctaaggccgcagggatgcaatctcactccggggcactcggctttcttcgagaggtagagagccgggcaaggg

SEQ ID NO: 682372 - DNA, 934 bp, Homo sapiens
  misc_feature (3)..(3): n is a, c, g, or t
  misc_feature (69)..(69): n is a, c, g, or t
  misc_feature (75)..(75): n is a, c, g, or t
  misc_feature (89)..(89): n is a, c, g, or t
  misc_feature (93)..(93): n is a, c, g, or t
  misc_feature (95)..(96): n is a, c, g, or t
  misc_feature (119)..(120): n is a, c, g, or t
  misc_feature (135)..(135): n is a, c, g, or t
  misc_feature (139)..(139): n is a, c, g, or t
  misc_feature (143)..(143): n is a, c, g, or t
  misc_feature (145)..(145): n is a, c, g, or t
  misc_feature (154)..(154): n is a, c, g, or t
  misc_feature (156)..(157): n is a, c, g, or t
  misc_feature (164)..(164): n is a, c, g, or t
  misc_feature (172)..(173): n is a, c, g, or t
  misc_feature (188)..(188): n is a, c, g, or t
  misc_feature (192)..(192): n is a, c, g, or t
  misc_feature (207)..(208): n is a, c, g, or t
  misc_feature (212)..(214): n is a, c, g, or t
  misc_feature (224)..(224): n is a, c, g, or t
  misc_feature (241)..(242): n is a, c, g, or t
  misc_feature (274)..(274): n is a, c, g, or t
  misc_feature (534)..(534): n is a, c, g, or t
  misc_feature (922)..(922): n is a, c, g, or t
gcnatggcttggagagaactaatcaattcatattctgcatttccagccaaagggacataggcacaactnactggnggcaccttcctgtnggangnntcttccatccatctacagcattnntacttttataaagtntgantttntnttgcttgtngnnttaagtntcattttnnatggtttttgcaggnttgntcataccagctttgnntttnnntgggtttttnttgctttcggtccaagnntgagaatcagtgagagggtggctctgggactntctcaatggctttgcaggaaactgatggttttcgagatttttagctgtggaattcagccctgcaggagtagatgcttgttcaggatcctggttaacaaggcaagttggaaaggagcagccatcacctagacttgaaaaaatgggtagcaaccagtacttcttctcatcaccaaaaacttgtcgcatgtttttactgaaacccaagctgaatccattcttatctgttccatgtcgaaatactggacttctgaatgcctctnatgtagatttatttttggtgactagccaacaatgatagccaaacagagaagacaagctgacagaaaacatagctgcagcaaagaataaaaacataatatggaacttggcttgagtatcaaataggccatttgtccaaaatttgataaaatactgtaaatctgttgccgcaataaaaaggcagtagagcagagaataagccaagaaaaggagaaagaacttataatttgaaaatccaacacaattgttcacccatggacaatgatgatccatcttccaaaatacatttatcacagacggagcagtgatggcagcgatctggttttataagttggcatctgtcacagtatcggatggctcagacatggtcctggtatagatgggagatcntggctgctcgct

SEQ ID NO: 682373 - DNA, 193 bp, Homo sapiens
gaaatgtatgggtgacaatgtctacaggctcatgtggtgcacataaggatagacggggtagccactgcaacagggcttagtagacaagtcagacaggaaccaacattgatgcccatattcaaacatcatgatgcagccctcagatggaataaagatggaatcccgtctgcatcgacgggcattgtccataatc

SEQ ID NO: 682374 - DNA, 617 bp, Homo sapiens
aaattaggtgggaagcatgccctttctcttaagaatcagattggagataaagaaaagctgggaggtaactttcctctgaaaataagagaaccatggaaaaagctgtagaagaaaagattgtatggctgggaagccccccagatgctgcccttgaaggcttcaaagctaagaagaaggaactggaaaaaattgttccacccattatcagccaactctatggaagggcaggccctccccccactggtgaaaaggatacagcaaaaaaaaatgagttgtagcccctgatctgctagtgctgtaatattgtaaaaactgggcccagggacctttgttaggaaaaaattgaaagaacttaagtctcgaatgtaattgggatcttccccccagagtggggttgaaactgctatagcctaaacggctgggtctgccttttcataaacagttgcccccatgtctttgggggggggggaaaaaaaaaattggccctctttaaaaacgggtaaaaaacctgggttagggggggggttccccctcaaaatgttttttttaacaactgggtcatgggcctttggggtaggaagttttttttcccctaagtgccccccataaatgtttgt

SEQ ID NO: 682375 - DNA, 242 bp, Homo sapiens
ggatggtgaggtgtctgtgtcctcaggtaagaggacaaaacactcaagccgtgctgaaaggagacgttctcgttcttattctcgctcatcctcacgtcactcacatagatcgtataaatcggagtcagaatccagagaacattccttgggtgaggcctctgtgtactcaagccaacatagatctaaaaaagaaaaaaagaaagccaaacaaaagaagaaatctccgacacggaagcatgcta

SEQ ID NO: 682376 - DNA, 205 bp, Homo sapiens
  misc_feature (33)..(33): n is a, c, g, or t
gttttttaaaaaaaagaatcccccaaggtttcnccccgggggggggccggggaaacaggcctggtattgggaaagggttttcctttaaaatttgggtagggggggggggggaaatttttttttttgggtaggggcctttggttttaaggtttttttccccccaggttttttttttttttggaacccgccctttttttaagggtta

SEQ ID NO: 682377 - DNA, 110 bp, Homo sapiens
ccccggttgcatgtgagccgagattgtgccattgcactccagtcctggtgtgacacgagcgagactcacaaaagaagaaaggggggtgtgaatttcgtaatgtagtgcgg

SEQ ID NO: 682378 - DNA, 178 bp, Homo sapiens
gggtaccacgagcactgactggcattttgtctgtaaaggtgcatctggtctgtaccctcctcaccacattatagctcgtgggggccaagcggcatcacaagggaaactcatggaatcacaggaataatcccatcagcttggcacagatgctgcccacagggattgcttggacgtaacc

SEQ ID NO: 682379 - DNA, 143 bp, Homo sapiens
ctgatcctaaaccactgttctgtcaatagccatgggagagatactgtccttgcttacagcaactcagttagacgcacgccacgactcaaaagtagttgagtaggcagcatcgagagtcagaacccgaactggggcaaaagcag

SEQ ID NO: 682380 - DNA, 409 bp, Homo sapiens
cacttatatgtggaatcttaaaaagtcaaactcatagaagtagacagtagaatagttgttagaggctggaaagggacggggcgggtaggagatgcaggatggggaaatgctgttcaaagggtacaaggttcagtcagacaaaagcagcaagtttctgagatctattgcatagtgtggtgactatagctaataataatatatcgtatatctcaaaactgctaagagtaaatttcaaatgtctcaccataaaaaacgttaaacaaggtgatggatatgttaagcttgacttagtcgttccatattgtatacatatattaaaatataacattgtaccccattaaatatttacaattatgatttgtacatatatttaataataataaaaatttaaataaaatattaaaaaaaa

SEQ ID NO: 682381 - DNA, 1288 bp, Homo sapiens
  misc_feature (1099)..(1099): n is a, c, g, or t
gactatcttcaatacttccgatgagggcccgatccttaattcgcaatggcattcctaattgcttacctgaatcgaataaattctaggctatatacagacatacgacaaaagggcgcgcggaaacggtggggtaaggccccgtacgggtgcgtgactacacacccctttcgtctgagcgccagtagagaacctctgtcgagccaaagagccccttaaaaccgcggccagcatctacccatcacccgtcgtacatacaaccgcccccccgcagccgttgaggcctgcgtgcgacccactcccgcctacctatccctatcttaatggaaagcgcgcggcgcgtgagacacgagtagaggccgagaagcgcgcgcgtgagagtgcaaacgcgtgccaacccctacgcgcacggtgccctaatgggagtggcgtaacggcacgaagacctccacaaggcgcgtgacggccacgctcactactctccacagtgcgcgtgcgtgcgacctcacgcgcgccgagagcactctaagagagcgatgcaacaccgctaccacagccccaagagaatcagagagacagcaacaatagcggaatgaccacaggaacgagaccacaaacaaaaaaacaatcaaaattaaattagaacaaaggtacaacaacaaaataacgcaccaaaatcccacataacgataaacgtaagtagccaagacccactatcacccataaattaacacacgctagcagcatttcccatatagtaacaaccccactccattcacaactctccccatgatacttccaccacaaccaaccaaacgtacaacaagcaccaatcataggtaagatcaaacccataccaaccgctgaacaaccaagcgtccaacatggaaatctcaccacataacggaggcacaccaactgtaaccgtgacataggaagtgtagtacagtccttatccacccatgaaagacacatcaacgaagccaactgcaaggtaaaatcccagacagatcacagcaaacatacacccccagctacgatctgaccggaaagccgccacttgtggatccccctgacaacaggggaggcagacaaagatctntccaccgacaacacaacccctacatgacttcagtttcgcaagagtggccatttatgtacgaaaaatcaaatctcagtgaacaagttaacaactccaccggtaccacctgacgtgcacaccaccactgatagtggaccgctgatcaatctaccagtttacaggtatagagacacgcaagatataacaacc

SEQ ID NO: 682382 - DNA, 98 bp, Homo sapiens
aagcttggagatgatattgaccttattgtccgttgtgagcacgtatttctcccctctagtacctctgcatttgtgagtgttccctctggctttctgaa

SEQ ID NO: 682383 - DNA, 264 bp, Homo sapiens
cagcagacacagcacacaatgtggggctggagatcaggtgggcccaggtctcccttcctccttccatctgcatcaactctgtttccatcggtgcttcagaatccagcgcctatttctaacagtctggcactcagaatcttattgttaaatgcatcacaattcactgtgagagccagcactccggtcgtgggaacgagaccctatggaagttcctcagtgcgtctcagggcgccccatggcatggaggcatgtcgtatgggttca

SEQ ID NO: 682384 - DNA, 919 bp, Homo sapiens
  misc_feature (161)..(161): n is a, c, g, or t
  misc_feature (170)..(170): n is a, c, g, or t
  misc_feature (174)..(174): n is a, c, g, or t
  misc_feature (179)..(179): n is a, c, g, or t
  misc_feature (182)..(182): n is a, c, g, or t
  misc_feature (218)..(218): n is a, c, g, or t
  misc_feature (259)..(259): n is a, c, g, or t
  misc_feature (283)..(283): n is a, c, g, or t
  misc_feature (343)..(343): n is a, c, g, or t
  misc_feature (346)..(346): n is a, c, g, or t
  misc_feature (369)..(371): n is a, c, g, or t
  misc_feature (373)..(373): n is a, c, g, or t
  misc_feature (376)..(376): n is a, c, g, or t
  misc_feature (402)..(402): n is a, c, g, or t
  misc_feature (404)..(404): n is a, c, g, or t
  misc_feature (414)..(414): n is a, c, g, or t
  misc_feature (457)..(457): n is a, c, g, or t
  misc_feature (491)..(491): n is a, c, g, or t
  misc_feature (503)..(503): n is a, c, g, or t
  misc_feature (524)..(524): n is a, c, g, or t
  misc_feature (695)..(695): n is a, c, g, or t
  misc_feature (765)..(765): n is a, c, g, or t
  misc_feature (802)..(802): n is a, c, g, or t
  misc_feature (828)..(828): n is a, c, g, or t
  misc_feature (834)..(834): n is a, c, g, or t
  misc_feature (905)..(905): n is a, c, g, or t
accgcctccgggtgctttagcaggagggccttgggagtaaccgcaggaacggcccgagcctccacggccccaccagcacccggaagttaacatgggtaccctccagggcaaatccctccgctctccctcgcccccctccacaggccgagtcatcggcgaanggaacgcanagcnttaantangagctgaacgggagaaggagccaggcggcggggganagtgaggtatggcccgaactgggattcttggcactgattantcctctccccagggcatggatganaaagggtgggcaagtatgtatctgggaggacgaagggtgccgggtcaacggccgccaaanggncccagccctttaagcaatctgcnnnanatnccaccccaacccccatcccccaatangncgtgaattcnagggtgggaaagagcactcacagcagacccccgggaaataaanattaatgggctaaagccgaagggtgatgacacantccccagctccncgggcaagatgcaccgggaancagaaactggagaaagaagggcgatgtctccaagaacaacactccagccgctagaagcccgacacgagcgtccccgggctgggaggacagagcccactcaagcaagggaggcgagcgagccaggcgcgagtctcctgggattgcagcggcggccccaggtcgcgctctgcncaaatctttcgcacgtgcccgcagctccctggccatccagcgccgcagggaaaggcgctgggccccctcnttcatttgtaccgggacgccaagggcctggcgcgcgngacctagggggcgggggcgggcctcngcatgncgctgcccctggcgggcgtgagggcgggccgctgcggcgcgggcggcggcggctaccgaaccgcggcacanagtctgtaacagta

SEQ ID NO: 682385 - DNA, 202 bp, Homo sapiens
  misc_feature (20)..(20): n is a, c, g, or t
  misc_feature (24)..(25): n is a, c, g, or t
  misc_feature (37)..(37): n is a, c, g, or t
  misc_feature (117)..(117): n is a, c, g, or t
  misc_feature (132)..(132): n is a, c, g, or t
gcacgagggtggcagcaagncgcnngcggagggaggnagctggcttcctggagccttctcagccctcaaagacagaccgacagacagacagacagctggcaagaggcagcctggggnctacagctgcttcanagacctcatggctgagtgagcctcccctgggcccagcaccccacctcagcatggtccaagcccatggggg

SEQ ID NO: 682386 - DNA, 539 bp, Homo sapiens
ctggggtcgatatttggactgggacctttttctgtgtgggaggcaccaacgatgtgtgcgccgggtgtgtctcctgcgttgcccgccggtgaaaaatcacagcgggtttcttttttggttgtccacgcaccccttcctaccgggttgtctttgcgggggtgttttctaaccacgcgttccatatatgtggggagagcgtgtggtacaccgccgtagaggggcacgttcctaaggtgttccccgcagagttttgtgcgcgcgtggatatggcaccctcttctcccgcacaaggcgccttttatatggtggggcgccccttgtgagaaggcctgtgggccgaagcgtggtatagcatggcgtgagaggcacttctcttttgtgaggggtcttttttccctcctgtactttttttttcctttcccctaaccccaaaagtttattttttttttttggcgcccaaaaaccttgttttaaaaaaaattttttttggcccgacaaattaaggtttcccaaaaaaaagtcacccccccagaaaacca

SEQ ID NO: 682387 - DNA, 119 bp, Homo sapiens
  misc_feature (105)..(105): n is a, c, g, or t
  misc_feature (107)..(107): n is a, c, g, or t
ataatgaagaatagtaggtataatcatgccttctgtaataaataactgggaaaaaattaaaaatagggaatatatgttatgtgattttctagaaatacataagananatatatgtctgt

SEQ ID NO: 682388 - DNA, 251 bp, Homo sapiens
  misc_feature (192)..(192): n is a, c, g, or t
tacagttttggatttatgcttaatttggggtatttagttacaaaatttaaaggaaatataaggagtgtcctctttttttttaaattaaaaagtgttttttaaacggggcttgggggcccacccctgtaaccccagcactggggggacggctgtaacggcggggatgaccaccgcctggattctccaggagangtttggaacaccagccggtggcgcaccaaggggtgaacaccctggtgtttctataactc

SEQ ID NO: 682389 - DNA, 1082 bp, Homo sapiens
  misc_feature (49)..(49): n is a, c, g, or t
  misc_feature (79)..(79): n is a, c, g, or t
  misc_feature (115)..(116): n is a, c, g, or t
  misc_feature (124)..(124): n is a, c, g, or t
  misc_feature (130)..(130): n is a, c, g, or t
  misc_feature (135)..(136): n is a, c, g, or t
  misc_feature (144)..(144): n is a, c, g, or t
  misc_feature (169)..(169): n is a, c, g, or t
  misc_feature (181)..(182): n is a, c, g, or t
  misc_feature (214)..(214): n is a, c, g, or t
gcctgggtgggccgggcatacacgatgccctggttgtcctcactctcanagggaatcttgaggatgaagcagaactcgnagttgaggacaatcatggacatcgtgtatgcctggnntggagccngggtcntgagnncgcctgangaaggccaagtaggccagtaatganatcctgaacagnnatgtatgacaccatcctacagtcaagcaggtntatccaacgaaggtgaggagcctggagaaacgtacctgtcgtgagagatggtccgtttgtggcgaccagaagagcccatcatggatggactgaatggccgaactacgatggacatacgaaaccactgtcgccttcaccggctggctccgataggcagtgaagggactaatatgtcaagcgaactggagaaatatgctccgactttgtgaacgaacatgcaactgtgatatattggactgaccattagtgtgttgctaagacaaattggaccaaggacggtctacagttgtgggcttggagggaccgcaagaggtaaagccaggtgggcagatccaatgtcatcgcacgcctgaatgtggccctgccctgggtatagtcattcaagcacattgcggtgaccaagggaaacaatgaattggtgggcagcggcccgagagtgtgacctagggtgcaggaaagggagctgagtgcagccaatgcactcgcttttagccacgcatgagtaaactaagccttagggaggcggccctttcttgtgaattgtaccctgggcgcttacaagatggcaggcaaggggaacacgatagcccaacgtcttatggcatgaaggcaagatgggaatggtgatacttaatccaagtttgatcttgcataaggcaaccgtactggtattccacggtgacaaccaactatgtgttgaagtgccactgtctgagagctcccaaggtactccatttagtctgtagataacaccagatgtggattaccgttaactaagctgtccacagggtttggacaacatcactcttcacatgtgataattccagtgttaagaccaacatgttacgagagggaaaacaaaaatggt

SEQ ID NO: 682390 - DNA, 579 bp, Homo sapiens
acgagtggctgactcctgtgctcgcatgtcgtaccagcgactgatgttgttgcatcacaaggtcaggagataaagatcatcctgctgatcacggagaaacgctgtttcttctaaatgcaaaagagcatccgggtgtgacaatgggtgcctgcattcccatgtgcttggtatgctgaggcatgacattgacggtgactctgtgaggtgcagtttgctaagagccgatatcccttcactggactctagcctgagcttgccgagcgcagtagctaatgccaaatattccaccacttttggaggccaaggtactggacatcacctgtagcatggagtttgtgaccatggccggtcaacatggtggacaattgtgttcactaatactacaatgatcttctaggacggaaagtgccacacccgacaaggacagtttctgagggggctggaactgtattaatggcataatcctccgaaagtagagctttgccacagccccaggttgtagccattaccctcaaagccttatgaaacctgaatgtcaattctgtcacttctaaaaaggggaatgacataaccagtttt

SEQ ID NO: 682391 - DNA, 138 bp, Homo sapiens
aaggtggtgggagaaccggtaatacaaaaggaacctaaaaataacgggaacattacagtagaaaataatatagacaggtagtaatgtctgaaagggcagatcatgacgttggaaatgatcactctgagggtctgttga

SEQ ID NO: 682392 - DNA, 154 bp, Homo sapiens
cgtttaaaggatacacacttaaatgaatgtgactgtgtcagctttgcatcatacattttttgaaagatttttaaaaaagcctacaacttacatatgtagtagaatcagccatagctctgctcctggcatagagtcacctgttatgtggattaaa

SEQ ID NO: 682393 - DNA, 177 bp, Homo sapiens
caagctggtagtttaggacctgtgtggtttgttaggctactgtttgcattaataaattaaagcttcatagggtcttctcgtctagctgtgtcatgcccgtcctcttcacggagcagcgtcaatttcactggcttaaaagctaagagacagctgaaccctcgatgccaagcttgcaga

SEQ ID NO: 682394 - DNA, 794 bp, Homo sapiens
ggaggagaagaaacctcaccttcagggcaaaccagtgagacccttgtccctgccagcctcgacgtttgtgagtgaatggatccgaaatgaattcgagcggagacagacgttgaaaacggacggcaagaacagatcacaaggagcaagacagtacagaactacgcgaacgaccagggatgaaagcaccgtcacgaccgtcagaccgcaggcacatacgcacgaacagactgagtagccactgacacaacaaagagacaaccgacaccacagaccaagagacatgaacaagcacagacagaacacaatagtcaccacacgagaacagcacctacaagaaggacagaactaacagaaacaatagaatacaacaacaaacaacacacacacgcaacaaacaacaaacaataacaacaaggtaaacaacaaacaaaacacagaacagaaggaaaacaataaaagcagaagagcaaagaaataacaaacaagaactacgatcaagaacgaagaatagaagacaaaaggaaacaaaaaaagcaaaagcaacaacaacataaagaaccacaaaactacaagaacaaaggaccacagagaaactgacaagcagacaaacgagcagaaacaaacaaaaaaacaacgaaagaaaaaaaaataataaacaaagcacagaagtaacaacaacaagaccaatacgaacgcgaaaagagacaaatagaatgaacaaaagacgagacatgagacagagagaacagaatcaagcaacacgacaagcagaaaagagagagagaacaacaaaa

SEQ ID NO: 682395 - DNA, 119 bp, Homo sapiens
gtgcttgaaggtgctgagagcgatggtcatgcagtgagcggtaggaaaggaccatcctcattgcatgccccatgataggccaacaagttgatttcacgctgccgctgctgttgttgcag

SEQ ID NO: 682396 - DNA, 124 bp, Homo sapiens
gtagcaggagcaatatattgagcggctcgagagatatgtgtagagatgaacgagcgtgtcgtgtgactccgatgcgcgggttgcctgactgcctgggaatgtagccgactgaatttgcacacat

SEQ ID NO: 682397 - DNA, 127 bp, Homo sapiens
  misc_feature (121)..(121): n is a, c, g, or t
tgcaagcgtagtacccaacaatttgtaaggctgaggtgggcagatcattttagcccaggagtttgagaccagcaggggtaactgcgtctctacaaaatttgaaagattagccaggcatggntggcac

SEQ ID NO: 682398 - DNA, 244 bp, Homo sapiens
tcctgcaagaggctggtcccaccttggccgaggatcctggccttgcggttcctggacaggcatccaggagagccatggctgggcgccccagacgtgtgcactcaggggatcccggtccgtggggtgcaggccgcagtcggcggtgtcggagccttcgactgcccagctaggcggtacgtccggttcgggccgcagcgtctggatctcctttagtgctgaggagcgcttggccccgggcggcggg

SEQ ID NO: 682399 - DNA, 750 bp, Homo sapiens
atctgagggaatgatgtacatgaattcttgtatgttttgcagcttttaagtataaagttatttcaggccaggcatggtagtgcatgcctgtatacccagctactcggggctgaggtggaagattccttgagtctgggagtatgaggttgcaggagctatgatcatgccactgcactccaggctgggtggcagaggacaccctatctcttaaaaaaaaaaaaaaaaaaaaaaaaaaaacggggggcggtattccctcaaaccggttatttctcaaaagaaaaacgggggggctcaaggccagggggagggttgttggaccccagggagtttcaaaaaccagccgtggagcaatgggtggaacccccatgctctggcaaaaaatcacgcggggtggtggggggactccaccggggggtctcagcaactggggagcgcggagggggggaatataacgtgggagcccaggagggggagcgtggctggtcgagaatcgagatcggtgccatggcactccagctaatctccaaaaaacaaaaaaagagcgggcgtattagaaagagcgccattttgagcacgggggacagggggcgcgggacacacacgaatgggtggccaaaccttcatacatatcaaaacaaaggggggggggggggcaaaaaggatcaccacaggggcccagagtatagcacgaccaaagcgtttgtgtaaacacggggcccataggggcggccaaacaacgcacaccaggcc

SEQ ID NO: 682400 - DNA, 357 bp, Homo sapiens
taaagaaagtttatatctcaaatagatgctatatatgaaatcacttttttggccttttgggtttcacttaacacatttcttcttcaccaccaccaaaaaagcttatttttgacctgacagctttcaccataacacatttcatttacaaaatagttcccaatatttatttaccaagcgttgcattgaaaccacctttatgcacagtaacgcacccccatataagcacacagaaaggggtgtgtaaacacagtacgttcacttttcatttccttccgtggtgtggattacacatactcttccatccgcgcatttgtggagccacattattagtccatcctataccagagctcgtgccga

SEQ ID NO: 682401 - DNA, 1609 bp, Homo sapiens
  misc_feature (180)..(180): n is a, c, g, or t
  misc_feature (230)..(230): n is a, c, g, or t
  misc_feature (257)..(257): n is a, c, g, or t
  misc_feature (351)..(351): n is a, c, g, or t
  misc_feature (435)..(435): n is a, c, g, or t
acttagagttttgagctttaagataggattattggggcttacccccaccttaattagagaaacatttatatcgatctccaaccggagctgtacatctctctatccgaatctgtatactgaatgtcacacatggaaaaactttaggaaatgcacttattagagctgttactgggtgcctgnatacaaatcagcagtcaaaaatgactaaaaatataactagtgacggaggnagaaatcctccctctgtgggaggcacntactgcattccagttctccctcctgcgccctgagactggaccagggttagatggctggcagcttctcaaggggcagcttgtcttacttgttaantttagaggtatatagccatatttatttataaataaatatttatttatttatttataagtagatgtttacatatgcccaggattntgaagagcctggtatctttgggaagccatgtgtctggtttgtcgtgctgggacagtcatgggactgcatcttccgacttgtccacagcagatgaggacagtgagaattaagttagatccgagactgcgaagaagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacgggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatattaaaaaaaaaaaa

SEQ ID NO: 682402 - DNA, 329 bp, Homo sapiens
ttcatgtctgcaccatctggctctgtgcgaatccttcttctggtcgactgccctcgatcgtttgttctctcagaagaacggctcgggcggagtgggggctgcctccgtgcagtctgcgatggccttacctgctgcctggtttggctgaagcaatcctgagtggggtctggggctgccgatcctgtctgtcctgccacccctgtctggctccctcactctgctgcagtggagcgcagtctgacctttcacgcagctctgcccccacccgttgcagaggtccaccatgtcgcgccatgcactccggcgccattgcctccgccgccattgca

SEQ ID NO: 682403 - DNA, 859 bp, Homo sapiens
agcggagtggccgtcgaggcgccgtctgttcgaagtgctgtctcgacttcacggttccccgcggctcggcccgggggctgatgagtagtctgccagcgatgaccgagagagaggagggctgctgctgtgcttgaatttgcagttccttgtgcgcctggcactgaagacctgtggcagcctcctggtggaaccattgcccctattcaagccctgctatatgccccaaattgagttccccaagtccgacctgtctttacaggtgccggttccacacttgagaaccccaggtgccctcatccctgcagggcctcgagccaagggcccaccgttgagggagggcgtgaatggaacagggcccctgggagaagcgggattgaggttccccagaggacatacagggaccgatgccaaacgaactgcgcagaattcggcatgtgtgcgcgttacaggggaatgaccatgggaagcacggagggacccccttgactttcctgaaagattggcactgttataacagtgaaccgcaacggtgacatccaaaagaaacaagcaagtcgccggaggtacacaacccaacgcgatgacgcgacagcatacctaggggacaagtccccgttgtgtacccagagaaaaattcctcaagtataaacgcgcccaaagaatgggcaggaatatgcagatcggggggggcatggcgcaggaggggagcaacaaggactggaaacgactgccagcaagtccatgggtccagaacagggcacatggaaccctcattgagaccagcgaagaagtaaccatattgccccgaggttaagtccacacaacaagatggaagaagggaagcaaggagacaaccaag

SEQ ID NO: 682404 - DNA, 266 bp, Homo sapiens
  misc_feature (29)..(29): n is a, c, g, or t
  misc_feature (119)..(119): n is a, c, g, or t
  misc_feature (128)..(128): n is a, c, g, or t
  misc_feature (149)..(149): n is a, c, g, or t
  misc_feature (191)..(191): n is a, c, g, or t
  misc_feature (197)..(197): n is a, c, g, or t
  misc_feature (232)..(232): n is a, c, g, or t
aagaatgtggcttctaatagtgctaaganttaaaagatgcttttatagagacttagagctattttggaaagctttggggcttcccagccacggatcacaattagactaagcccatggantttctgggngtgttgtgcagtggattcggntctagatccatcttacatttgtttagtgtttcccaatttttnggaganggggtgcacagcaaatttgaggagacttttttgantctcacacatgttattttcctcaagattctttta

SEQ ID NO: 682405 - DNA, 923 bp, Homo sapiens
tggttgttcaatatagaatcttaatgcactgtttaaatttggctcagagaaccctctaaatccccgtggtaaatataagctgtgagtccagagaggaacagctctttggacactagcgaaaaaagcttgtagagagagtaatacaagatttaagtgccataggttaggtcctaaaaggctgcctaccagttaaggaaagtcgttcaagctcgacattgcactacctaaaataatcccgttacatgtaattgtaagtccttcatacggccaattggagccattctatctagggccgttatagaaagaactaagtgttgagtcataagtctaccatggaaaaactattctaccgtccgtagtaagcctcgtggtctagcatgtgaaaagatcgggaactgacagattgaagctagcgccagatatctacggatcgatacccaaacagagtcatctattaccctctactgtataaccccaaggaacaggcatgctcataaggacaatggttaaaaacaaagtagacggaactcggggaaatcttgaccccgcctgtttactcaaaacacatcacctctagtcgatcactcagtattagaggcacgggctgtccaggtgacacatgttttaagggcgggtacccttggctgtgcaaagggtacgcatattcactgttccttaaaatatgggaccctgtatggactggtctccacggatgggtccacctgtctcttactttttaaccagtgatatgcctgcccgtacagatgttgtgatgaggcagaagacgaacaaccctcggggttaatttttacgcacgtactaaaaccaaggtctatacaactgctaaatctgtggggactcggagacaactcgaagatgaaactccgaagaaaatacatgcaatgcgaagccgaaacgctgca

SEQ ID NO: 682406 - DNA, 174 bp, Homo sapiens
tggtccagattatgagagaaccccggattatttatcaaaaatatagtttaaacaaagtagttggccgggcatggtggctcatgtcatcctagcactttgggaggccaaggtgggtggaactcctgacctcaaatgatccacccgccttgggttcccaaagtgctgggattccag

SEQ ID NO: 682407 - DNA, 267 bp, Homo sapiens
aataagggctttttcccctatctaagtagccagatgcattgaatgatgtgtcaatacgttcgttgaagcctcctgatcccacaggtaccccatgtgcctttatggagttatataataatgctgtctaatagccacgatctcgcaaaaggctttctgtgtgcggtcagttacaaatagagccagaaatacatttttattcttttagcagagggcatcgtctgttttctttgaagaccccgtacaattgtcttatgagttaatagccaa

SEQ ID NO: 682408 - DNA, 157 bp, Homo sapiens
acactgttatacgtgtgcaccaggtaagagcgtcttctgggttgttctcgtgtgagtgtggctttgaatcactctctgtacagcgtagcgcatgatgggggcggctccgcggtctgctcggcggagtggctctctgctcgtgtcttttgtttggatg

SEQ ID NO: 682409 - DNA, 232 bp, Homo sapiens
gacccgtcagtgtgtggtgtatgggtgtctggcaggccgtacaagaaagcagtgtcctccaaaatatcaagggcatatttctgctgagaaagataaatgccatgtttggagcgcgcaacttcaagtccaagaaatatttaaatggaccaagatcttaaagacaaagcaattgtggagataagtcttcagtgaggaaatggcagaaagcatctacccataacaccacacaatt

SEQ ID NO: 682410 - DNA, 220 bp, Homo sapiens
tggtacggtcccgagttcttagatcgatccccggctccagcccccgggccccggcggggctctgcgctgccggagcttgggctgtctgctgctgtcccggagcgccatgtcgtccgaggtccggccgcccggccggggcggggccagtgaggcccggccttcccgcttcctgcctgatgcctgcaggcccgcccctgcgtcctccgcccgcctcttttcc

SEQ ID NO: 682411 - DNA, 174 bp, Homo sapiens
cctctagccgactctagaggtatcccctcataggtcgcaggcgttactgtgttgaacaaaaggcacacatcacagagacagttgcaaactcacgcaatactgcgttatgggcaaaactaactggctccacaaccagaaaatgatgagactccgatttggactgccagcgaacac

SEQ ID NO: 682412 - DNA, 180 bp, Homo sapiens
atggctgagttctcaaggtcaagggcagaagagtggcttatgtccacctgaatgactgcgtgtgtcccaggtggcttcccacggaagggacacagaggtccagtccttctgaagggctaggatcgggattctggcagaggagaacctgccctgccactggccccatgcgtggattgccag

SEQ ID NO: 682413 - DNA, 423 bp, Homo sapiens
  misc_feature (72)..(72): n is a, c, g, or t
ccattttgtatatagtagagacggttcatcatgtaggcaggctggtctcgaaccttgactcaagcaatctgnctacttcggctcccaaagtgctgggattacagtcgtgagccacagcaccaggctaaggcatattttacgtagcataatgttttataggttcatccatattgtaacgtgtattagaacttccttcctttttatggctgaataatatctatggtatgtatacaccacgttttgttctatttatccgttgatagacattgggggtgttttatcttttggctatagcgaataatgctgctatgaaaatgggtgtacagatatctttttaagtcctttttcatttattttgcgtctgcccctaggaatggaattgatggattgtatggttaattctgagaaaccgtcgaattcgag

SEQ ID NO: 682414 - DNA, 294 bp, Homo sapiens
caggctgtggagagccccaagttgagaacaataatgaacaattattgtatgaacaattgttagaaacagctaatcacaaacaacctgcgggcacaaatgacctcattccacacgtagcacccttcagcaggaccctataaaactttcctccagcccctgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 682415 - DNA, 227 bp, Homo sapiens
ggtatgaccaggtgatatggcttggctgtgtccccacccaaatctcatcttgaattcccacatgttgtgggaagaacctggtgggaggtaattgaatcatggggccaggtctttcccatgctgttctcatgatagtgaataagcctcatgagatctgatggttaataagggggagtttccctgcacaagctctgtctctttgactgctgttgtccatgtaagatgtg

SEQ ID NO: 682416 - DNA, 200 bp, Homo sapiens
gagcatgaatggcatatcagaagaaaaacacaacaaaagatcttgttgtagctgtcaaacttaagggtcaagaatccactgggaatttaaggctttcttagaaatatttttcatggcactttaacattaaatatcactaaaaggcaaaatatgtaaatattcatagttacaaagctacataattgaaagtacatgccatt

SEQ ID NO: 682417 - DNA, 500 bp, Homo sapiens
  misc_feature (3)..(3): n is a, c, g, or t
  misc_feature (24)..(24): n is a, c, g, or t
  misc_feature (28)..(28): n is a, c, g, or t
  misc_feature (33)..(33): n is a, c, g, or t
  misc_feature (53)..(53): n is a, c, g, or t
  misc_feature (137)..(137): n is a, c, g, or t
  misc_feature (243)..(243): n is a, c, g, or t
  misc_feature (271)..(271): n is a, c, g, or t
  misc_feature (351)..(351): n is a, c, g, or t
  misc_feature (396)..(396): n is a, c, g, or t
  misc_feature (420)..(420): n is a, c, g, or t
  misc_feature (432)..(432): n is a, c, g, or t
  misc_feature (469)..(469): n is a, c, g, or t
  misc_feature (495)..(495): n is a, c, g, or t
ggncattatggcatagtgaaaggngctnagggnctgcaagtttcatgggatgncattatttttctcgttttcgtttgtagggaaatacatggcttctgtcattgacttgcaaggtttttttttttattcttaattgncctccctaatcctttctccactcagctgtggtactcaatggcactcaggattaaatgtgtgtgttcttctggggccagggaaggaatagataggcattgatgtggnaccctcaactgtattacagaatagggtngtaaacactcaggagaaacattctccctggtaaagtgctaagcaattgttaaacagcattttaaagcatgaatgaacgtnttgcttgtacattccaaagttccacaaacaaaaggaaaggtcttnttctaaaggagcagggagatgaanctgccgataatngtttttataaatgtggccgtgaatattttttcccagnggttgggaatcccaaatcacctcttncaggt

SEQ ID NO: 682418 - DNA, 169 bp, Homo sapiens
tatgacatgatcgaatcgagctcggtaccatagtggtgcttaggcaatctttccaaagtaaatcagtgccccagtgctacttatgccatatttggacatacttttttttttcttcaatttggtaaacttccgggaaagctgtcttcactaagtatcccctagtctctat

SEQ ID NO: 682419 - DNA, 748 bp, Homo sapiens
atgaagtgataagatgaaatgatgaaatgataagatgaaaagagttgatgagatgataagatgaaatgatgagatgcaaaaagcatgcagcatgcaacatgcaaatgcatgcaaatgcaaatgcagcatgcaacatgcaaatgaccatcaatgaaatgcaaaaaacatgcaaaataatgcaaatgcaggatgcaaattcacatgcagcatgcatgcacacattcacatgcatgcaccctgcacacatccatgcaaatggcaaaatgcatgcagcatgcagcatgaaaatgcacgcagcatgcaatgcagcacgcacaatgcagcatgcaacatgcatgcagcatgcccacagtgcatgcagacatgccacatgcatgcaaatgcatgcagcatgcagacatgcagacatgctcaaatgcatgcagcaggcacacatgcatgcaagcatgtcacatgcaacatgcaagcatgccaacatgcacatgcagcatgcacacatccaatgccacacagcgcaaaaatcgcaaattgcatcatcatgccagcatgcacaatgccagcatcaccctgcagcatgcacaatcaagccaacatgccatgcaaggtgcacacacgcatgggaatattgccttgcaaggtgcagcaatggaccatggcacacatgccaccatgcaacccgcaatgcaccatgcacactgccacagggccctgcgaccatggccactggcatgccatccttgcaaggtgg

SEQ ID NO: 682420 - DNA, 504 bp, Homo sapiens
cgagtgactctagaggagtcttatccagagaaattccaaagaagaccatgaatgttgcatgtgcacctttgtccctttctacaaggagcaggaggcagtatgccagggttaaggcatcatgtctgcagccaggcaacctgctcagtgtccctgttctaccaacttcatagctgtgtgactagtggtggttaatttagggtgtcaactttgacgtggggttaacaggacacctgagaaaagcgggtacaagcaattactgtatgggatgtatcccatgagcaagggtgtttcttggacacagatcatgcatttgaatctggtgaacctgagctacagaacagatcccccgttaacccaaatgtgggtgggcaccaatccaagtcagtatgagggcctggatagaacaaacatagaggaacaagtgaatttgcccactttctcttcttggagctgggcactcatcttctccttgcctttggttgaacatcagaactccagggtacc

SEQ ID NO: 682421 - DNA, 197 bp, Homo sapiens
tggaccctaaaaggtctggattgatcgtactgctttctgaaggaagacaacaagttgctgcatagtctacaaacacgtctctgaaataggtgaatttctagctcttcatggtcctgacattgatttcagtctttgcaaagatgaagaggtaattcgctgtacatttgtcaccagcactgggtttttgtttttgtttg

SEQ ID NO: 682422 - DNA, 481 bp, Homo sapiens
  misc_feature (6)..(6): n is a, c, g, or t
tgtcgnggtgcactgtgtcgtggtaggagaatgtcttgtccttgttttaggagtgtcaaataaaaaaagcttgagcaaatcaaattttaaagatttaatcgccttttactagagattcatgaatcaagcagcatcccatctacaaaatagacagagctgagcagaggaggtgtgctttatagacataaaagagctgaagaggcagggcatggtggctcacgcctgcaatcccagcacttcgggaggccaagctgggcggatcatgaggtcagaagttcgagaccagcctggccaacatggtgaaaccgcatctctactaaggatacaaagaattagccgtgcgtggtggcatgcacctgtaattccagctacttgggaggctgaggcgggagaattgcttgaacctgggaggcggaggttgcagtgggctgagattgcaccattgcactccagcctggtcgacagggcaagactccgtctc

SEQ ID NO: 682423 - DNA, 90 bp, Homo sapiens
ggccagatctcctttcatcctcctcctcatagcgtttgttgaggatgtatcccgcaggaaccgctccccttcatccaactcagggtcgtt

SEQ ID NO: 682424 - DNA, 117 bp, Homo sapiens
caacatggtgttcaggcgcttcgtggaggttggccgggtggctaatgtctcctttggacctcatgccggaaaattggtcgcgattttagatcgttattgatcacgacagggctttgg

SEQ ID NO: 682425 - DNA, 971 bp, Homo sapiens
  misc_feature (971)..(971): n is a, c, g, or t
ggatctgcgttctctatcgcagtggtaaaggtggacagacaaggtcctaaacctctcaagatgcctaccacgacatatgggtgagagaaaacccgaatgacggagaaggtcggtcgcagatggagaagcatctacaactagggatcgctccgtactacagagctggattccgctctacggtacatgtactggcgaatatatggagatttgagggatgcacataaaattctgcgagaaggggatctcgtattccgtggcaggcgcatcccaagagaacatcaaaagagaaggtggcgccggtgggtgtcgggcacactcccgtgcaggaaccactacctcattgaccgcggccgtcgagtgcacgtttgatgagggtgataccagtgcgaatatctctccagaggatctcacgcgcaggtttgcgaaagtctcgatttaggaatttgttataagcatcactaagactagatggcaattgtccaatgaacgatgtcttcctagtcatcgatagatgatcagttataactttttatgaatcgcacatgggctttccagcgagatgtgacgtgggagacgaagattgaacacggcgatcgtcggatggggttgaggaaagggtcgatggcgatgatatttgatcttcgaatgcaccggagtggagaataaccagtgagctagcccacattatccactagtcgtttgctacaatagttgcaggatcggaacaccatgactcgatgcttcgacggggtctttcctcgcagtctagtgaatgaaattgcgccgcgagtcctatacttgggtacttcctaggagttgagaactgggcaattccccttgcgagtctcaagctaatttcgtagggcacttcgtgcacagcggtcaaagacgagggatagaaggtcccccagagtattgctcgggtagaccattaagttggtttcggttgaaaggccttcacgctggtgacn

SEQ ID NO: 682426 - DNA, 220 bp, Homo sapiens
tgagtctgtaccacagtagtgagaatgtaggggctggtgacaggagacacactgcagtgtgaagaagctaagccttgaggccccttcctgaggccttgtacctgttcctttagtcagtgtttacttgactgtctgatttgcctgctgtaaaactggaacctttttggtatacatgctctgtgagttgttaagaaaatgcatagatgttgtgtctctagat

SEQ ID NO: 682427 - DNA, 1063 bp, Homo sapiens
gaacgttatttaattcttttatgactatttcttttttttgttatattatgtgtacaagctatatctagtatgtatttctctcatttgtcatttggtatataatttaatcgtgttagatgttctcttgttttatatatcattgtgtttacctttaacatttgtgatcttcttgaaacctgttgcccttcgggaacatgaacaatatggtggctcgggaaatcgaggctggtcccatataggatctggcccatgcaaaaacttgctggtgctcagatgacactctgagaccaacggtttgtgtcaaagactgatccttggttttctcaatatgtggtggtgggctctgattttatcagcttctatataggtcttgcggtctttaggaagctatgtgaggtggaatccctgttatacggtatattatatcttgcattctgttggtaacttatgaattggcccctgtggatatcgataagcctgtgccataaaatggggtgtagcaaaagttgggttccgtctgtgtttactgacaccacagctcttacaagtgatgcttccttactttaaactctacgctccttctgtgtctccatgcttcatgggtgactttgttccttttgcctgtcgtctcactgctgtgggatgtcaactccagtatcatgtctttattagtaggtaggacaagagaggaatcgacaaagaaggcatgtaaccaccatgaatgttgcccctagtcaaagagctctccaggaagcaccaacaaagtgaattttcactgacatttcccaggccagaccatgctgctgtctaagcaaaatgaggattactgctagtgaggatgaaaggaagaatgtgtaatcagttttcttgaagtataatacactgtacaataaactgaacctgagttggaaatatacatgttggatgagttcttgacagatgtatataccacagtcaagatacagaacagttcccattcactcccatagattgcttagtgcttccctttgtggtcaatccctcctacacgggcccctagtaacttaacctcgtggtgccttca

SEQ ID NO: 682428 - DNA, 309 bp, Homo sapiens
  misc_feature (95)..(95): n is a, c, g, or t
  misc_feature (151)..(151): n is a, c, g, or t
  misc_feature (262)..(262): n is a, c, g, or t
ggccaatagtgattgtttctaaggtacagtcacagggccaggaacaatggctcatgcctgtaatcccaacagtttggaagacggaggtgggaggntcacttgaggccagatgttcgagaccagcctgggagacatggcaataccccatctntacagagcatttaaaagttagccaggcatggtggcatggacctgtggtaccagctaattgggaagctgaggtgggaagatcacttgagcccaggagttccaggctgcagtnagctgtgatggccccactgcacttccagcctgagcaacagagacaga

SEQ ID NO: 682429 - DNA, 159 bp, Homo sapiens
attcgcggccgcgtcgactgaggacaggtgtaaacaagctctattattaacaataatgccttgtatttgtatagtgctttataattaacagagagcgataacatccatcaatatatttgaccctcaaaacaaccctctttgagtgcttatgcatctgta

SEQ ID NO: 682430 - DNA, 226 bp, Homo sapiens
tgataagctcgcaccatttagagcaatgagaagatgcagatacaggatgcacagaagcccaagtgaaaataacgagttgcacaacagtgtatacattatatttgtgtatatatgtacacttatatttgtacatttctatataacatcaatgcaaaggaaagtgtctgattttattatacaccaaaggttatcagtgaatctctgttgtgatctccattttaatata

SEQ ID NO: 682431 - DNA, 174 bp, Homo sapiens
aaggccccccgggggggggggggggcccggttcccttttttttcccaaggagggggggggggggccccgaccccccccgtccccccccccccagggggccccccaaaaatttacccccccccttgggttttttttttttttttttaaaaaaaaatggaaaaggttttggtccca

SEQ ID NO: 682432 - DNA, 226 bp, Homo sapiens
attcgcggccgcgtcgacttcttttgtttcttctccttccccctccccctacctccttcccctcactcctcccctccttcgctcgcgcaacctcttttggtcactatgtgtcacttgaagctaatttgtactactggatatctgactggagccacacataccgaatctgtattgtccttcctgaaacacagcatggaattaacattagacttaaataaaacaaacc

SEQ ID NO: 682433 - DNA, 363 bp, Homo sapiens
ttacccaagcatttctatatgcacagctacatatctgaaaaagaaatcaagaaagtatcccatttatatagctacaaatataaaagatacctaggaataaacttaaccaaagaagtgaaagatctctacaataaaaactataaaacactgatgcaagaaactgaaaatacaacaaaatggaaagatattccatgttcatggattgggagaatcaatattgttaaaatgtccagacttcccaaagcggtctacagattcaatgcaatctctatgaaataccaataatactctttacagaaatagaataaattatcctaaagtttatactgaaccacaaaaaacctcccgtaggcaatcaagctt

SEQ ID NO: 682434 - DNA, 468 bp, Homo sapiens
  misc_feature (63)..(63): n is a, c, g, or t
  misc_feature (149)..(149): n is a, c, g, or t
gggatcaacccacgattgtgtgcccctttttttataaaaactggaatgtttgaaggttgtacnacaggctgtccttctctgttgccaattctggaaccaaaatatgcagttgaaaaaatagtagaagctattctccaagaaaaaatgtncttgtatatgccaaagttgttatacttcatgatgtttcttaaaagctttttgcccctcaagacaggactgcttatagctgactatttgggcatccttcatgcaatggatggctttgttgcccaaaaaaagaagctttaaagcccacctttatggctaaggtcatttgatacccagtgttacataatgggtccttcaataaaaaaaagtatttttgtctgccagtggaatatatttggagcccccaagtccccctcctattttgttatctggactagaattttcaatcaatgtgtttgaaaataatgttgctttccccta

SEQ ID NO: 682435 - DNA, 118 bp, Homo sapiens
  misc_feature (84)..(84): n is a, c, g, or t
ggcctccctgtggcggcggcttgttgttgtggaggccataatggcggctcaggcggcggcagcggcccaggcggcagcggctcngtctgcgcaggccgaggcggccgactcgtggtac

SEQ ID NO: 682436 - DNA, 481 bp, Homo sapiens
ggatccccaagcagttatacagactcatacaccagcctactgctatttgtacttatataaccccctcctcttgagagtgggctggatcaagtgactaacaaatagaataaagcaagtgtgataggatgttacttctaagattaggttacagaaggctgtgacctaacttgcagcagactcatgctggcttttgatgaggcaagctgccatgttgtagaggaccagatggcaaggaactgagggcagcctttggcaaacagccagcgagtaacagaggccctcagtccagtagcccacaagggactgcatcctggcaaacaaccacctgagtaagcttagaaatggatccttttccagttgagcattcagataagaccacagcactgaatgccttgattgcaggccttatgagagacccctaagcccaaggaccgagttaaaacatgcctggattcccgaaccacaaagaatggtgagacaa

SEQ ID NO: 682437 - DNA, 930 bp, Homo sapiens
  misc_feature (930)..(930): n is a, c, g, or t
aagtgctcgattacctgtggcagagtgaatggcagtcccgtgtaatccaattgcatgcgttagatcacaggaagacatgcaattgaatgttttgcctcagaaaaactgagcatacagggcatgccatcttcaacccggcgatgagaacaattagtgtaaataccataagattacccagactgatggctcgtgatttatcaaagtgcctgggagatcagtggccagtgtactgccgagtgatacgtgaaagaacctatgtcaggacatgcggtggtatcagcgctgctgtgaaacatgcagggacttctatgcccaaaagctgcagcagaagagttgacctctagcaggctggctggatcacagctcttggcaattacattatttataaacacacacactagcatgtttttccagaccaaatattatcagattacatataatttaatcaaattactttattttttgtgcctgccaaacatccaatgtggtgcttgtttggttacccaaacatttttgatttatactatattggttccttaattaattttatatgactgaatttagtgggattccagtaatatatacacaagacacaagcgaagacaattgattcatttattccttaaaacaggttgtcggtggtggtagggccatctcctaagggctacctctcccccataactttggattatccgaagggttccggcctagcctaaaagttaagcggattaccgaggaccactttggtgtggggccgggcgaatacccctttcttcaccgcggaagtggtacacatgacccgcgctggccgcggtacaagtttaatagggcacattaacaccgacgtgggtttcatggtggcagaaacaatcgttttctcactagacagacactggcgccaacagcttttcacgaccattctaatattcn

SEQ ID NO: 682438 - DNA, 712 bp, Homo sapiens
cgggagtaaagatggccgcgctgtgcaccgctgcccccgtccccgcacagttcaagagcatacagcatcatctgaggacgggtcaggagcatgatgagcgagaccctgtggtggcttattactgtcgtttatacgcaatggagactggagatgaagatcgatagtaaagactcctggaagtgtggcaaatttttatcagaagttaatggatacagttaggaagtcgtctagagagaagcagtggggtgataatgaagctattactcaagaaatagtgggctgtgcccatttggtagaattatgcttgtgaaaatgtttttgtatgcagacaactgaagatcgtgctggacgatttcagcaaaaacatgatcaagtccttctatactgcaagtcttttgatagatgtcataacagatattggagaactgcacgtgatgaaaatgtgaaagcacaggaagttatgccagatggcaaggcaatcgatacatccatcacattgtcgcaaagaatgggggagactcctcaagcaggccctgtaggaatcgaagaagatcacatgatatgagacaaaaatgaggatgctggaagcagcctctctgcccactcagccaatcagacatcatcatcttcaagttatgacccaagaacatgccatcaggcactatactggaatacagatacctccgggttcaccaagctccaggttatacac

SEQ ID NO: 682439 - DNA, 621 bp, Homo sapiens
ctgctcgggaggctgaggcaggagaatcgctggaacccaggaggcagaggctgcagtgagctgagatcgtgccactgcactccagcctgggtgacagagcaagaatctgtcaaaaaaaaacaaaaaacagaaacaaacaaaaaaacacacattcttttcaaaaaagcacatggaagagaaaaaagcacatggaacacattcactaagatattatattgtgggtcgtaaaacaacatctaattgataaaacaatttcacattccttatcaaaattccagcagaaatttttatagatataaacaaactgattctaaaatttatatggaaagctggctgggcccggtggctcacacttgtaatcccagcactttgggaggctgaagcgggtggatcacttgaggtcttgagtttgagaccagatcagcccggctaacatggcaaaaccccgtctctactaaaaaaaaaatacaaaaactagtcgggtgttgtggtgggtgcccctaattccagctactccggaggttgaggcgggagaatcacttggacccgggagacagaggttgcagtgagctgagatcgtgccactgcactccagcctgggtgacagagcaagaatctgtc

SEQ ID NO: 682440 - DNA, 651 bp, Homo sapiens
acttgtgtgtttgcagctgtgagagggacacaactggaaagtgactgctactggatctacgttccttttgggagtccagttgcattatttcataaatatagtagaaaccacaaaatagtctatttgaaatggttgattctaggcataggaatatagctgttaaagtggtgactgggactccactagcgtccagccttatggctttatttgaaaaatctgagtatccagtaaaaatgggctatcactgacagctcacatggccatgtcctgctgaagctagacagcagctacccctttaaaaaagaatatgtactctatagtatactagtctctaccacttcaaagttacctgcctagtccatacagatatggtaactcctaagcctcatatggtgaggaggagaactggtagtggtagcagcgaagacagatacaaaggtgaaaatacaaaggacctgcaattaaatgattcccctaagataattcaactaataagtggcagagctaggaacagactgtttattaatcttcagaaatttattctctacctaaaactaaatggtcaaatttatttactcttataatagagatacctaaacatactttactttaactatctcctttgttctgtagtaatcatattctcgcaaa

SEQ ID NO: 682441 - DNA, 214 bp, Homo sapiens
ctctccctaccatattgacattctctggcttctcttatgctatcgtccgttcggttagctcttacatgaaccattgtgctcggcaggactctaggggctcctctttagtcgtcctgcgagcttgcggtgtttgactatccgcctcgttcgatgttatacctgctttccggttgaactcggataaaacccctgatcgaatccttcaccaccttct

SEQ ID NO: 682442 - DNA, 853 bp, Homo sapiens
gcttgtttggcggtcccaacatgtggagttgacggtgaaggtcgcggctctaagggggctttctacaagggatatatcaaagatgtcatgaagactcccttacagtggttggaaaataattgggaaccagaagcgccaggtcccatttaagtgaagttagataaccaccaccactgtgtatataaaaaagagaaattagtgaaggagatgaagtagaggtatatcaagagcaattgaccaagagccatgtgggtggtgttggctaaagttcgggatgatgaaaggagaattttatgtcatggaatatgctgtgtgtgaggctacttacaatgaaatagtcactatttgaacgacttcggctgtcaatcaaaataaactgtcaaaaaaaataccttcttataaatgcacaaggtgatgtcctgaggatgggaagagagggtgtgctatgaaaatgcacataagagatttaagaaagcagtaggagcatgcagaattttttaccatccagaaacaacaagtaattgatactgtctgccagtgaagcaattgtgaagagagtacactcttagagtgaaatggcattggcgaagtattcgtaagaaagttggatgcttattgtccagaaatgaagggggcattaagcttttaggatgcgcaaaacaattggacgcagttttcatgaggaatgtgtgtgagagaagagctaatgggggggaaaaaggacactgtgtttactccagcagtagaaggtctgggtaccgcatgggtaatgaaatggacatcaaaatacgagagggtgggggaaaaggcaaggttgagggggaaaaaggtgaattggaatgaagaggtctaa

SEQ ID NO: 682443 - DNA, 461 bp, Homo sapiens
tgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaaccttaaaaaa

SEQ ID NO: 682444 - DNA, 450 bp, Homo sapiens
  misc_feature (367)..(367): n is a, c, g, or t
  misc_feature (386)..(386): n is a, c, g, or t
  misc_feature (420)..(420): n is a, c, g, or t
ggtgtttttgagacggagctcggatctgttgcccaggctgcagtgcaatggcacgatctcagctcactgcaacttccacctccttgcttcaagtgattctcctgcctcatcctcctgagtagctggaattagaggcgcctgccaccacgcccagctaatgtttgtatttttagtcgagactaattttcaccagtttggccacgctggtcttgaactaatgatgtcaggtgatccacctgcctcggcctttcagtgtgttttatttttaaagcagattactttattgaatagtttttgttggggtacttaagtactttacatgctttgcaggctggctggatttaatcagttctttgaggggaggtantctgtcatccttttcaggngaggggaactaagggttaggagatttatgtggantgcctagggtcacagtgacgtttggtggga

SEQ ID NO: 682445 - DNA, 738 bp, Homo sapiens
ggccgtggactagcagctctactaggacactgggctgggggggtgtgcttggtggttctggtaatgattgtcgtgacggaaaacagctccatgcgggaatatagcagccacgaagaatcatcaaggtgacgcgcagaattgtctgcgccgggcactcagtagagatcctcaaacacggtgagggtctcggagtcatgtcgcaactgtgctgcagagatcatcacaacagcatcgtgcgcgctcgcgatggacgagttatatctcgtagagaaagggttcacaggtagctcggtgtttcgacccttaatgtcgcggccgggagcgacttgtagtaacgagagtggtgcgcaagagagctcataacaagtgccagcgaagatgcctgccaagtgtatactgtcaaggatctgggagagtgctcgatccaaatctcaatcactcatcaccctcggacgaccagtgggagctcgaagcaggggaaactgttgttggtggagtaacttgcaaggggtgccgccagctgaactgactggtctaggcctagccgaaacgtctataggaagggacaaaacgctagtcatggttgaggaggagaccaatgtcactggttcccttaggctctcgagtgagaccacgctatggacgactgtggtatatggcctgaggagtcatgcgagttatctacggatgtcatctcctttgggatacgtgagatggtgttccagataaggtgagcta

SEQ ID NO: 682446 - DNA, 112 bp, Homo sapiens
aatcagctcggtacccgtgatcgcgaatggcggtcggggcgaaaccgaagcgtttgcgaaacgttcggcgaaacgtgatgcgctttcatagccgacatgttgcgcgatggcg

SEQ ID NO: 682447 - DNA, 536 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (464)..(464): n is a, c, g, or t
  misc_feature (526)..(526): n is a, c, g, or t
ccaattngncntggacacgaaaggattttacaattgcagttcactccctagcagaaaaaacagcaggactctgtactcgccataacaaaggaaatcactgggctacccagtgctgctcaaaatttcatcagaatggcaccccattggtaaatgagatgggggcctgcacccgggcccctcaaacaatgagggcattcccaatgcagaccacaaccccacttcagggatgggttcctggaggcacattgattccctcaacccaggaacaccaggaagtgcaggattagatctacccaccagagaaagaatcacattagttaggggagacaaacctatttgggtatttggggacctttaccgacaggatacacaggactaattttaggtaaaagctgccttaacttgcaaggcatcactgtagtcctaggaatgactgactccgattatgaaggagaaattcaagnagttttaatgtcacaaaatctttgggtttttgaactgggagaatatattgctcaattattgnttattccctg

SEQ ID NO: 682448 - DNA, 439 bp, Homo sapiens
ttgaagactcttgatgagaattgcctggtagcttttttagaaagattgtcacagcgtttgttgccattgttactgtattgtagttacctttctgcttgtctgctccctttcttctattacttgataagcttctaaagtcctttaacaaacatctcatggatattcagggttgttagcattaatggctctatattggaacagaagtataacagaattttggatctaaatggaaccctagagggtgtctagtccaacatctcgtaatggagcgttccctgccctctggtcagctaatacaatggggctttgacagaaagatggctatacgaaggaggtttattcgtttaaaatattgcatatgggattacaggcgtgagtcactgcacccaagcctcctttctcttttgcctattaaacctctgctcttaaccttaaaaaa

SEQ ID NO: 682449 - DNA, 212 bp, Homo sapiens
ccccccccaaagggggggggggggagaaattttccccccccccgggggggcccccccgggggcccccccgggttttccccccccgggggggggccccctttttttttgaagcgccctcctttcccccgggggggggtgggggggggcccccctctggggggggcgggtgtgttttttctcgggcgcaaaaccccgggtttttttttttttga

SEQ ID NO: 682450 - DNA, 795 bp, Homo sapiens
taggctagtacgaggccgggtgttaatcggccgaggctcgaactggctgagactgagcacgagaacacgggttgaggcacaacatcgagcgcatgaaggaggagaaggacttcaccactactctcagaacgcaaacagcctactacaggagaaggagtgcctctatgtcgcaacgcctggtggaccggcggaaatggatgaggcaaccagtgcagaatcgcctgaacgcgaggcacagtacttcctattctacaccctagtaggctcccttcccctactcatcgcgactgatttacacgtcacgagcatccgagcccagaaggagcgagccgagcaagagcgaggagtatgctgagcagctacacgtgcaactcgctggacaaggatctttatgtcgctgaagcttctatccactctggaagtcctggaggagccgctacaaccaaggttgtacaagaaacagggagaccttgagctggaaattattgtcctgaatgaccgggtaacagatctgtaaaccaacaacaagaccctggaggagaagatgcgggaagaccgggatagcctggtggagagactacaccgtgcagactgctgagtattgccgcattcaagcgtggaggaatgagaggctgaaggccagcttgtgctccaatggaggacaaactcaaccaggcacacctcgaggtccagcagctgaaggctcagtgaagaactatgaggggtgattgcaattataagagtcggtgatgagaccgattggtgcgatgaatattgccagaaaaagcgggagca

SEQ ID NO: 682451 - DNA, 404 bp, Homo sapiens
gaacctaatccatgatcactgatacactccataatcccgtgcgccgttggcccacaggaaagaacatcgggcgtatagtccaggaagctgagaagtacaaaagactgttcatgataaccagagggccccggtgtcatccaagacttcacttgaatcctttgccttcatcatgccaggaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcccgggggtaggaggt

SEQ ID NO: 682452 - DNA, 491 bp, Homo sapiens
cgaggtggctgcaaactcgcgggcacgcacggcgcccggggagccgagggactcgggggaggggacgcgcgcggaaggcgccagcttccgtcccgccgcgcccctggcagctcgcgagccgaggttaggaggcgcccggggccccagccgggcagagccgagcggcggcggccggcggcggcttccctattgctccccgaggcacgaggccccggagacggcgcggggaccgggccctaaaaagagcaggaaatctcgatgaaccgcccgcggagagaagccgatcgagccatttgtctggaacgtcagcgatctccggcatccggctgcaaatgtgttcctggtgacattagcatcgggcagacccgccggaggagcgaggagagtcgccaggttcccagtcgtgctttcgagaggcggatcgagcgggtgacttgaggtgcattcgtatgaatatatggcaaatctctctatttttcctccctcgctcg

SEQ ID NO: 682453 - DNA, 1114 bp, Homo sapiens
agccaaggctggtacggtcggagtcgtttggatcgactcttccgaggctgagcgctggggctgctcggggcggggctgagcctggggaccagtgtgattaagtactgtgctccaggatcccatttggtctgctcatggccaagtgctgacctagcgcgtcgatgatgacctaccaggtgccctccaggtgaggcaatttcatgcagcgccttcttggccttcctttcagaggtagtaggtgggggccagtttatacttttctggggtgctggcatctgccctggataggatcaaacgtcttctatctttcttcctgctccttggagctctgttactatcttcctccctaggaggagcagcggtttcctggtcttggaaggccttgtacctcgcataagcactagtttaggcgcgaggcacgctatgaggtgggaaagctgtgtgtcacaggagaaggctgccagcttcatggcgtcctggtccgggtcctggatcccagcctctgccttctgaaaccccttcttgggcagggacatgacctcgtgtgtctgaagcaggatctgggagcggctcctgtgccatgcggaatgcagcagactcggttggctgaggacctcgcggcgggtaactgagtgctgtgcactcctgtggtccggaagggccacactgcctctgggctcttgatgtgatggcctgtgtggacagtgagagcatgcacccaaagatctggtcaccctgatgacccattcttactcacagctggatggactggcggctggagcccatggaaacaagggtggaagccagcagggccaagtaaagatggggccatgatgacgagaaagctgcagaggaggcccaaagggcggcgcccaaggccttaaagctctcagggactggcctattgacaggactgctggcaaagtacagacgaagaaatcatatcaattccagacttaacataaatagcagtgaaacagcacacggcaaagactcatacaggaaacaatctccaggagtccgtaaaaaggatactctcacaagtcacaatctaaaacatcaattaggttaacaaccagggaaatgatccattttcacaacaaagggcaatcca

SEQ ID NO: 682454 - DNA, 244 bp, Homo sapiens
agaccgatctcctttggcaggtatctagtataaagtaactgtacaacatatgtatcgttgaagcagaaactttacaccagtgtcattatgttatctatagagacgaaactactaccacaagtaagatgggcttacaagtatgacacaagcctgtgagagggcatgataaagattaacttttgattgcctatctttaattatgatcgctactactgtctgctcacaattcctgtgcgcatttcaa

SEQ ID NO: 682455 - DNA, 107 bp, Homo sapiens
tgctcggaccatgtggagaaggagatgtgagaagaggagatgtggagaaagtcagctctcagaacaaattagtcagcttcagtctcgatcagcagggtcttttggat

SEQ ID NO: 682456 - DNA, 780 bp, Homo sapiens
tgaaggcctggaatgagccagacaaggttccagcatgaggaagaaatgataggagagtgacggatgaggaattgaaaggagtgactcgcgtgagacagatgctgtgggcgtccttcactatcgtactgagtagtgcgcccttggatattgaatgcaaggaaaagaatgatgagctctgctggctagagatatgaaacagaatcgagagctgtgacagcattagaaagaacacgatgctccaatcagactgtgtgtgaagagaagacttggatacgtctctgagttggaagaattggaacggctgtggagagccaccggcatgaagataagatggaacaagatcggacttccatgggcatgaggggggaaggccgtggggaaaagaagtgcgttgtggctgaagtttgcgcttctccgcgtggtcaacgagtcagtatctatcgaataaacagtagaatgtgaagaggagagggcgaggaaagagatagagaatggggaggaacatattaagaattgaagacatactgaatggagatagccctcataggaaagatggtggttggaacgtagaagggccgtaagaacaaagattaagaagaagaaacgaggaaaaggagaacgcgagggtacaatagacggatagaagacaagagctagcatgtggcatttaagccaatcaagaaaaggaaagaagagaaatcccctggtctgattcagaatcagataggagcagtgacgaaagtaacttttgatgtccctccacggagaaaacagagccac

SEQ ID NO: 682457 - DNA, 133 bp, Homo sapiens
tccagctggcccccaagctcgtgcggtgaccccactttctccaagccaggggaggggtactgacccacaggttggtggggggcagactcccttctcgtgcctcgatttagtcacctgcagaattcgtgggagc

SEQ ID NO: 682458 - DNA, 936 bp, Homo sapiens
gcagatagggcgtcgcgccgaggcagcggagcgttctgcgggctgactggaggttggcagctgggcgggagaaagaggaagtgcaggcgcggctgggcctcggcctctggcgccgtggtaccctttgtctcggcagcctgacggccccgcctgggctctccggagatggggaacgggcggcgagggtggcgtggtcctgggcgccctgttgctgctggggccgagatggcgctcgggtcgcggccgggatcggccggacccagaccagggttaactggaacgagccgtggccaaagatcccacagcgcagtgggccccaccagcaagacagaacagacctttggcacgctgcgggacttgcgacgtccatgaagcgcggagagaaagccctggcccgtatctgaagggccttccggtaacctattcttgaccccacacaagaagcttccgaccagaccaggagcacaccttgccgggcgcttgacccgtagccttccagggcacaagaccgcttcgacacacatatcgggccagaggtaccatcctcctagccccatgggacaaacaggtttatcagttcaacgtagatggatagttccaacgatgatggatctgcgggaggttgaacgccttcactccccaaaagtcgttggtaaggcacattcatgcgatgattagccccttaagcccctcaaagggggttgcaactcaggtagacacacaccatagcaacaccccaagaaccgggtcagattgcatctaccttgggtcacttgcacattaaggatgcatgggatgtactatgccccgcacggattcctcaagggccatcaggtaaataaccacgggttacccacaaagtatacggttcttgggctcattgtaagaatgcccttcgacttatgtaagcagtggtagtgccaaacgcgggaaaaa

SEQ ID NO: 682459 - DNA, 237 bp, Homo sapiens
tgtacccctaattgcttcttcgatgacgtatactcattcaaacattatttaatacaattaaacattctgtgatcaagtttgcctgatcccgtgagcacctgaacaagagagcacagtctctcctctgcctactcctccagcctcatttccagtgaatcccttctacgtctcatcactgattcacttcaacaacataggaaaagcaaagagaggctggctcaataacccgtcatcgaa

SEQ ID NO: 682460 - DNA, 669 bp, Homo sapiens
  misc_feature (476)..(476): n is a, c, g, or t
  misc_feature (569)..(569): n is a, c, g, or t
  misc_feature (644)..(644): n is a, c, g, or t
gacacgatctcgtgttcactgcagcctccacctcccgggttcaagcgattctcctgcctcagcctccaaagtatttgggattacaggcgcctgccaccacacctggataatttttgtatttttagtagagacggggtttcactgtgggccaggctggtcttgaaccgctgacctcaagtgatctgcctaccttggcctcccaaagtgttgggattacaggcatgagccactgtgccagcctcttctaagagttttatggttttagcttacgtttaggtaattggtcaattttaagttaatttttgtatatggtgtgaattaggggtccaacttcattcttttgtatgtggaaatccaattgtcttggtaccatttgttgaagagtctattctccattgattagacttggcatccttgtcaacaatcatttggctgggccaggcatgtggttcacacctgtaatcccagcactttgngaggccaaagtttcatctagagatgaaaccccatctctagaaaagtacaattagctgggcatggtggcatgtgcctgtggtcccagtacttgngaggctgaggtaggagtcacctgagctgggagtttgaaggtgcagtgagccgtgaatgcaccactgcacttcagncttgggttggagtgagctctgtctc

SEQ ID NO: 682461 - DNA, 375 bp, Homo sapiens
  misc_feature (22)..(22): n is a, c, g, or t
  misc_feature (177)..(177): n is a, c, g, or t
gctgttgccaggctggagtgcntgtggcatgatcatggctcactgcagtctcaaactgctgggctcaagcaatcctcctgcctcagcctcccgagtagctcgtgccttcagtctcttgcctcgcacctgggtggcttaccgccacaacccaacgtttggcagacggggacagcagancgggagagaacagatagcttttctgtagcacgtatgaggcatcagtgaacgtgatacctgtcatccttgctcttccgagtgcctggctctgtcacatggctctcaggctgctgaagcattaggggcctatcagagacataactttttgccggcaggatcctccgggaatctgaataaagctatggctctttttcccac

SEQ ID NO: 682462 - DNA, 566 bp, Homo sapiens
gagcgggaaggggagggctgcgggtggaaaggggcgagcccctctcgcccgtggtgacatgggaagagcggtcacggtgccgggcgaggcggcaggggcgatgttgcagtgccatgctgccgtttgtgcaaagttgggcggtgtggctgtgctgcgcctggagcgcagtgggacctctgaacaacccgcgacagcgcgcagagcgtggctgctgctgagtgagcgtggggtccccctgctcccctccgagacccttgataggctggaggagagctcggcgtctcgctcaggattcagggataagtcgcaactgtgagcaaagagatgatatctgatacattcacattcaagaagaagcacaggaagcgtcatatcatatcgcatagggccaagcgtatgattagcagattgagttacaggggtgcaggatcccaatataaactgctgggcagaagtataaataagattggaggctgacaatggactacgaaaagaacaaaagtatgaaaatattaaatgtgatggtcagtgggtgaaaatgcgggagaagaagcgcttgatatgtg

SEQ ID NO: 682463 - DNA, 906 bp, Homo sapiens
tttgaccgaaggctgctggagactcgtgttttggacgcgatgtgtcgtctagagctcacttactagctctatgagctaaactggctgtgggttctcgatggtaccatgccggatcacagcccatccagatccgccgaatactaatgatggtggctacctgggagcatctgaagctaagctagccaacctatctggatcttgtttgtggagagaagggccccattgcagcaaactctccatcattgttgatagatcaatcctacaaagtgatgactcggtgatcaaggtaccgaataaagatgaaggggatgtttgtaaccatgagaaaaagactgcagatcttggccctcaaccagaaagagcaccaacagaagaaacgttctggattcagagacagaaaagtgatggaatatgagaataggattcgagcctactccacgccagacaaaatcttccgatattttgccaccttgaaagtcatcagtgagcctggtgaagcagaagtgtatatgacaccagaagattttgtgcgatccataacacccaatgaaaaactaaccagaacacttgggtctggatcacatatataatacacacgcttttggatgcacacagacaaccttttcccagggaaacgagaaaaattttgcttggatgaatggccggtataattttagcaccccttgggcgcaatgtggcgccctcaatacccttctccgactaccctttttctccaccaactgttcctttccctcctcccgcaaattttggaattgcgcttcagaaggttgacttgaatgggcacaggcaactcactttggaacttgggcggttccagcatactctcccacacgctggttcgccccacacgtccccatggaccccacattgtgtttacccactctt

SEQ ID NO: 682464 - DNA, 985 bp, Homo sapiens
  misc_feature (985)..(985): n is a, c, g, or t
tccttcgaggggctttttttccccggtcaagaaaaagaagcagggacagggccgccttctgtgccgtgagcctgggcagacacaacacagaaagaccgggggatgtggggcggggagaggcacaggagacggcctctcagcaatgtgtggtgcactgtggctcccttgggttgtgtctcctgtggctgtgggtctcgaggggaaaaggcctgtgccggggggtgtgggtggccactgtgaaaacgcctgtgggagaacacgaggcggccaaggtccagtgtgtgcccgagggacaacggccagcggcacgggaagcgccacataaaatatacgtgtgtgtggcgccccaggcgcgcgggggtctctcttggggtttgggcgcccacagtgctgtggggagagatgcgagtgtacgagcgggtctgtgtccacaaatccacgagggggggcctctttggcggggtgtgtgtttgtggggcgcctcttggggggccagttatgtggcccacactgtcataggagagacccagagaacacaagtggcgcagacagtaggtgcaataggagaccacaaatatatccccacaagagacctctatcccatggggagatctttgtgataacctcttaagagagggatagacccttatgagaagatgcttttgaggggggaccacaaatctgctggggcggctattttttaccccgccccacaaaaagaggccccccaaggccacgaggatgaaccgcgccactaatattactgctaccaccaagacccaagcggcccccccctagttgggtctccaccacagagggggcggcaacaagaaggggcggtgggagccaaacagggcgtctgtgttcggcggccacaaaggaggaggacaaaacatacatggtgagaatcaggggactccacatgttgggtgggtgacagcacatacacaccaacctaccacaaagactgacacaacgacacagn

SEQ ID NO: 682465 - DNA, 447 bp, Homo sapiens
  misc_feature (45)..(45): n is a, c, g, or t
catttttacacaggtattcctctctacattctatgtctacctctnctctcctcttattctttcctagaaatcactgggagaattgtactgaatttgaaaaacaagcatgaatctttcctataggataggaagcctctgatttataccataaagtgaaatttcttatacaggatgtatcaattaagatttaattcaaaaaagatgaatttaagttaaaaagaaaaacacaggataacttccattcatctgatgttcatatgccctggcacatctattgcttcttataatgtgcttgcttaaaaaaaaaaaacatgagcttttctcagagacactaatataatgaattcatgtacccatcaccaacttctacaattaccaatattcagcctcttccatttacaacctgcccattttctaagaaataattaaagcacatgctacacccat

SEQ ID NO: 682466 - DNA, 1569 bp, Homo sapiens
  misc_feature (570)..(570): n is a, c, g, or t
cccacgcgtccggaggctgagatagcattattgacagaagcaggctttggaaggtgggtaataatgaactttgctgagctaaaggagcatgttgtaacccaatgcaaagaagctaaggaccatgataaaacaacacaggagcttatagccggttttgagagaaacataacctacctgatgtagctgaaaaacacaacacgagaacctcacattgcaatcacaagtatcaatagcagaataggccaagcagaggaaagaatctcagagcattgaagactatctttctgaaataggcagacaagaatagagagaaaagaatgaaaaggaatgacagaacctccaagaaatatgggattatgtgaagagaccaaacctataactgattgggttacccaaaagagacagggagaatggaatcaagttggaaaacatacttgggatatcatccaggagaatttccccaacctaacgagacaggctaatattcaaattcaggaaatgcagagaaccccagtaagatactccacaagaagatctgccccaagacatataatcatcagattctccaanggttgaataaaagaacaattttaaggcagccagagagaaggccatgtcatctacaagggatcctccagactaacggggactctcagagaaaacctataaggccgaagaatgggggccctttcacctctttcggaaaatttccccgaaattctcatcgggcccaaattttaggcgaacgaatagaattcttcgacacacgcctttgagattcacccgcgcgttgcaaccctcgagcacaacaggtgtcgagcaccgacacactctaccgtaccaacagcccgactcgacagcgcagtgaggtcaacgcatccgccacaagaagaaagggcgaccaccaccatctacagccagcgtaaggcaccaccgaccacaccacaccgcagactgaccgcgcatcactcacacccgaccaccgcacctcgctccgccagcccacacacgcacgcgcacaacaccgcaatccagcacagcaccaacaacctcaccacccaacgcacgcgccgcgacacgcaacgacagcgaggtcgagtaagagagacagtgcaagcacagagggcgggagacggagcgaggtgacgaagcagcgacaagacaagaggagacagcggagagaagaaagcgagggacgcgcagcggacagacgagagagaggagcgcatagtagagagcacgagcacacacgcaccgcgagagcagaacggtcacgggcaccaagcaggagacgagagcgcagagaagaacgagctgacgacagagcagtgtacgaggaataatacgagcagtcgaggacgagacgagacgagaacgcgactgaccagcgcacagcggaggaggcacggcagtacgagaagtacagacgattccatgagagacctacaggcagcgagtcagcggagaatgagaggaagcgagtccgcagaggagagaggtagaggaaggaaagagacaaggggggcccgcatacagacagcgaacagcgacacgaaggggccaagaacg

SEQ ID NO: 682467 - DNA, 419 bp, Homo sapiens
gaagtataatctcttgttggggagggtctgcatgatgctgatggctgtttgtgaaggtatgggtggctacggcaatttcttaaaacaagacaacaatgaattctgctgcctcgactgacttccttttatgaaagatttctctgtagcattcaatgctgtttgacagtgttttatccacaagagaagttctttcaaaattggagtcaatcttctcaaaccctgtagctgctttattaagtaagtttatgtaatattctaaatcctttgttgtcaatttcaacagtgttcacagcatcatcaccaggagtggatgccatctcaagaagccacttactttgcttatccgtaagaagcaaatcctcacgcattaaagtttaatcataaaactgcagcaattcagtcacactgaaccacgggct

SEQ ID NO: 682468 - DNA, 112 bp, Homo sapiens
gacacttttcccttgagaaaagaggagatggtcctaaaagccgaattgagccagacctgtacacctgacatgatggttctctcttggcattcctctccattgtctacatggt

SEQ ID NO: 682469 - DNA, 235 bp, Homo sapiens
gttaactcgaggcgttcggggtatccgtagtacagctagaattcggtggactgggtggacagattcgaaggttgtatggttcaaacgagataaagctgacaggccatttgggatgctgcctcagtgtgattcacaacgagacagtccccatttatgagagagtgtgtgacggatgaatgattggatttgcatagttaccttgttagagcataacagcatggaagactgtctttag

SEQ ID NO: 682470 - DNA, 899 bp, Homo sapiens
  misc_feature (566)..(566): n is a, c, g, or t
gcccgaaatttggcgtgtttaacaagagaatattttatggtggattaagaggaagactttgggcccctttggagcaagaatttttggccccaggagaggagatgccgcagaattacctccttggggggatcacaccaacccggggcttcttcctctggggaactgtctgggagacactcgcctcgggggggaaagagaggatatgggccgcttgggccgctctgcacaacctctctgtggagaatttagagggtttcttccatattgggcgcaaggagggaaaaaagaaggttggtgtcccagccccataggagtatgaacgccattaaggggcgcctccccaataaagaaagggggggttctttcgggcagagaaaatatgcgcccacgtgccggattgtgtccgtctttagttgggggtccaagcgtggacggttcccttttaacgtggatgtggtttccccccattggcgcacacttgttccgcacccctttggcgcacatgagggacccccttgaaggacacacccacgttgttctaaagcgtttcttcccttccgctaccnagcgcgtcaaggactttggagcaccacatctttgtgtgggacatcccagagttattttaaagagagaacaataccaagaccagagtgattttcttagcgaccgttgtgagaacaaccagtgtgataagaccttctggaggtgatattttgggcgttgtataataagaaacccaggtgtttttgtattggttaaagtgattaaatgcccttagaaaagcaccccgggcgaaaatttttgttaaagatagatattttccaagttttacagaattacaatttccaaaaaagggttttatcaatgaagttgtttatttaaaacttttggatgatgga

SEQ ID NO: 682471 - DNA, 452 bp, Homo sapiens
  misc_feature (79)..(79): n is a, c, g, or t
  misc_feature (143)..(143): n is a, c, g, or t
  misc_feature (171)..(171): n is a, c, g, or t
  misc_feature (210)..(210): n is a, c, g, or t
aaatgcttttatttgccaaaagttttgggtgattttgaaatacattagacatcccattcattgaggatttctattgtcnattgttaaacattctttaatagtcctaaactgattttttttatcagagcaaaaggaacaaaggnaaaaacccacctgaaaaccgatctttgnatcatggaaattatgaagctggaataattagacattaangaaattcacagacccacatagtttaaaaatttaatttttaagattaaattttcacaccacattatgactgtaaatgagttacctgaataccaattattacctctagttatttttagcaagggagctggacttcactttacttaatgctagcttataaatctaactttgtaaaattatagtggaaatgtgtcctggctagctgcctctgcccaacgcaaatgttctcttcccttagtgcctca

SEQ ID NO: 682472 - DNA, 658 bp, Homo sapiens
tgccaagtgcccccacgacctggtgttcctgtaaccaaaagttctggcaattgtcgagagaccccaatcccatcgtgtatacaacgccccgcattcataactaattttcagagtagcctccatcatatttttttaaagagaaccattttttggctccctgaacattatagtaatcatctaaagttttttacataacaaataccattctcccccattaattaacccctttgtaaaaatctaggcactgctaatttcattgacacacttctttcaccacccctgtttcctcccattcgcgaaatcttttttggtttctcccaaaaaaaatccaccctctcggcggccccttcttataaaactcccctctccttatcggcccatttaatttacccaccatcgcgggaccaaattctttgaacaccccaccttctccacaaccacttttacttgcacccccgaccatcttttcgaacttccttgtcgcccgcaatccttaacagaacacgcaagataaaaattaaccacacaaaccctgtgtcattaactccccccctataatctataaaccaccaggtaacaaaggatccccttttttcccaaagtaaaccccaatgctttaatgaacacccaaaattgagtgggggagacataagacaac

SEQ ID NO: 682473 - DNA, 469 bp, Homo sapiens
ccgtgattcgtgatagctcgattctagagtatccccatgcgatagctcggggagtctcgatgatgctgcatcgctctgcagtgtcgtacatatgcactcaccaaatcagagctgttggtagaacagtacctctcctctcactgaggaagaactagaaaaaagaagcaaaaaaagttgaaggatttgatctggttcagaagccatgttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattgggtatgatgatactgatgagtcccactgtgc

SEQ ID NO: 682474 - DNA, 138 bp, Homo sapiens
agagatagcttcacagttctctttacatgagttcttttccagattttgctgtcaggcctagactagttttgtcaaatgaattaatgacttttcctttatcacttctctgtaacagatttactagtgtggcaataaact

SEQ ID NO: 682475 - DNA, 203 bp, Homo sapiens
caggatcccacatgatgctccacgctcaaccgactgctgtcaccttcagcgttccagtttttaaatcctgagtcaatgccacaaaaaaaaaaaaaaaaaacccaaaccaaaccacaaaaacacaaataaggccatgcaaatctcattttgtttcctggcccaattaagttttggccaagaaaggggttaacggcacttaattc

SEQ ID NO: 682476 - DNA, 730 bp, Homo sapiens
  misc_feature (20)..(20): n is a, c, g, or t
  misc_feature (159)..(159): n is a, c, g, or t
  misc_feature (282)..(282): n is a, c, g, or t
  misc_feature (287)..(287): n is a, c, g, or t
  misc_feature (310)..(310): n is a, c, g, or t
  misc_feature (312)..(312): n is a, c, g, or t
  misc_feature (315)..(315): n is a, c, g, or t
  misc_feature (396)..(396): n is a, c, g, or t
  misc_feature (400)..(400): n is a, c, g, or t
  misc_feature (444)..(444): n is a, c, g, or t
  misc_feature (497)..(497): n is a, c, g, or t
  misc_feature (559)..(559): n is a, c, g, or t
  misc_feature (590)..(590): n is a, c, g, or t
  misc_feature (602)..(602): n is a, c, g, or t
  misc_feature (659)..(659): n is a, c, g, or t
  misc_feature (709)..(709): n is a, c, g, or t
cgctcacacccctggggggncacagaggtgtctgcacagcagggcttcctccttccctgggaggcccatgaagggagacagatttggctgcaggacctgctgctacggggcaccgtggacgaataggtacggctgggtcagtgggcgggcccttgacantgaggctgatcccgcccccacagcagcctggagatgctcacagcctgctgatggtttcttcacaaagcgacctctccagggaacatccgcaaataaaccccgtgtggttcagggagtgagggnccggncccgctgggaacgggggtcagcnantgntttaatcccccagatgcagggtgctgttcggctgagggagctagagggtgcctgggactagggggttcataatggaaaggnaaanaaaaaaaacagccagggcagagcactggggagccccagggagancagccctccacctggggctgctgtggtggacggaccctctggacctgggtatncagggtgggcatggggcagtgctctggacactgggggttgctgtgctcgccaccatggtgancgcagcaggtgggaagcgggtcccaaggcangcagtccaagtnatggagtgcggccagcctggctggcacccccacatctgctcactcccaatgatctcnaagccaaggtgtgatagcagggctgccgtgttcaggagacacagagcgtncacacagcacggacatgcgca

SEQ ID NO: 682477 - DNA, 128 bp, Homo sapiens
gaagttccagcgcagctagaccgcggggttttcggcgcgaggcggagcttggcagttccgtccacttcagccgcagcgaccctcgttgaatgtcttgttgttgcctccggagaggaacagaccctcac

SEQ ID NO: 682478 - DNA, 111 bp, Homo sapiens
tatcaccagcagtggtatctgttcaatgactttcttattgaacctattgataagcatgaagctgtacctcaccccgtagctgtacctcacccgtagctgtacctaaccgta

SEQ ID NO: 682479 - DNA, 348 bp, Homo sapiens
tagattctccaagtgttctcatgggtcggagccgacgcttcgcaagttcctatctctgactgtccctcgtgccctgtgtgagctttgtcctcccaaaagagtggggctcagatggtagcaggcctgagtgtgctgtgtcgggggcattggtgatacacccggatggtgggcggggtgtgtccgcacgcctaagttccagtcatttccaacaatgacaagagatgcccttttgaggctgggcatccgttggggcctgtccccacggcccccgcggggtgagccacgatgctccccataccccacccattcccgatacaccttacttactgtgtgttggcccttatcgag

SEQ ID NO: 682480 - DNA, 253 bp, Homo sapiens
actgtggtgtaccgtgaagcaccatttatagaccagatgtgaacgatgctccctgagttagtgacgtggcagatctgtaccctcagctttcgtgcctatgtcagatattgctgatcaatcagagtctggatgaggactccgaatccttctcctcctcaggggctcagacaacacctgcaaattcctcagagttagcatatgcgatgctcagtatttgctatcattggccccaacctcctggagctgatggcag

SEQ ID NO: 682481 - DNA, 249 bp, Homo sapiens
tggaaacagcccatggagcagcgttaatgtccatatgggagtctgtgctgcctttgaagctaatagaagaaacatataagagtctgatgcagaaaggccagcggatgcttgcaagatgcccaagatctgcagagactaatattgaccaatacataaattacttgaaagaaaaatgggcatcggtggaaaccaaactcaatgaagaggcaaactaaactggaagaggctctcgacttagcacatggagta

SEQ ID NO: 682482 - DNA, 1317 bp, Homo sapiens
gacacgtcatgggcagcgccctgaccggagccttcagcggggggagctcggagccctcccagcctgctgtccagcaggcccgccgagcggccgctggcctcccagcgccgtgacggatggggcccgtgcagcctacgagaatcaaggcagattcctggacgtgttccaccaacttcagcagtgacactgtccgctgtagtgagggcttcaggcgaggccctgaagcagtgcaagtatttaccagtggtcatgagctccactgccctgacagaggatcgagtgcagacatcggagggccagatcactgcacccacactcatacccctacgccgacacgccagcaccacaacaccagacttgtacccagatagctgggactggaagctgagcgacggtttctcagccccacagataagcccacagacaacaaagtgtgcaacttaaaagtttactcgaaagacccgacaacagagacaaagaccaacaaagcgggagggccggatcaagaaggaacaccgcaacagagccgcgccccaaggacaaaaccggcgatacccacagcggcgccacgggcacccccaacgggcacgcacacagaagcctgcaccagcgaataataaacagcccagcgcatacggacaccacaacgaacccaccacacaggtgcacagaacctgcgcaccacccccccgcccacgccgctggagccacccacggccgaccacggccccccgagacacacataggcgacagccgccgcaaccccgacgacacccccccccccagcacacacgccctccaccacccacctaaacgcgacgccacccccgacagcccgcccccacgacaagccaacacgagcgctacccaccacaccaccgccacctccctcggccggcactacaaccggaacgcgaccacccacgccctacaactcatatcgcacgcaatctcagagtccccaggggagatcacaatctctctctaccctccgacacgcaaccgacacaaacagagcaccaccccccgccagcgcggaggtagtacaacgcaagggggggcgagcacccaccccggccccgacctccagccgcggccagaacggtgccgcgcggcgggcgagccggggaccgcagagcgtggcacaacgcacgagtgtagacgaccaacgagactggggcgcaggaacccgtcgcgaacccgggaccacccagcacggcgagggaggagagagataagcgcgggaggtcagagcaagtaagcagacagtggggaagcaagagagaagcggagtgagagaggggagggtaggttagc

SEQ ID NO: 682483 - DNA, 372 bp, Homo sapiens
  misc_feature (72)..(72): n is a, c, g, or t
  misc_feature (120)..(120): n is a, c, g, or t
caagggctttgtcaaaaacaccagttttttaggtggctgaggattccaggatggtgggtggtttcttcatanactctctcccccgattctaaagaaaagaaaagaaaaggaggaaggccnttcccttccggtgccaactgtggccaccctttcctaatcaaaggggcaattttccccttttttcaagccccaaaaaacttttccctttggttttggcccaaggtatcattttgggggcccctttggggggtttttttttttttttggcactaagaaaacaacaaaaatttttcaatttttggttcaaccccatgttttttttccctaaccccccaatgggaaaaaatagatttaaaaaattggccctgccca

SEQ ID NO: 682484 - DNA, 112 bp, Homo sapiens
cgcggtgatgtggctttgatgactttgccaaatactttcttcaccaatctcatgaggagagggaacatgctagtggaaactcaatagcaggtcagaagagtgatggaatgtt

SEQ ID NO: 682485 - DNA, 106 bp, Homo sapiens
tatcacttagcacgtgtacttcagcacgttgtcacttcagacacacagaaccaacagtagccagccctgtgcctgaatgtgactggggatcctcatagagttcgac

SEQ ID NO: 682486 - DNA, 254 bp, Homo sapiens
gactaaaagcaggaaggctggtgtgacaacatagtcgcttgcaaattatatttccaattcagctacacagttggtgctaggcgcgtgcttgtaatcgacttatgaactgcaactggcgtcggttcatcacgcagaacagccacgccgagaagcacgggactagaggcccctgcgcgacgataaagacggagcacgccaagtgcggatacgcggagacagctccgcgacatgggcactaactgagggttcaaagc

SEQ ID NO: 682487 - DNA, 873 bp, Homo sapiens
gggaaaaggggaagcgagagcaagcgaaagactcagtccccagggcggcggcggggggggcccgtccagccatgccgaataaaaacaagaaggagaaagaatcaccaaaagcagggaagagtggaaaaagttcaaaagaaggacaagacacagtagaatcagagcaaatttccgtcaggaaaaacagccttgttgggttgtcccgtctacagtatctgctaaattaaaaggtaccagtctctcagcccatagtgaagaaagacaaagggcaaaatttcttcaggggtttaggcgcaaggcaatattagagaactttcaaaaattaccatctttaaaagatgtcctccgtgctgattcaagagaagctttttatccagaagttacggtcaggtgtggcgtcctctttgactttgtgtttctgaatccactaagtgaccctaaaggtgaccggacatgtacaaacggagctggcttcaacgttgaaatggtagaattatatcacccaataatcggacgtgtgactcaccagacgcctatttaccccacgaagtacgtgcattattgttgcaggtacacattgtttcgaaccatttatcaacccttttcctcaatccttaacgggagcggaatttttgaccccggaggcaaggatgacccaatcgttagaatggaggctggcttcaattaacaggttgtatatgaatttgcctaagagtttaagacgcttccgaggttccacgctaaatattggggaaaaatattttgcccgacgttgtttggcagcttagaaccttgacagggaaaccgggaagaagttttaaagcccccttcagacttggaactcgtgaggtcccacaagaaacatattggtga

SEQ ID NO: 682488 - DNA, 319 bp, Homo sapiens
aaattaaaaccccggccagagtccgccagttcatccctttattcccccccttttgggagccccagaaggcccgttcccgaggtccggagtttcacccctttctggctaccccgttgaacccccttttttattaaaaaatccaaaaaattatttgggcccaaaggcccggcccttttttcccactctcttcaggagccggagccaggaaaatggcttcccccccggagccggggtttccctttaccccggtttttccccctccccccccccctgggttccaggtttaacccccttcccaaaaaataaaattttaaaatta

SEQ ID NO: 682489 - DNA, 561 bp, Homo sapiens
cattttagggaaaacccgacctcccacacccccaagccatccgcaccgccacctccagggaccgcccgtcagccgggctctcacccgacgccaccagatgatgatgatccaggacccaggcaccgcacacagtctccagcacacgtaccagacacacgacgagatcacagacacggagattcatcactggaatgcatcagaacaccgaaaccacaaataccaactagaaataacatgacaaaattcatcagagaacaagaattccacacacaacatacagaaacacgaaaaacaagaaccaaaacatagaggactgaagacacacaccatgaaactgaaaaaagacaaaaaacgaagaaaaacatgagaaagaaaaataaaagaaaaaaaaaaagaacaagcaaaacaaaaaaacacaaaagaaacacgaccgaaaacacaacgatgaacagccagagaataaaggaatagacatcaaagcggacagccacgcaacacacaccacaaaacacagagacacaagccactcaatcatgcaacaaaaaacctgacagaacccgc

SEQ ID NO: 682490 - DNA, 719 bp, Homo sapiens
gaggtgtagtgttcccctgctgaggggtgcctcccagttaggctgctcaggcgtcagaggtcaggggtcaggcacccacttgaggaggcagtctgcccgttctcagatctccagctgcgtgctgggagaaccactgctctcttcaaagctgtcagacagggacatttaagtctgcagaggttcctgctgtctttttgtttgtctgtgccctgcccccagaggtggagcctacagaggcaggcaggcctccttgagctgtggtgggctccgcccagttcgagcttccctgctgctttgtttacctaagcaagcctgggcaatggcgggcgcccctcccccagcctcgctgccgccttgcagtttgatctcagactgctgtgctagcaatcagcgagactccgtgggcgtaggaccctccaacccaggtgcgggatattatctcgtggtgcgccgttttttaagcccgttggaaaagcgcagtattcaggtgggagtgaccctattttccaggtgccgtctgtcaccccctttctttgactcggaaagggaactccctgacccttgcgcttcccagtgaggcaatgctcgcctgttcggccggcacggtcgcgcaccactgactgtgccctgtctggatcctagaagatgaccggtcccattgaatgcgaataccgcttgggtcacactgggatgaggaagtcattggcttggccctgggc

SEQ ID NO: 682491 - DNA, 420 bp, Homo sapiens
  misc_feature (355)..(355): n is a, c, g, or t
  misc_feature (396)..(396): n is a, c, g, or t
  misc_feature (408)..(408): n is a, c, g, or t
  misc_feature (414)..(414): n is a, c, g, or t
ctgtaaaaaattcagaaacgaatgcagaatagcataagaatatatgaaagtctctattagaagttaaaattaatagggatagtatcaatctcttagaattcaaacatgtgtgttcacaatgtggctttttctattttgtttagttttttttcatctcttcatatcaattatctctttcttattactttagcatacatttcaaatatcccactgagctttgttctaagttcaaagtggtattcaatcactttttactaatgtttctatgacctcttaatggggatagtgacaatgaaaataatgctatttaaaatgaaaggatatgtacactactatagggtgtgtaattgggtgnacccagtgactgggagggttgtgagtccctacttaggtgcncccaggcagttntgtccnggctgg

SEQ ID NO: 682492 - DNA, 817 bp, Homo sapiens
  misc_feature (403)..(403): n is a, c, g, or t
agcgggggccggagcggtgcgaagggggccgagcggcgggccgggccgggccgggcagggcccggggcgtgggccggcaggaagatgtgcgaacgtggggctgctgttccaggcgagcgcggtgggactcggacccacatgtagccggcccctgctgcgtgctcgtggacatctgcaacaactgctccgcgtgccctggatccacagtgcgcgggaacgcatgctatccccgggtcaccgaggagctctgtgcagtgctgtccttgagcacgcatcaagcccaagccccacgtgacagcgtgtccccacgtcgtacgcgtggaatctatcgtccaccggtggctgctcgctgctcctgcatggtgttgagtcgctggcactaacagggcgctccatcggtgcncgccacaaccgttcattcaaccgcggggcatgggtgcagtgcacgcgtgcccttgctcggtcctcgggagacgctactccgcatgcgatttgtggagttgggtcattgcagaagctagggcctggtaggggtcgtttagcgtatcccgtcccatgtgcccacatgtgcccctgtggcctttccacgccttgttcaaccaccatcccggcttcaaggtagccctcttcggggctgggctctggaaggacagaatgaccgggtccaccccgttagggaagctttttttctcccttggggttgtggtgaccaaacggaacaaactgggagccccgggattgagacgcgtagtcccagaatttgacaagtttggcttaatgcgggaaattgcccaccgaagaaccgtggcgttgctgg

SEQ ID NO: 682493 - DNA, 226 bp, Homo sapiens
tcttgttgggtgaacgggaattggaggagaaaaagaaaaaaagaaaaaaatttaaagaaagtcatgttatccctataaataatttatattgccaaacacgaagctttgaaactagatcccttgactaagtaccagtaaaagcttcaacataaggggactctaaaagacttcagagatgggaatcctatttattatgtgggaataccatgacttcccgtagggatgc

SEQ ID NO: 682494 - DNA, 197 bp, Homo sapiens
ccaggtgcagttggtgcacgtggggggtgtcctggatgccatggtggccaccaaagtggccccttgagcaccaggcagcatgctcaaataggggatgtcctcccccaggatgagagatggaccgcccggtccccaagcaccctaggaccgtcacataggagcgcgtcatcgtgattgtataaagaaagcaacagcca

SEQ ID NO: 682495 - DNA, 542 bp, Homo sapiens
agcggggaacaatcactgtggggagaaatttagcaatacctaataaaactaaacatgtagatatctctgaactgagtctcccaatgggtattccttggatgagtgaggcctaggggcagcagggtgggtcctcaggggctagagagtccatgttagttacctcagtctcaagtagcctcctctgcttactgtagaaatattatcatctggtgtgagtgttacgacacaaaaacagtgggtaagtaacatactatgacccagaaattccatttctagttatgtatcttaaagaaatctggccaggcacagcggctcacgcctgtaatcccagcacttggggaggctgaggtgggcggatcacttgaggtcaggagtttgagaccagcctagccaacatggtgaaactgcatcttcactaaaaaaatacaaaaattagctgggcatagtgatgtgtagctgtagtcctagctactcaggaggctgagtcaggagaatggcttgaaagcaggaggcagaggttgcagtgatcgcatcactgcact

SEQ ID NO: 682496 - DNA, 234 bp, Homo sapiens
gcaaggaaccaaggaccacagatgcaacccaggaactggattctgccagtgatctgaatagcttggaagtggattctacttttgaacctccagataagagcccagccaaggtgacaccctgattttgcctggtgagtccctgagcagggagctcctttgagcctgtttggactgagaacctgcagaagaactgtgagctaataaatgaaggttgttttaagttgctaaaaaaaa

SEQ ID NO: 682497 - DNA, 479 bp, Homo sapiens
  misc_feature (10)..(10): n is a, c, g, or t
  misc_feature (30)..(30): n is a, c, g, or t
  misc_feature (53)..(53): n is a, c, g, or t
  misc_feature (73)..(73): n is a, c, g, or t
  misc_feature (115)..(115): n is a, c, g, or t
  misc_feature (121)..(121): n is a, c, g, or t
  misc_feature (151)..(151): n is a, c, g, or t
  misc_feature (180)..(180): n is a, c, g, or t
  misc_feature (228)..(228): n is a, c, g, or t
  misc_feature (331)..(331): n is a, c, g, or t
  misc_feature (335)..(335): n is a, c, g, or t
  misc_feature (465)..(465): n is a, c, g, or t
aggttactgnaattagggaacattttctgncaccttgctgattttacttaagncagtctaaccattccatggnacttgtcctcccagagtcagtcagcaatgtcccgttctgagnccccancgtggtcaggagtccttctgggtacggggncacacacaggtcccagccttctgtgctgntctcctcctctgtgtcgtcctcagatctcggggtgagggaggtcgggncagctcttcgtccagccttcccgtccttcagttcaacgacatctttggagtgtttttgttttctcttccaagggccgtcccgttgtgttaggaagggtgagtngctngttccagggttggccggtgccagctccggggtggactgaacagcggcggctgtccctgtgcatcctttgattactctcatgctgaatttactgttacatttgttttattgtacataggtttgaaacattntttcctgagatatt

SEQ ID NO: 682498 - DNA, 135 bp, Homo sapiens
atgtcctgatggtggtggatgtctggccatggttccaggagatgagagagctgaggagagtgtgagaggctggaggaggacgaggcgggcgagaaaggaaagcagcaggaattagcagcatggaattctcgcgag

SEQ ID NO: 682499 - DNA, 736 bp, Homo sapiens
ggggcatggtaagcagaatcgggcaagtgcatgcaggtgaaggcaccgaggatcttgactcaaaaggtggtggccagcttgcaggggaccttcgtctgtgcctgaagtcactatgcattgaagcctatcagattaaagattgcgtgatgcaatcatgggttgttctaaggagctaccttcagacgctgccagtatatacacagtagctgtgcttgtggaagtcagactggtggtcagctgagggtgtggcttacatgctgcagaagaagattgtcctcaagggacaatttcgctccaccgttaaatgtacggatcctcactcactgacagcgtctacgccattcagaatgcacctgtgcctcagcacagagaatcactgaacatgttctacggaatcttcaaacacccattgccccgtgcatgaccagccttgagtggagtataaggcgtgcgggtgacatacatcagaagcagggtgtgatcatttctgaaaagcaacctccgcaggtgatgtcattgaggtacagcaatagtggtctgttagttcatcacatctgggacctcaggtcctggcacaagctcaatagctagtgcctgacagcattcaggtagatcacatgccgctcagaaggggttgtgaggactctgggaaagaatagccatctccagtggggcagggtagccatgaggtctgaaaggtaggtatgaggatgctaggggaatgagcctccgtgtg

SEQ ID NO: 682500 - DNA, 127 bp, Homo sapiens
  misc_feature (48)..(48): n is a, c, g, or t
cggtccacctattgttcacgctctcagaagattatgtgatagtttggntgaaccccgtctgccccgcagctggatgatgctgttcggcctgaggcagaaggagaagaggaaggaagagcaatcatgt

SEQ ID NO: 682501 - DNA, 92 bp, Homo sapiens
gtgcagtcgtgccacgacgacctgaggagaacatcgcatcgtggagcggcgaacaacccttcctgcagcttaagctggaggagttgcgtccg

SEQ ID NO: 682502 - DNA, 924 bp, Homo sapiens
  misc_feature (385)..(385): n is a, c, g, or t
ggctgattgactaggacgtaccgcagagcaggtggaaacatacagacgcagcaggggcacttactgatccgaggtcgacaccgtgcgccgaatgctaacgctgctagcatgctgctgcagctgctagcgctgtgaacgtccatggaatgtaaattgcacgcacgaaacattgcacgtagatcccactgctcatccaagctcagcggatcggcccagtctgctcctaacgatggacttcggatcatgcttcggaagtgctcccgagatctggaatctggtccactcacttggtctttgatggagcttcaccatgaccggtatgctccgaagatacagtcgcatgatgacctgctttcgatcaccagtaggggagtgcgcgcgtatnctgtgtcagatcgattgggagctacatctagagcgcaacatgggcccacatagcgtgggacgcagagctagacgttggctgtacatatctgtaagatgaccatgttccgctactgacatttgcgtactctggtatacgtcccgcgtggtgtgctcacgtcaagggagatcccacccagattgcggtgtgtggcgtgacgtaccatagggctcggacatgaccataggttttttactgccaaatctaagtgaccacttgcagtgtcgcccccaaagaccctgttggcgacgggccccttcccacgataactctatcccgcctacttatcgcgggaagtacaaacgaaccaaacaagaccttgttccgtgaactcggcggagaaggctatgctttgtgccattctaacatttcccgaactctggcgccgtgctcggtcaatgcaaggatccccagtagtggacatcgtcacgtagggctggctcgtaggggcacataggacttctccctcctatgacgccagaaagtgaacaacttctctg

SEQ ID NO: 682503 - DNA, 114 bp, Homo sapiens
  misc_feature (42)..(44): n is a, c, g, or t
  misc_feature (60)..(60): n is a, c, g, or t
  misc_feature (62)..(62): n is a, c, g, or t
  misc_feature (71)..(71): n is a, c, g, or t
  misc_feature (95)..(95): n is a, c, g, or t
tcatgaaaggcaaagtttacagaaccataaacattctcaatnnnctttatgctagacatntnaattatttntcaaactgtatagatttggggtanaaagttgtctcagttcctc

SEQ ID NO: 682504 - DNA, 154 bp, Homo sapiens
taaaagcccccccccttttttttaaggagaatgggccagtcctttcccaagtccccacagggggggggatagcattgcttttgggtaaattatgtaaggcaaaattttttttaatcttcgccctaaaacttttttattttgtttttttttgaaa

SEQ ID NO: 682505 - DNA, 635 bp, Homo sapiens
gtgatggaatgagactcgtctcaaaaaacaaacaaacaaaaaaaaacactttgggaggtcagagcaggaggatcgcttgagaccaggacttcaagaccagcctgggcaacatagagaccctgtctctacagaaaaattaaggaaagggaaaaaaaaaaaagccaagttggtggtggatcattgccgtgttaattcccaacactttgggaaggccaagatgggagacttcaccttgaaaggccaccctgtgggccacattaaggagacctccattctcttacaaaaaactttaaaacttagctggcacgtggtggcacaggcctgtagtccaagccactcaggaggtacgaggtggtggggaggaccccttgagccaagaagctcaaggttgcaggaaagcggtgatcacaccaggcactccagccggggtgacagagacctttgtcccccctttcccaaacaaaaaaacaaaaaaaaacagaaaaaaacagtggtggggcaccatgcgacccaagagaatgtttcataaaaacaatcgatgtggccgggggggcccaaaaggaaatatcacacatgggcataacgggactcacaagaaaagacgggacaagaacaagggctgagtaaaccacaaa

SEQ ID NO: 682506 - DNA, 455 bp, Homo sapiens
ccccaaatgatccaggagggtgggacattcttacctgcttcgtaatacagtaattcgtctgagagaaatatcccttcatctcagtgtctcagatggacattgttggtattcctgaagtgttttgacattgtggccatttccaaacattactaggtctttgttattgatcctgtcctacattctcaattcttgggtccttccctctgttttgaaatgactcattcttcacaatgagctaaactgaaagctttactgttaagcaaaataagaaatcttgagccaaaggtattataacttgctctgatatgaaatgaacacagtgcattggccatcttttcaccctgtttgttagagtatattaaattaaaataacacagcaagaaacattagtttccatcattcattttagatttatgttggtgtggatttggttggttgtttctttggttagtaga

SEQ ID NO: 682507 - DNA, 920 bp, Homo sapiens
gcgacaccagctgcactggtcaggaccccagcacagaaggcagccaagcacaaggcagctgaggtggtcctcaaacacctcaaaggggggagcatgctggagccggtccctggaggacagcatcactcttcatctgcactgaggacgattccggttttttactgctgcagcgagctgctaccccatagttccatgctgtagtcctcaaccaaggagcccacacaccattggtaacttgataggcccctgtctctcctcaatgcgtagtcttgagttgctaaagccacccgttggtagctctagcaagagaggactggtggtgtctacaaaggctcggcgtggtatgcctggtagttacgataggagagccaagggagtcttgggcgcaagtccgacccggataaaggaaatgctaacatgaccttgtccgagatggaagaccggtgttactatcggaacgatctggggaagtcgcgcactttccgaatagacaactttggtcgaacgcggaatgcgtggtggtcaataattggtcatggtcgtctcgagtgcaacgcggtgacctactggagtgccccgcggtatggacacatgacggtgggatgaccggtatgatggacccactttctccagaagggtgtagggctccgcgtcgtgggatgggtcttccgaaatagccgggggcccagggtttgcaccctcgggattactctacggaacttgctgtcggaagagatcgatcccctgtgccctccagaaacttgcgtcccctgggctccctggggtgccctgggtgcctgcctgctggccggccttcgggagcgctcctgagggtgcccgccttccggtccgcgacccggatatcggggagctggctcggtggcttagcattgccttgtggatctgtcccctcacggcac

SEQ ID NO: 682508 - DNA, 1268 bp, Homo sapiens
  misc_feature (243)..(243): n is a, c, g, or t
  misc_feature (510)..(510): n is a, c, g, or t
atatagtgagtgggccccccggggaatgttttcgtttggggcgccccccttgtttaaggttataggagggaaagcacgccctcgggggtttataatacctgcggggggtttactaaagcgccccccatgttgtgtggtggccgccgccaccagaattgaagcgagtcgcctgttataaaagggggggcgcctgcaaaacgccaccgcgttaagatgtaatgatgtgcgcgctaaaaggttgtngggcgccaccaagatgaagttaggcggccgcccagcgtgggcgcttcaataggcggtctccgtgcgggtgcgcgtaaagagtagcgtggagaatgttatgaggacgagaggagaattattggcgggcgcgtttttattagcccccacctaatagaagaggcgctgttagtagaagacgctgcgacgcccctcggggggtttaatgatctccccccacattatatggggacatgatacacggcccgcagcacatcatcggggggttgntccttcttcggggaggtagcccccccaggggtgggtgaggtgtgtgagacagggtgtgtgtagccagagtttgctgaagcctgctgtgccgcacgctgagcacaccgggcgacctctttctgggagggcgagaccctcgtgtgtgtgtctctcccacctctgggagagagcactcttttggtgttgcttgcgcggggttttctggcgtgggtgttgggttgtgtttgtgtgggggtattcttgggcgctccacgtgtccaaccccccgtgagggctttctcacggggtatgaccacgcagcgcggtgagatgtcgcaagacacttctgtgttgtctataagggtgttgtgatatctgtatactggacgtataatggcgtttgccacggtgaaataagtcacaaacttttgccacccgcagaaagggagggggcttcgggagaatcccctgaggacattatgcgctcaaagttataaggttgttgtgagagacatttccctgagttggaaattgtacctcttgtgttttgttgctctggttcccgaaaatataactccgcgggaatgcctccctcggtttgtccactctacctgcctcttgaattccctctggatcccaccccactttctttctactttaagaaaataacaccaaatcaattccttccccgaagcgtctctgtattttgccgctgccccatttgtaagaacccccttttcccccaattacacccatttaacaaaaataaaaaaataaac

SEQ ID NO: 682509 - DNA, 675 bp, Homo sapiens
cgtggtggctcatgcctgtaattccaacactctgggaggtcaaggcaggcaggttgataacttgagttcagaagttcgagattagcctgggcaacatggtgaaacactatctttacaaaaaatacaaaaattagctgggcatggtggccagagcctgtagccccagctactctagacgctgaatggggagagactgcttgagcctgggaggcagaggtttcagtgagccaagatcgtgccactgcactccagcctggacgacaaagtgagactgtctcaaaaacaacaacaaaaacttgtctatattaattattatgcaattcttcttccccccactgtattttgtataactgtaagagaatactttcttccttaagtcaggattccattctagtgtctaacactgtaacaaccacacattaccccctacactgattgtaaaagtaagagttagtgtcagaatttaagcagaactgagtttaagaccatgtgtttttattaacaggggaataatctcctaatcttaaactttatcttttttccatcataaaaatgtttaacacctatccaaatactttccatatgaggcctttaatagtttttgatccccagggagttgtttgttaaactaggaatcaaagcatctggtgattcatctggcaccaggtttgggct

SEQ ID NO: 682510 - DNA, 539 bp, Homo sapiens
  misc_feature (190)..(190): n is a, c, g, or t
agtgttcaccttgaggggtgtctgttagaagcttcaccctgaacagaactttggcaccagtgatggatgtagcaactataggtgtctatgaaatatgaggttctcctttcaggctgccttgcacagctctgtgacttattagtgatgccatttcaaccgtgagaaaggtgaggctttctgtctctctctntctgcctcagacagtcccatctgtctctcctgtatggatctgtactcaaatctcttcatgtagccaccatgagagtgcgggcatttgccgccagattagatcacgccacatctgtggatacagagaaatcagcagatgctacagaagaggaaaatatttccctcctaccaatctcatacccatttctccctggacctcttccgcgatgtcaacaaggttttctacttcttgttttcctctagtgtacattttagattattttggtactttctttactctcagtctaaacattgtttttttcaactaaaaagatgagaaaacaaaacaaaatggaataatcgtcaaagca

SEQ ID NO: 682511 - DNA, 271 bp, Homo sapiens
atgggaacaagcagctgtccctgagccagaagagtatgtgtatgtgcgctagacctgtacacagacatcatcaacattttcctgtacatactcatcatcattgggcgcgccaaggagtagctgagctccagctcgctgtgcccgctcaggtggcacgggctggcctagaccctgcccctggcacggcagtgcccattgtacttcccctctctcttgtccccaggcacagcctaaggaaaaggatgcctctactccaaccctcctgtatgta

SEQ ID NO: 682512 - DNA, 721 bp, Homo sapiens
  misc_feature (87)..(87): n is a, c, g, or t
  misc_feature (106)..(106): n is a, c, g, or t
tttttttttttattgccatttctacactcacacaggattatgagctctataggtaggagtttgttacacactgctttgactttgtgnttaccagtgcttgtcacanatcaagttcttaagaagcattcattgaatgaaggaatctgtttaattctgaatctttctttcctctaggcttctttgtttataagttgtagtcaatatagaataatacagggtttgtattgtttgatgtgtataaatctgatctccgtctgcaggaactttcttggagcaagggcctaactttgtactattatctcctccacagaatcttagttggcatttgtgtttgatctcttgatttagatagacacgagtttgatttttggtttagctgtttacttacttttgtgacagtaggtaacttttctgaaccttggtttctctgttttaaggatatacgagatagtgttggttgaggactgtgatggttcattttatgttgtaagcatgactgggccacaggatacccagatcctggtaagatattatttctgactgtgtctgtgagggtgtttccgaagagattagcatttgagctagtagactgagtagggaaggaccacccttatccatttgggcagatattgtccatcctttgggggcccacataggaaaaaaaaaaataaagtcgacgcggccgcgaatttagtagtagtaggcggccgctctagaggat

SEQ ID NO: 682513 - DNA, 497 bp, Homo sapiens
acagaagaaagcaaggactgagtggcagggagtcccaggctgagtgctggcgccttcgcgggactcgcttcagcgagtgaccttcgacagtcacttaaatgctgtatgctcagcgttcctcatctgtaacatggatatgaacccatctccctgcctaactactagagtgtggtcaaaacaacagagatcagcagatatgaaaggtacaatataaactccaggtgatgatcttatcatggcatatatatcatctgactctcactctttccaaaattaatcatagaagattgacatgtattctttccactctgttcctactcagaggtgtaagaggtcacatgcttaaagcatctagcccaacacctggcattcagcgtatactataaatgtctgtaaattaagtatactaatgccccgaagtaacaggcacactgtttctcaatatatagtaattcatagacacgggtctcccatcggttcgactgaagcatgtagtt

SEQ ID NO: 682514 - DNA, 615 bp, Homo sapiens
  misc_feature (366)..(366): n is a, c, g, or t
  misc_feature (426)..(426): n is a, c, g, or t
  misc_feature (478)..(478): n is a, c, g, or t
gcgtcgactggtgaataagaaatttttaccttaggagttcacttgaatagtcatttttatatttgtgactgcaagtcacttttaggggctgtacttccttagtactggtagcattattatccaatggacttttatagctttcattaggttttcttttgtttttgttctttaaagaacattttacttaacttagtatttcatttttcatctatattatgaggcagtaagagtcttctgtttttccaaagttgagactgctttatatttatttcgtattgtctacagctgtagtgttcaatacattagccactagccacatgtggttatttaaataagataaaataaaaattggccgggcgtggtggntcacgccggtaatcccagcactttgggaggccgaggcgggcagatcattaggtcaggagntcgagaccatccttactaagacggtgaacccccatctctattaaaaatacanaaaattagccgggcgtggtggcgggcgcctgcagtcccagctactcaggaggctgaggcaggagaatggcgtgaacctgggaggcagagtttgcagtgagccgagatggcgccactgcactccagcctgggggacag

SEQ ID NO: 682515 - DNA, 1687 bp, Homo sapiens
  misc_feature (362)..(362): n is a, c, g, or t
  misc_feature (688)..(688): n is a, c, g, or t
  misc_feature (691)..(691): n is a, c, g, or t
ggtggagaaggaggcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagcgttatgtcatggaaaagacaccaaacacagcaagtattttaatgaatacaccatcccagggggtcagtaagctctgcctgccaagaagacacagtgagaggngtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtaggtaggaagtatgtgcaggtgggagtcatctgtcagccttctatgtttcagagatcctgaaggtggtttgaaacaaacagaagaggagcaggaaatatccgtgcctgtggcagatctcactcancangcttagcattctctcccgccaagctgggataagcctcatgtcctaacacagcacaacaggaggtctctgtcagtccatcagagatgacattctatgtgatatttttgacatccttgtgctaaaagcaatggcacaaaatggaaaagggcctattgaccacacctactccagtaaaattgttcttcatttattccttaattttctaaatctgacccctttaaagcaatctagcaaattgagaatcctcagctctccttggatacctgatattttatttcaagaaagagacaaagaaggaaaattttatttattttactacccacatataaaccgaagggagatgggactacccaaacatttgctgctcaattttgtgtcttgtgcttgaaagtctgccctaatgcataacaaaaactacttgtctcctacctttgggatccctttaacaagtatttgccttctgaactacgtggataatttcaaaggcagagttccagaccagagaggtctttccatacaatgaaagctataactagctggttgtgtttaaccactgctatcacgctatcctgggactgcatagaactttgacaaaagacagacttcatggtacacaacttcaacagattttctgtcatattctcaccagcacatctgaatgaggctttgtgttttccttgctctcttgcatgttccttttcaactcatggcccacagtgactctcagagatttatgccaaaattgcatacaattgttttctgaatcataacttgtctatttttctgcctatgtgtgctactttcagttgtttctcatcaacatttgactctcagaagagcctccatttgccctttctctctttaggtatctaagatctttgaaaacctggactttacattgattcaacctatcaaataatgacttctcgagagggatctggggtcctggactctgtgggagctttttttggatttctcgggtttatatatttaaaa

SEQ ID NO: 682516 - DNA, 1737 bp, Homo sapiens
gtatagaccactgagtaatgaattacgtacggagaaggactgtacgggtccttagcatagatagaagatgaacatatgtctgagttccacctaagtgcgtgcccacaaataaataggacccgaggttgatggctaagaaatgatgggaaatctcgtataacattgggtaaatatttcgaagccagcactagagaaaagatatgcctagcttagttgcgacaattgtaaattacagacactatacatggaggacttacgactcgagtaataactcctttgctgattagccaatagcaaatttgcatgactgtaacttgtcagcaggggaataccattaggaaagataccataacagtagcaaaactaaattaggaccacacaatgttgggccattctaatagctcaggcagaaacagcgaagaaaacagaggcagaagatcaaaaagaaattaggttgagtaaccctgacctaagacgggataattaagcataaggaacaaaaggcccacaggcgaagggacaatatgacaagaaacacaaaaattaaaaaacaaaagagccatagcattaccataagacgaatgccaacgcatcgtaagaacagtgaagactccccaagttggtgcgacaatactcgggaagcaagaacacagctcagacctataattacaaattggcgaagcattggcatggagccaaaacaaaagagaacaccataatacaaccaaggaaagaataaaagacaaatagaactagcagacaaaagatgatatgacatgacttcaatcataacagcagcaaataggaaaagaataagaaaccccagcaaaaacacacactagccataaaagacaaatgacaagagatcaaaagggaagaggaaaatcacaatccaaatgcacaagaggaaacaaaaaatacaccataaagcagctgatcagtcagagatgagaaggaacagaagacaataaaagaaagggaaatatatgtggcacgagaccatacaccccgcaacgataatcacgatagaaaagcgcacaaacgactgtgacaaaaagaaatgtaatcaagaacatacataaaagcacacaacaatcaacacaaagttggaaagagaagacagataaaacacagatgaccacagatagacttaggaaacaacgacaaacacatcccagtgaaaaagaaagaaactcgatccaaataaacgcatacaacacgaaccgcatcgcttcaaaccacgcaacacatgtgcatgaccaacggtatacaaacgacagacacgtggaacagaatacgatcacacaagacaaacacatgcgtgtacgcgacaacaagtcgatagcagacgtagctaactagacaccatcaccaaagatgagacaaaaaggagacaagaaagaagaataacacaatatatatcaagatccgcaaatagatgatagaacacttagcactaggaaagagaataaacataagcaaaagaaacacaagcaattcgatgtagtgtaggaacacaaatagcacacgaacaaagaaacgacagatacaacgcgcagagctacagcgagcgacagtcagatagacgacgcattagagacaggaacaggcagcaaacaacggagagacggatctaacaatacatttatacgtctatggccacataaacaccgcgaaagcacacaaccacaacattaagaagactatagagaacgaataaaccgcgagataaagaga

SEQ ID NO: 682517 - DNA, 930 bp, Homo sapiens
  misc_feature (443)..(443): n is a, c, g, or t
ggatacgggagttcctccttgctctcgcccctactctttctggtgttagatcgagctaccctctaaaagcagtttagagtggtaaaaaaaaaaaaaaaacacaccaaaacggctcggcagccacaaaaaggggatggaaatttctttctgggacaatcctcctgggttctcccggtaactggatcggtcttgggtccctaagaagtcctttcggtggaacgcttttttaattccctaagagagggagagaaattcaggtcaccgggcgagaaatcggtggctggattacagggagctggggcattgggaatcggggagactggactgcgctatgaattcggctaaactttaaaaggcaaggctgggtcctctggggatataaataagcttgggactgggagggaaacaggttgccaaattggcaaggggattggggtggccanggttcataccttggtgggtaagactggaggcaaccggaagaagatttttacaggctctggcaaaggaacggtggaaggcagaattgggacgatgtcaggtatttcagtaaacaaagggcgggggtagtctaatacttccagattggttgtgctacaccaagatcctcagatggaacaagactttggaagtcaatgtacctggccccatttgctggactacacagggcgatttcttccgtgcatgtgaccgaagaattacccgttgcggcactttgtggtcccgtgggggcttcgggccagcgtgggacttgttctcggtcccctttcttatggctcaacgtgtgcaagcaagttggctgcctgtgggaattcataaacctctggaccgcatgaactgggtggcctaacaattaactggggttcaaaacaccattgttcgtgtcccaaaattgcgtaacacctgtgtctctccaaattccagttcctg

SEQ ID NO: 682518 - DNA, 115 bp, Homo sapiens
attggctatacctataacactaagtacacaaatattcttagagaccctgctttcaattatttttgagtatacattaggtcatccttatctgatggggtgggatccaagcactccc

SEQ ID NO: 682519 - DNA, 184 bp, Homo sapiens
  misc_feature (6)..(6): n is a, c, g, or t
ctgtangaagacggagcagctacagtcattcctttgtgaaaaaggcattcagagacggggtttcaccgtgttagccaggatggtctcgatctcctgacctcgcgatccgcccgcctcggcctcccaaagtgctgggattacaggcgtgagccaccacaccttgccgaaacttagattttttctt

SEQ ID NO: 682520 - DNA, 278 bp, Homo sapiens
gggcaatatccaatgcctgggacagcgggggaagtgggattcagcctttcatttattctttcacctatttgtcctctttactctgtgtacaaaaaaagaggggatatactaattcatagactgttgtttctaaacagaaactcaggctgggcacagtggaatacgcctgtaatcccagcactttgggaggccgaggcaggagaatgaatcgcttgaacccaggaggtggaggttgcagtgagccgagaccgcaccattgcactctagcccgggcaaca

SEQ ID NO: 682521 - DNA, 111 bp, Homo sapiens
gactcggagcaatgtgggaggatagcttgagcgtagacaattacgagagcagcctagggcaacgtaagagataccgcatctactatgacaaaatatataacaaatatagct

SEQ ID NO: 682522 - DNA, 584 bp, Homo sapiens
  misc_feature (510)..(510): n is a, c, g, or t
tccagcagcggcatggggtgtgttgcagacagtcatgaaatgtggctgaatcttgcaagggaccctcggtcctatggttgctgcttgagacaaagacccctgtcagtggaacctggtgacattcacccttctgtgtcaggctgcagacagcaggagatggcagcagattacacccaacaggaaaagggccattgccaccccacaggttgccatagaaggagatgacatctctccctctcctcctccagcagtgtcagctggggaagtggtgggtggatgtgcacaaaagagtagaccacagagcatgctccttctcctccggtctgctggggccccaagagagtctgcagcccttggccaaggaccggctgacacaggagaacaaaagaccttaggctgggataacatggtggtgcagttcatcctctggagctccctgtgagatcagactggagccagtctccagctgagaccacatctcacttagctccttccctgccatatcctgtnttccttactcctatctcctgagacttcttcctgaatgaattacatgcactccatccctgcctcagtctctgctt

SEQ ID NO: 682523 - DNA, 1012 bp, Homo sapiens
gtggtgagcttaggcgccgagggggaagcggagccgacatgccatgtggcccaggagcgtgggtgagtcgcaaaatttatgtgacccgcgtcggagagccttcgagaaatctcgtatcgatcaagagctgaagctgatcggtgagtatggcgctcgggaacagacgtgaggctctctggagggtcaaatttaccaactggctccaattgatccgcgagggcgtcggacgggaactgctgacgcttgatgagacaggacccgacgggggatctgtacgaaggctaacgaacctgtgctgcagcgggtgggtcctgcataggggtgctggcatgatggtgcagagattgaatgcctggaattaacggtaccctggggaccgtgaaagattcgcagggaatgttctgtacgaccgaagacgtcgctgcgagaatcccaggggttcgtatccaaggctagggggacatttgcgctcaaaggtcgcattgccaacctaacgactacggcgatggcatggattcgcaggcaccacgtgcctcgatattcaacggggctccctgcagataccaacggttgcgatgagagcagtccccaggatccgttacattttgatacacgtccttgggaatgtgcaccaagaaatgcacaaatctgaagcattactcatcatggcggattctccccttaacggggggttgagccagaccacagaggccggcggatggaagcaaggaaagaaattgccaaacggaagggggccccacgggttgacgcgggcctggggggagcctggggaggaacggaaccgaagggaccgggacgcggacttaaaggtaccgaccacttggttcccgtaccctgggcgcctcgcgcgcgggcaattcggacatacggatatatagcccatggcccaaacaagtaaaagcacgggactcacaggcagccttcttaccagccagaacaactagaagacgaacaggaaccacagcaaacacagatagccgccaaagggcag

SEQ ID NO: 682524 - DNA, 510 bp, Homo sapiens
  misc_feature (488)..(488): n is a, c, g, or t
tgtatcgatgccacattatttcttctcagcttagacggcgtaagaagaaatatatgtggtgaaaggtgggaaccatttctctctgggtctcggtttaaggtgaaaagggtgagctaataggaggcactttcaacttcactccctcacgctaccccgtccccctccagacgggcagtttcaaggatgcaaatggcatggcaaaatcaaacggactcatgaagcattggggccagtgcacggtttacttccatcggttggcagacacattggtgcccggggctggggagcccttggtatcaaggttcggacaagggtccctataaccttaaccaactcgaaaccggttggggatggatatgatggggcttcggtgctatggcggggatggggagaaataaaacatgcaatttaggtggaagcgaagaaatttaaagaggattttattgggctggggtcaatcctggtgaaaagggaggtggatgtgtttnccttgggtgggggggcatcgat

SEQ ID NO: 682525 - DNA, 185 bp, Homo sapiens
cgcctactgcagaatcaaccccaagtccgggggcatcgtcatgcttttccggagtgactttccctcaaccccaactgttcggttcgtctgctcggaaatctataacattgtatactctcaacggcaagaaagtggaagtttccgtcaaacagatcatcgctggaaaagccgtggagcaaggaggt

SEQ ID NO: 682526 - DNA, 1604 bp, Homo sapiens
  misc_feature (328)..(328): n is a, c, g, or t
  misc_feature (1000)..(1000): n is a, c, g, or t
  misc_feature (1047)..(1047): n is a, c, g, or t
  misc_feature (1108)..(1108): n is a, c, g, or t
  misc_feature (1310)..(1310): n is a, c, g, or t
  misc_feature (1312)..(1312): n is a, c, g, or t
  misc_feature (1365)..(1365): n is a, c, g, or t
ggaacacaatgttgaccaaacagggcttttgtgttgggcccccgacaggcggcctcgtgtaagtaaagtgttccgctgtggacacggacacgacggtggggatcaccaccgtgggccgcacgaacagaagaagccctcactacaaccaggggggcggacaacgggggctaccacacccgtgtgcttagtaggacccacgcccgaagagaagtggttgggggcttcttctcgaacagagcggcccacaccaggaggggagacacaccacagatatcaaccgtgggcctagaaacacacgaaggcgcctgggggtatacttctgctgcgnccggaattttcttcaaagagccccgtgccgggtgtgcccaaagcaaaatcccggacgcagagcccccttttcggggagggaaaagcccccatattaaccccccacaaaggtccccgttgcgagtaggaattccgggccgccaagaaacaacttgggccccaccacatagccgtgttgggcagaatcgccgccagaaagcgtgatcgcgtgggggaccacaagccacattggagagggaaggaagaccccccccccggggcccccgttgtaagagtgccccaccccacaaagggggggcccccccccgctggagatctcacaaaggggtggtagaaacaacgccacacaaggtgcacaacccgcgcattatttagggcctgttccaccacaaacgcccggcgctgggttcccacagcagagggccccccctgggagatgtccccgcagagaagagttggtgggggccccgccacaccacaagagagatttcaacaaggggggttccccccccgcctctgccacggcgaaatattctctcacatggggtttttccggcgcagagtttgtagagcaccccccccccctctcgtggtgggagaacacccacacccacatttgtggacacgcctatatgtcttgtgcggctcttatttctcggcgccctgggggggncctcttctcgcgcgctagtctcttgagagtttttaaggcgtcacagncccccccgcacaacttgggggcccactacgacacactcttctgtattatccgcggcgagangatttgggccgcttcggccacccgcacacacaggagagtttcctcctctcccacagagacgcctctctcacacccctgctctgtcatcacaagggcgcgtcttctcttagagaggctcgtgtgcaccctctgtctctctataaggccactaaattctctctctaagatggggagattgagagccccttctctctcgagagananagagacttttcttctggcacacattccgtcttggcacacgctcgagagagagngggacaaagtttctccacaggctgaggcctgaaagtctggagttaattaaagtgggagttgtgcacctccacgagacttctccctgcataacgccttaattgtgaagaactaagaaggaagtgggagagttgaggcctcggcttgaacctcttggaaaccacgaaaagattggggagacaggtggaggaggccacactcctgggagctgatggttttaaatctggttttaaatttccca

SEQ ID NO: 682527 - DNA, 566 bp, Homo sapiens
attccccagccctgaatttccagccatgaagatatgctggggttgccccccaaagagaggaagaagattcacacctgaatttcgggttttctccgaaattagaaagggcctcttctgggggccattaaaaggagaaaaaaccccatttctccccttgcctttaggccaaagaaaaaatgctttatagccaaatgaaagagaacctgaaaggcttctttccccgtttattgggtgaagggggatccatttgggtctggaaaaaaccaatgggtttgaaaattagtttaggttggggcttccggggacccccccggaaactaaaagcttccggggtatggctatgttccttctatagaagaaaagccacccacccccggattttaaaatttggtattctcccccgaaaaggaatttttgggggagcccccccaaaaccttttcccccccttaaaagggaaaaaacccttttagggccccaaaatcttttgttttttaaggtgggggaaattttggtggggttttccttttgggggggggaaaaatctttttttttgaagggaataaga

SEQ ID NO: 682528 - DNA, 336 bp, Homo sapiens
aaatttttttttcataaagcaggaattccaaccagtaaaggccaataagatgggccaatatagaaattttttgggaagattataaaaaccagttgtttgtgtcaggcatgactaatagttttttttaaaaaggggcagggggacttaaattgttgatggctatgaaaaaaatttttggatgttcccttaactactgagctgttttactggaaattaaaaatggtatagttaaaatggcctatccaatgtaataagtttaaaaggggtggatcaaatgttaaaccctgatttaaatgtttttttacccaaaatgaattaaaatatagtagggttcca

SEQ ID NO: 682529 - DNA, 427 bp, Homo sapiens
  misc_feature (80)..(80): n is a, c, g, or t
  misc_feature (83)..(83): n is a, c, g, or t
  misc_feature (117)..(117): n is a, c, g, or t
  misc_feature (356)..(356): n is a, c, g, or t
  misc_feature (404)..(404): n is a, c, g, or t
  misc_feature (411)..(411): n is a, c, g, or t
gcctggacctcccttcccacctgatcacagggaattcaatgagggggatggccggggagcagcccgaggcccccagggantgnggaaggccgcagacctggagatgaccgcttcccncgggatcctgatgacccgcgatttcgagggcgcagggaagagagctttagaagaggtgctcccccaagacacgaaaggccgcgctcctccaagaggaagggacaactttcctggtcctgatgactttggtccagaagagggttttgatgcttctgatgaagcagcccgaggacgagatctccgtggtcgaggccgtggcacccctcgaggaggatccaggaagtgcttactccccactnctgatgagttttccccgctttttaaggaggacggaagccagacttctnggatggnaatcgagagcccgggg

SEQ ID NO: 682530 - DNA, 202 bp, Homo sapiens
  misc_feature (36)..(36): n is a, c, g, or t
cccttttcaggggtcctttccccccttcccctttantgcctttaccagggggacccctttcctgacttttgacagggcagattagttttggacttgaaatcaggggaataaaacaggaggcccttttttgaatttgggttttttccccccacaagaaggttggggggttcctcccgaaaaaataaaaaaataagattcctta

SEQ ID NO: 682531 - DNA, 333 bp, Homo sapiens
tgctgttcagaggatccccgtcggatgcaagagtccagaattgagccttgaatctggcaaccgtagacttataatatatacataagttataaagagattggaattataatattactacataatacaatccatgtcatcttacaatcatcacagtttaattacttcccatttctcatccctgatactatttttcttgccatactcaactaggtaggacttccagtcacaataatcaaccgaattggtgacagtgaaaacaacttctctttccctgtctcaaaagaaaacttccaacatttcaccagtaaacatggtgtttgctataggattttt

SEQ ID NO: 682532 - DNA, 1030 bp, Homo sapiens
  misc_feature (355)..(355): n is a, c, g, or t
  misc_feature (523)..(523): n is a, c, g, or t
  misc_feature (560)..(560): n is a, c, g, or t
tcagtgtacctgtggacacgctcacctgagctagctaaatggctactatggctcctcgggacgatcccatgactcgctgagcttgttggcactgctactgtactgacccgtggggtgcaaagatgggcaagtgtctttccctaagacatatccactatactccaggagcttattttcgatcatacgcttactggctctcgctggccctatacgctcatgacaccaaggctgtgcgcttgtgacaagcctaaacgagtgagattctgcaaggaatagccttatagtacgccaatacggtaagcaagacaggtaattcagtatgcctgtcagcagacctcccgagtaggcgtcaccntcgtggtgtgtctcagttagctcatagttaccagagcagcacctccacatcacgggtaagggaagacagcaaacgagagagatcgcataccataagaggctagtctctcaggtatcatcctcgtggcatgtctcgagtccacgatcagatggcgttgtgagctcccgnctgctaggttcccctccagagaagttgtcgttccgancaagacagaccctaggttgtaactgggcggcccttctggaccagccaaacggttgttaatgagccgtacgttaataaggggagccttaagaacggcaagagggattccgaccatctgccttgcttggggtgaagagcttgtgaaacgaatggggtatgcccccctgtgaacttggggcaagaatcctttcaaaggcatgcaccttagcaggtcaagtttcgaaccgccatagctcgccacaaattgagttcaccggcctatactccccgaaaataaaaggacctggatcgttagggccatcacgggacaggggcaggggcacaaggggcccagaacattcccctggggccacgatggcaaaagacgccgtacacttacaggggacccagggggagatctacaggccggcggggagaacccgggtaacaccccccagaggagcaaacaaggagccgttggccagtgcccac

SEQ ID NO: 682533 - DNA, 455 bp, Homo sapiens
  misc_feature (178)..(178): n is a, c, g, or t
ccatatgcttattggaacccttaaggtaaagctaacacggacagttccccccagaagaagatggcatccttaatgtgaacagcttttcccaagatcacagatcaagacttctctactatcatgagactcttatcttaagtatctgtgcagctgctaacacttacagcatgtggagaanacatggggtattataaagatttggttgtagggaattaacaaaaaaaaaccacttagttaagcaagtaaaccctttatctaatgcattctttaatctatttgatttttggtggtttgatttatggggaccctgagtaaggagcatataccacatcttggtgttatcccaatagtcataagagtctccctggtgtactgtacttactcaaatgtttcaagagtttgcatgcagccatctctaaaatgtcaaatggtgtctctttaactggaatgacaag

SEQ ID NO: 682534 - DNA, 1224 bp, Homo sapiens
cctctgcaccccagcaagtcatcagcggaagatttgggctggggagtgagcagctaaccagaggcggtacccctgcccggaagtgtgtcctggaccttggtttggttgggtccctcaggtgttgcccacacagaccgtaactacctggcaatcgagaagggtgccagatggacactgggggtgaaaacacagccacgcctggtggggaagcgggtggaggtgctcaggaggcaaccaggagagtgcagtgcagcactgcccgcaccaagcctgggctggggctcaacaggaagcgtggagatggcgcagatgcaccgcaggactcagagggatcacgctgggcttaaaaggcccagagcaaacagactcaaccgttaggaagcagggaagtggcccgatcttaacggaaatttcccagcaagaggacaggcttccttgtccggggccatccaggctcacacctgactgagtcccgcagacttggctgtgcccacagcgcctgtctcactcagtgtaaaccgagatgagttgcatccatcggctcccgattaccaagaatcaagaggcgatggatggaaaccttgggggaagcagggcctggagggccagtgtcccctgagtctgtgagacactccaggacggacgggggcgggcctgagctgcaacctgtccctccgaaaggcacttgcaagacagggttgaaactgggctgtggcaacaaaaccgacaaccaagaacactggatcccttgtgagggagaactggtcaaagacgacggagcagggccaacagggatcagacgcaagacactggagaagataaaaagcgacacaccaaaggctggcagcgcaaactcaaccgggtatccaacaatagcgaagagcacggtcgacaaacctataaacgaagagttaaagacggcagtcaaaccgttgaaacaatctttaaaaaataaaagattacgaggtaaaggaaggaaaatggcacaaaaagcggaacaagaggaagaaggcaacgaacaaaagaaaaaacagagagaggaagacaagacacgaaggggacacgacaaacgcagactaacacccaccgcggcggcgagaaagcaagcagaaggggaggacacacacgcagcgaaaagacaaagagagaataaaaaaagggggcaaagaaagcggcagcgggacaggagaaacagacaccagtgccacgccagacaagcgcaga

SEQ ID NO: 682535 - DNA, 395 bp, Homo sapiens
  misc_feature (3)..(3): n is a, c, g, or t
tcnaaaggggggggaaaccggtttggcccccttttggtttttgtttagccaaagagagagccttcccttaaaaacccctcccccccggtttttcccgggggaattttccccggggggttcccttttttttgaaacccccccattaatcttgggagggcccgggttttggtaaaccgggcccccaatggtttaagggtaaataggttccaatttctctttaagccttggggggaagggtggtggttttttttttcccccaggttaggcccccggctttggaaaaaccttggtttggggagtttgccggtctttcccggggcaaatttttttgggggtttttgggtccctttaggggtttccaaaaacccggttccgccgcccccggttttgtttta

SEQ ID NO: 682536 - DNA, 124 bp, Homo sapiens
ctgcagttgacgctgtgacgactctagagatccctgatgtaggtggaagcgcccacccttgttccactgtgacccctgtacccatgctgacctgtgtttcctccccggtacatgcaatgggtac

SEQ ID NO: 682537 - DNA, 377 bp, Homo sapiens
gccggccctaatgtagagagacgagagtgctgtctggcatcttctgacctcagacagacagtataagtggtcttgttggctaagatacgtaccaccagttacttagggccaagatatccacatccccttgcgtatgggaggtgggtgtaagagtgtaggatgcaacagatggttattatgggaagtagctcgatggtaaaaggacaaacagctatctatcttaaagcttacgcctgtatgtgcttattcccaagggagatagaggtgtataagtcacagaggacagcatgagttagaggacactggcatcaacagctgccacagccgtgcacaccagggccagagcagcccactgacatctcgtctcttctcttgta

SEQ ID NO: 682538 - DNA, 106 bp, Homo sapiens
  misc_feature (65)..(67): n is a, c, g, or t
ccaccgactgcaacagtcccgactcagcggcggcgcgtcgagccaccctggtcttacgggcagcnnntcgacaacaacactcaccagggccgcgggacaggtacag

SEQ ID NO: 682539 - DNA, 1030 bp, Homo sapiens
tcagagggagcagagggacagaaaagtaacctctttcttaagtggaatattctaataagctacctttggtaagtgccagtgtttattatctaatcattccaagtttggcattgatgtctgactgccactcccttctttcaaggacaggtgtttttggtagtaaaatcacgtggtttatacaaagctttattatagggggtaaagttaaggctgctaaaaccccagtgttgggactgcgtgctgttgagatacgtgatgcttggggaagttaaaaaaaaaaaagttatatttcttgtgtcttataaagaaattttataaaaaatatagtcagtaaaacttattcatcttttccagggaacatacgtgatgtggtcttaaaagaattagaacagttaagttaaaagggtggctggaacatcatatttctctacaaaacgtggacaaaattgaaccgtggtctctagaagaagtgtaccccaaaataaacacagtgtgacagcacgtatggattcttataaaaacaaaaccaaacaaaaacacaacacaacaaacagaaaaaaaaaaaaagggggacgcccacacaaaaagccacacaggaggggcgccacgacgaaccagggctacacgagctatatgagacacaagaagaccacaaagaaggagcacaaagaacgacgcgcagagcaacatgccgacccccagcacacaacacaacaggacgaaccgcgggagacacaacgcagacagcaggcgcacacacctcgcagaacgcgaccacaacacaaacaaaacgtagagacgagcaggaacacccacatggtgcgaacacaaacacacacccgaacacacgaacatacaacagccgcccaacaagccgcaacacaacaacagccagcagacaaagaggataaaaagagggtgaaaaacaacgacagccccacaacaaaccggcagcacaacagaacaaaacaagatagagagaagacgaagatcgacacagacaaacaaccacaaccggagagcaggaaac

SEQ ID NO: 682540 - DNA, 257 bp, Homo sapiens
  misc_feature (58)..(58): n is a, c, g, or t
ctcctagcctcgcagtggctgggattgcgggcgtgcaccaccacacccggctaatttntgtatttttggtagagatagggtttcactttgttgccaggctggtctcgaactcctgacctcaaatgatccaggccacctctgcctcccaaagtgctgggattgcaggcatgagccaccatgcttggccaacctgagatgactttggtggtggctgatcacacttttgggaacactggcgaggaggaccactggcgagg

SEQ ID NO: 682541 - DNA, 336 bp, Homo sapiens
cagccatttcttaaagtgaaacagcactgaagttacgaacacagtgacgttcctttcacagcagatttctccatagcatattatgatttttgacattttcctcctatcttccttctttccttaattcctctccatctcttcccatgtcttcataaggtagtgtctcactaactcagacatcctcagactcacaatgtagcgtaacctcaaggcatctttcaaccctcctgcctcagcctcccaaattttgacattatagtcatgaactaccatgtctagactttttttcctcccttaaggaggtttttagaatgccagctggtcttacgtcgacgc

SEQ ID NO: 682542 - DNA, 343 bp, Homo sapiens
gaggatccccagttccagagtagttagacagagatggtatggtccacaaagcctgcctagtcccagaagggtttccaacccttctctaggatagcagttcttaaacttttttttttttttgggttttttccaattctcccttcaaaaggggggaaaagaggggtatatttaacttttgggcaagtctcctcagggtagggtggggttaattagcagacggtgactccaaagagcggcttgggcttcattctgttacaaattcacttgtcgggtggcctacagaaaactccagtgtatcctggtaagaggtggaaagttaaaagggcaatgtaattccttagta

SEQ ID NO: 682543 - DNA, 271 bp, Homo sapiens
atggcttatggaactcggtagctgggcagatttctactgggagatgcgcagtaggacagcgttaggtcttgaagcctgaccgtgtgagacgagcatccaaggctggtgactaaacggaagaatgtccaggccattcctgccgtcgctaactggataaaacgaaggccccaaaccaaactctagctgatccatgttgccttcaagtttgtttttctcgggggcatctctctcatcagataagacagctacatcagtctgcaaggaacccacg

SEQ ID NO: 682544 - DNA, 199 bp, Homo sapiens
  misc_feature (5)..(5): n is a, c, g, or t
ccccngactagcccgacagctaatcactcgtaccggagcttcctgccgaaagtgctggcgttctatcataacttggattctattggtctagcacactgatcagaatgaaacctaaactagctcctgctatactgtgtttgaaaaatcagtttctatgattactaaccccttgcccattgctctatctgtaaagtatgat

SEQ ID NO: 682545 - DNA, 301 bp, Homo sapiens
tctccagtctattatgtgtgatttgacatagatactgtgctagaatcgacctggtgtctattccgcaattatgcaataagactaatacgctatatagtcagtcaggtatatatttagttcaacgcaggagatctgcaaaagggtatgaagacattattcttttctttattggcatggccaacattaatatgtaccaaactagcataaagaaagttttcagcttgttgtggtggctcatgcctgtaatcacagcattaagggaagccaaggcgggcagatcacctgaggtcaggagtacgag

SEQ ID NO: 682546 - DNA, 314 bp, Homo sapiens
gatctccaccaccctttatcttaacccatacattcctttctactgacaaatagcttttttcaaccaattgccaatcagaatatatttaaatctacctatgatctggaagtgccctgctccctttgagttgtcccacccttccagaacaaaccaatgcaaaccttacatgtattgattgatgtctcgtgtctccctaacatgcataaaagcaaactgtaccccaaccattttgagcatgtgtctgcaggacctcctgaggctgtgtcacgggtgtgtccttacccttggcaaaataaagttaccaaattgaaaaa

SEQ ID NO: 682547 - DNA, 352 bp, Homo sapiens
gaatcacaggtgtcgtgaataagggggaccgttctgtcagagggtctaatgtcagtctcttgtttgggatgcgggtgcttctaagtcatctgccgtcatggttgggcatgggttcaggatccctcatctccatcaagttctcttaattcctcgggtgtgtgtggtcttttagctcttacatttctctaagatccatatcttaaaacccttcactccctacttctttcacttttttctttttttttttgggggccattttccaaaaccccagagtgattccctgtggaaagggcccgggttataaactcctgggaagagtttaggcagcgacacattgggtgaatgaggggac

SEQ ID NO: 682548 - DNA, 481 bp, Homo sapiens
tgccacctcccgggatcagggatctcccacctcagcctcctgagtagctgggactacaagcgtgtgtcaccacacctgcctaatttttgtagagtcagcgtttcaccacgttgcccaggctgatcttgaactcctgacctcaagtgatcctctcacctcagcctcctgagtatagctgggactacagttgcatgccactacacacagctaatttttgtatcttttttgtagagacgggttctcactatgttgcccaggctggccttgaactcctatgctcaaatgatccgcccgtcttggcctcccaaagtgctggggttacaggcatgagccccagtgcccagccagcctcagtattctcatgtaaaaatgggaccacatttaaactctgagcttctcgtaaggagttgacgtggtaactgatgaggtggcatatataaaatgcctggggtgtattatgctctcaagaagatgaggccca

SEQ ID NO: 682549 - DNA, 383 bp, Homo sapiens
cctttctgctttcccccattttggtttcctttctccccatcccctgatccagcaaagatggtggggacaaaggctaagcttctcttcagaatggtctgcgcaccatctgacctgcatcattgctggcacccgttgagaacagagttggggcaacagcgtggagaacagacctgtgacttttgcctaatgctttcacgtgtccaaagtcttccagtggccggttgatcccctttgaggacagtgctcagctgttagtctcagagttggaaatggaaggaaggagagggagtctagtttcattgactcttcaacaaatatttactgagcacccactacgtgctaggcctcgatctgggcgctggagacactgcacagcaaaacag

SEQ ID NO: 682550 - DNA, 1511 bp, Homo sapiens
gtactcgcagattaattgtatatctcttgggaatggatcgcataacatagtaggcaactttatcatcactagttgagccatattatctatcgtgacctaataaggcttttcctcatataactacagcctagcagggggacgattatttacatatctggtaattatctatgtgatcgattgatcccttgagtacacattactcgcaggtcgcctattataacttgattcttgcaatggcactcgctgagagatattggatcaggtcctatgggtctctagatgaagctcgatctcgacagtatttgatgcactagtataagtgcagtgaaaccatacttatttcaacacggattcactacacactttgcatgagcgagacactactcgataaattcttgtgtgcatgcatacttgagatattatagagtttgcgtggattgatagtttggtgactttaccctttggatttataccaattaccattggtggatttgtcagtacctacaattgctttttgttggaccaaacgtcgtttacaactacttggtaaaggtggtttccacctttttaggacgcactctttttaccatgaatccacggttcatcttctgaatggcagatactaacttatggttaacagacaggttcctataagctttactgcataaccaattgtataggataggtggaggggccaaaagacccgataatcaaatatttgtaacgggagaccgtggctttgttgcagaacacgcacgattctaagcattgaacctttatttcctacggatttggaattgcaccagataggaacctggggaccatccctgtgggatcacccaagcttagagggttcactttccaaaaactctctgtggttttccgcacttacgcattggacctttaacatttgaagtgaattaccacgcctacgtctgtgataaaagcggcgcgttagtatcacttaaagggtcacatttggcatgtgtctcagtacacacttgcagacattccttcccttgtgacccctaaagaattttcttactttccccctgtgtgtgaattgcattccatttcctaaggcgggggcaatatcggcggtaattatacaggcggtatgccccttgctggaattagcgctgtttgttaaacacaaacatcgataattggccactatttcctccagatttgtgaagatgcccctgtgtccattacacgccaattgtccctttgtctctgacaccatttacacacgagggctaatagggaaatctcccatgagacgggcaacatgtcggtgcgccccggatacttgtaagggggaacaatgacactgttgagaagcatgatcctccacgcgtatcaccataccggactaacgtcaaactggtccggcgcactccgaacattcaacagtataggaagaacctcggctaccacaaatccacatagtgttgcggagcgcgcccgctccatgcgaagtataatataagtagttgctacatcacaag

SEQ ID NO: 682551 - DNA, 380 bp, Homo sapiens
ttcccccaggggtcagtccccaaggggccctcctttccccccaaagagggccccaaggttaaagccccccccaattcccccgggcccccccccccccctttgggcctgcccctaaggagttttgtgggcctttctgggaaatagcccccttggggaaatttcccaaattgggtaaatttaaacccggaattggggggccatttattaaaaagcccccttaaagccgggaacttccccctagggggggggggggaaaaggttaaattttttattccggggttttttggggcctttttgggttttttaaaaattttttttggggggggttatgccccaccccttttttttttcagggcccaaaaaatttaggaaaacttcca

SEQ ID NO: 682552 - DNA, 727 bp, Homo sapiens
  misc_feature (46)..(46): n is a, c, g, or t
  misc_feature (101)..(101): n is a, c, g, or t
  misc_feature (123)..(124): n is a, c, g, or t
  misc_feature (126)..(126): n is a, c, g, or t
  misc_feature (159)..(159): n is a, c, g, or t
  misc_feature (197)..(197): n is a, c, g, or t
  misc_feature (241)..(241): n is a, c, g, or t
  misc_feature (275)..(275): n is a, c, g, or t
  misc_feature (316)..(317): n is a, c, g, or t
  misc_feature (321)..(321): n is a, c, g, or t
  misc_feature (324)..(324): n is a, c, g, or t
  misc_feature (347)..(347): n is a, c, g, or t
  misc_feature (352)..(352): n is a, c, g, or t
  misc_feature (386)..(386): n is a, c, g, or t
  misc_feature (404)..(404): n is a, c, g, or t
tgggaagccccggcacactggccaaactgcaggcccggagcagggngccttcgtccacgatccctccacgggcacagttcaccacacgcacccccttcttncctgggcaaagggtgtttgtcnntncagcaagcctgtcgtggagggcaggagaggagntgtgcacaggtgatgaaactcacagagaggccagattntccctccaggggcagctgctgaacaccaaaggaggccgagaccntcgtggggaaagtgagtggggctcataccctatnagtcttcatcccaaaggacgtgcactccgggtagctacctnntctnccnaatccgtgcccaggccaagaatntcccnggggtcttcccattcagcctcgtggtcccagtgnagcttcttccgctcccantttgccggtccttcatcgaagccgttcgccgtggggaatctgcctggccaggccatgatcattccacaagtgacgttctgcggcctgaggctgtcccccatggggggtgttcctaacccagatgcccttccttggtgtggggccccaggatccccattttgccccccctgttgcgtatccttgcgcccaccctgggggtctccacgtcgcgttatacactcgggcgcgcttggtggggagcggcacataaggcgcgcagactctgaccccgtataaccctctgtgagagggtgtgtcccccttggcccccttggagactccgg

SEQ ID NO: 682553 - DNA, 676 bp, Homo sapiens
taactggcgatcattttacggctcccatcgttttaaatacaaagattgggcaccccaacgcccgggattgccagcaaccaatgaacattactataacattataaacttgatttaccgtaaatgcgtcccgaattacattacctattacagtatccaacgttatcactgactaactccctaatacacaccactccattatcgacctccgtacgtttatacttcgatcagcggactaaacacttgctcacgcgccattcactgaagctcttcatggcatctatatctgcatacggccattctcaggttcctcaactttccgaatagtttcgcaatccctacttgattcaatttgtcgattcgaaccagatatacggcgcgatgcggctgctctacagaatgcctggtgagccctattgcgcttgtacccaatctgccttattctgtgactctatagaatggtaggttatgccattggctcattccttactgggatgcctgtagcgcgctgcacttctgtataactagggactttcctcgctcattgccaacttttcacccttcactttgccctgcttagtccatatcgcctctggtatgcattccccccatctctgctctaataccttttcgcatccacttttcttggtcaccgtgtcttctcccaggaaccctgcca

SEQ ID NO: 682554 - DNA, 207 bp, Homo sapiens
cccccccgggcccccccgggggggggagagggttttttccccccccccgccccgggggggagggcggaaaaaaagggggggcagcccccctcccccttttttttttgcccccggggtgggggggggggggtggggggttttttttttttttccctttggtttggaaataaaggggggcaaaaaaaaaaaaaccccgtttttttccca

SEQ ID NO: 682555 - DNA, 196 bp, Homo sapiens
aattcaagagcagatatgcaagcacgccaggatattgtatgtattcttagtagagatggggtttcaccaatgttggccaggctgatctcgaactcttgagctcatgatatgcccgcctcggcctcccaagtgcgggggttacatgccctgagccaccgcgcccagcccggtcctccttttattttcgaatccactc

SEQ ID NO: 682556 - DNA, 969 bp, Homo sapiens
aactgcagggttctcccatgggcaggtggtctctctggatgatgctgcgccccttccaggacccagacctgagctccctgtcaggccggttctgcgtgtctgggcaagcagcaggatgggcctctggtcacgacagcacgcatcacccgcatgtgggacaatcggctagctacacagtcaagttcgactcgctggtgctgagggagcgccgtgggtgtgcaacgggggacggcaatcctgtccccccatcatgcgcacagatgtgctcacagagtccgactcagacagcgacggtactgggtgactccagtcttatgcacaggagtggtggggtcagagtgcatggtggactcgtggggacctgcagctctgccttagcgggctgggaggtgcacaggcgaggtatatgctcgagcattacctcatgcgaaagatgggctatgatgtagggcaaggggttagcggccgagatctgcgcaaggccggggggcagccgcatccatgtctgatggtgttgccctcgagtgcaaggtcgcatggaccagtggtgtggagaccctggcagtaagcacacccagggtgggcaaccgctggctaccagacagaccccccgaggtgcccggggaatatgggccgggctgggggccgccagcctcctcggcaaatgtgtttgacttcctcagtgcaaacagttgcaggtccggctcctggggcccgtagaaagccgcgggcggccccagcggagaagggcagcacgcagggaatggaccactgccagcaagagtgcatcgggcctgaggccagcggctcatacagatgacgcacacaactggcgacccagcggacaaaccgcgcccggaggacacgccgcagctggcgaaaaccgggacccacgaacaacgggcacacacgcaggcgcacccggctacccccggagactcccccagacagagagacgccacccgcacc

SEQ ID NO: 682557 - DNA, 159 bp, Homo sapiens
atctagatcgtaaacgtagagaagctgcttgagtttattgtaaagtaaactgttacgtgaggatggtgggaaaacagctatggggacagaggagaggaagccagcgggcggcatcgagatcttcgtggtggtcgtgggccggcaggtgaattgagcccc

SEQ ID NO: 682558 - DNA, 215 bp, Homo sapiens
ctctcgaggatttcaagtacagcagagaagagaagagaaaagaaaagaaagaaaagaaaagaaaagaaaagattgtttccatgcctgctaacacaacatccattcttcagcccatgagtcaaggagtaattttaactttcaagtcttattatttaaaaaatatatttcttaagactatagctgccataaataatgacttctctgctggatacctt

SEQ ID NO: 682559 - DNA, 115 bp, Homo sapiens
ggctcggtctcagctatcatctcaacaaactggattgagtgttcgtgaccattccagtggaacacagttaacagccctgacgtgatggttatatgtacccactatctcccctatc

SEQ ID NO: 682560 - DNA, 341 bp, Homo sapiens
tgtcacggtctccacatgtgtcccgagagctctgaggggtaaatgtgtattttccctattacctgtccccccactcttattctctgttggaggagcgctctcagaaatgtttgtttcacatgtccccttaagttttttgttaaaagagtgtgtattgttatcactgtgtcttataaccctctgagggaaaggggagtgttttgtgggccccactgggtttcttttttgcgtgtggcacttttaagtttttagtgtttaaaatctctactttttattggagacacattgtgcacaaatttgtcacagagttttgtgagcccctataaaagttttatgtgaga

SEQ ID NO: 682561 - DNA, 301 bp, Homo sapiens
gcgttgaaactcatttttcttgcacgccaacttgttgagcaatatttgctgtgatgcatcattgacgtactcaacgcagattgcactgctcaacaacagaaaaatcaagattacctcgtttgtttaagctcttcctcaaaatatagctgtcatttcttgctgttttgtgcaccgatattatattttgctagcatgctatctagttgtctctgcaactcatctttttgttcgttgaatgttttgagagataattctgcaacggtcgtatcaaaaccacggtttcacgtacattttgcgattt

SEQ ID NO: 682562 - DNA, 107 bp, Homo sapiens
gatatttgaatataaatacttctccaatgatatgatttatgattctcctgttcataaaccacctctgtcaattttcacatttacaagccattactcgttgttgtctg

SEQ ID NO: 682563 - DNA, 796 bp, Homo sapiens
tctttgttcctgatcgtcgttctggtccatggcgcgttgtgccgattgccatatgtcgtcgcgatgcggtccctcccgctggcccggtcccctggcgtgcgggcatccggtaggtcgcccgcggaactcggacccctgtttgtgcggtcatccctatatctgggtccgtgcagggcctgtaatcccttttcttggtccccttttgccggattttttgacccgcgtgggggacctcttcggtcccgcggtgtcgcccatcagcgtcgacctcgggtgtcccgcccctacgtcccttttcccgcccgtcggtacatttccaaagtgtgcccacgcaggatagatctggcctgtcatggccagcacgtgggcaggaccaacgtgggtggatcacctgaggctcacagagttcgagccaccctaggggacatagtgagccctccatctctaccgaacacaagtcgagtgtgaaaccaaacacttccggttccgggcatgttggctcactcctgtaatcccagccaactttgggagagctgagccacggtgcgacttacctgaggtccacggagttcgagaaccagcctggccacactcgaggacaccctcatctctagctagaatagccaaaattaactgggtgccggtggcatgtgccatgtaataccagctacttgggaggctgaggcacggacaatctcttgaaccccggtagggggaggtttcagtgaccccgtgatctgctcccctgcaccccagcctgggtgacaggagccagacacccatctcacacaataca

SEQ ID NO: 682564 - DNA, 133 bp, Homo sapiens
ggctaaggcctggatgcggtcaccttcatgtcagcatcctcttggtcttgcttggcacccactctttgtcacagctttgtggaggaggcgtacacatagtgcttctgccacatgataacgagaagcggtgaag

SEQ ID NO: 682565 - DNA, 293 bp, Homo sapiens
gcaggtctctactctctctaaagcaatcaaaatacaacattcctggagtcctcagggagtccggctcacagaagggctcgtttaccttacaggaagacgatgctgacactagcttaagcacgcattcagcacaccacagttacagtgaatcacacaggaattccacacacattccctacccagggtcagccttagtttacataggggcgtcaacagagaaaaggcaggggtgcctaaaggtcttctcaaatggcccagtctccaggtcctggctcattgggctaagactgaat

SEQ ID NO: 682566 - DNA, 554 bp, Homo sapiens
  misc_feature (496)..(496): n is a, c, g, or t
ttacatcgggggaaaaagacacgtgctgggctatgggccggggcgcagtttatgtgtaagcctttcctggtgggattccattttcttatttcccgaatacttctcagccccacaagtccacggagtcttctgtctccagagacggccgggtttccatccccgagggcatctgcgcatcacttaccagggggtaccaggcacctccagggtgcccggcacggtgtcaggagcgggggatacaggtgcgggtccccacctcactcccctcaagctcggcaatatatgatacataacccacacacacagaccatatgcaaaaggggggggactccttggtaccggtcaccggcatcagggattatcagcatttggccagactggtttcatcagggtctcccaacacactccccccagacattacccataggtgctcaaatagattggggtgtgcgtgtgtgtgtgtgtgtgtgtgtgtgtgagggtgtgtgtgtatttntacagagacagggtctcgccctgtcacccaggggggagtacaggggcgagatcatagc

SEQ ID NO: 682567 - DNA, 155 bp, Homo sapiens
agttcgagagcagtgtgggcagatgttgaaaccctgttgctagctacaactacaaaacttagccaagcgtggtggcactgcgcctgaaatcccagctactcaggaggctgaggcaggagaatcgcttgaatctgggaggcggaggttgcagttag

SEQ ID NO: 682568 - DNA, 231 bp, Homo sapiens
aggaggcagaggcacgaagggagaagtctccaatggttctggtttccaggcctggtccaaggaagccctgtattcagggaggctaccatttaaaggttggcagatgagcttatgggggggcaatcttcaaaaagtccacagcagaatgcatccgggctcgcaggggccatcaggctttgaataaattgctggttccaagagcccagtgaatgccaggcaggcaccccttcc

SEQ ID NO: 682569 - DNA, 1209 bp, Homo sapiens
agcggggcgggtcacgaggtcggaggatccagaccatcctggctaacacggtgaaaccgcgtctctactggaggtgcaagaaattggccgggtgtggtggcgcacacctgtagtcccagctactcgagaggctgaggcagtggaatagcttgggcccgggaggcggaggttgcagtgagcggagatagcgccactgcactccagcctgggtgacagagcgagactcaatctcaaaaaaaaaacaagttcttccagcctaagaacatttagtttcttggactagcattctccagcacagaagtggagactagtacgtgtgagccagctatcctaagtagtataggtgcagcttgtgccattacacgttgattaccaacgccttgaaaagcgtggaacatgtcagtattgacacatcacgcagttgatacctcagggcaagaatacgtaaagcaagttgagtcccactttgcattcatgcgttagacaaatttcaatcaccctatcgtgtcggacaactcgtccacgcaagtcgtacgtcataacgggcgacggaaaacacttgaggccagcacgtcgtatctaaacaggatactgtgggctacactcttactgtaggaccgcctatctccattacgaggaaaccgctcagcaccgcagactccgcgagccgtgtacatccagcaaacaatcgcccaatccaatgttcgcacgcacgttcgaactagcgccttcttggcgcgagccactgaggctaacaacaaattcaagtatgaacccacattaccacggcacactaatacacacccagacgaccccgacatcaacaaacggcgtggcgaggatagctataacaacggcaccaacaacagcaacctctacacacgccacgtatccaaaccccacagcgagcgcgcctagacctacaggcattgcaaaccggggacaaagttgggcaacaaaagttaaaccgaagacagaccccggactcagacagaagagagggcaggaacccgcagccacacagacgaaacatgccatgttgtgacaacctccgcgacgacacacccacaacaagcaccaccaggagtgcatgtcaacaaccagccagcacgcagacggtgcacaaaatgtcacaatcagaataaccgcaaataagacataaccccacgacacatcacaccaccctccacaccgacaacaaatctacac

SEQ ID NO: 682570 - DNA, 877 bp, Homo sapiens
  misc_feature (12)..(12): n is a, c, g, or t
  misc_feature (69)..(69): n is a, c, g, or t
  misc_feature (182)..(182): n is a, c, g, or t
  misc_feature (209)..(209): n is a, c, g, or t
  misc_feature (255)..(255): n is a, c, g, or t
  misc_feature (258)..(258): n is a, c, g, or t
  misc_feature (270)..(270): n is a, c, g, or t
  misc_feature (281)..(281): n is a, c, g, or t
  misc_feature (286)..(286): n is a, c, g, or t
  misc_feature (294)..(294): n is a, c, g, or t
  misc_feature (668)..(668): n is a, c, g, or t
gcagagtggaancaggtgtgagagggtccagcagaaggaaacatggctgccaaagtgtttgagtccatnggcaagtttggcctggccttagctgttgcaggaggcgtggtgaactctgccttatataatgtggatgctgggcacagagctgtcgatctttgaccgattccgtggagtgcagngacattgtggtaggggaagggactcanttttctcatccccgtggggttaccagaaaaccaattatctttggantgnccgtgtctcgancacgtgtaatngtgcncagtctantcacgtggtagcaagacgatttacaggaatgtcaacatcacactgcggcatcctcttccggccgtgtcgccagccagcttcctcgcatcttcaccagcatcggagaggactatgatgagcgtgtgctgccgtccatcacaactgagatcctcaagtcacgtggtggctcgctttgatgctggagaactaatcacccagagagagctggtctccaggcaggtgagcgacgaccttacagagcgagccggcacctttgggctcatcctggatgacgtgtccttgacacatctgaccttcgggaaggagttcacagaagcggtggaagccaaacaggtggctcagcaggaagcagagagggccagattgtggtgganaaggctgagcaacagacaaaggcggccatcatctctgctgagggcgactccaaggcagctgagctgattgccaactcactggccactgcaggggatggctgatcgagctgcgcaagctggaagctgcaggaggacatcgcgtaccagtctcacgctctcggaaatcactacctgccagcgggccagatccgggctcctcccagctgccc

SEQ ID NO: 682571 - DNA, 165 bp, Homo sapiens
gaccaagaggatccccgttccgtcgaccgcattgagcaacaggaccttcagacagtcatcgagatctaccctgacctcagcagcaacgacatgctcctcttcatcgtgcaagggcatccaacttgcccacacccccaggactgtcccctgtgcgatctgcgatgt

SEQ ID NO: 682572 - DNA, 576 bp, Homo sapiens
atgacccaccaatcacatgcctatcatatagtaagaacgcgcagcccgatgactcgcgcataacaggggccctctgcagccggtcctaatgacctcgcggcctagccatgatgagttgtcacttccactccataacgctcctcatactgaggcgcttacgaacctagacacagtaaccatataccaatgatggggcgatgtaggcacgagaaagcgcataccaaggctcacgcagacagccaccgtgtccgaaaaaggccttcgagtacgggataatcgcgtatgtatgacctcagaaattgtctccttcgcaggatttttctgagccttttaccactccagcctagcccctaccccccaattaggagggcactgggccccaagcaggcatcaccccgctaaatcccctagaagtcccactcctaaacacatccgtattactcgcatcaggagtatcaatcacctgagctcaccatagtctaatagaaaacagccgaaaccaaataattcaagcacgtgcttatgacaattttacggggtctctattggaccctcctacaagcctcagagtacgtc

SEQ ID NO: 682573 - DNA, 277 bp, Homo sapiens
caagacctgtctcaaaaaagaaaaaaatgcataccttcagaaaaattaagtatgccttcaatatattatacagattgtactatataaagcatacacaaaaatagaaattaaaaatgatgatagctgggtgcggtggtgtgtgcctatagtctcacctactcaggaggctgaggcagaaggattgcttgaggttaggagtttgagactagtgtgctaagatcaagcctgtgaatagccactatactccagcctgggcaacacagcaagaccccatctc

SEQ ID NO: 682574 - DNA, 119 bp, Homo sapiens
acccgctatcaaggagccaattccttatttggtgaatccacgtttactcttttatggattattctttgtgccatatttaagaaatcttgtctaacacaggtattttatcctgttttctt

SEQ ID NO: 682575 - DNA, 1628 bp, Homo sapiens
  misc_feature (874)..(874): n is a, c, g, or t
  misc_feature (897)..(897): n is a, c, g, or t
gagctgaacatggacccggctgcgcgggtggtgctgggcgctgtgtgcctgtgtgggtgcgcctatgtgcctggaggctgttgagtgcctgccccagcctgctgctacccacgcagagcctgggctggcttcgctgggggcggcgtggctggccctgagccccgtggctgcagctctgtaacggggagcccgctggctgcttgtgttagctgcggctgctgggcctggggggaagccctggggcgtgtaacaacaatggctggcggtgtgcaccatgcgctgcccatggaccatcccaagcaggagacgctcagacacgcggcacgcttcatcccctgttccaggcacaggccatgccaagactgatccactgatacacaagttacaacgacgtgatccctttcttgccagcaagggtccagaagacctttccatcgacctatcacatgcacctggcacatacccaggctaggtggagcgttgaaccccttgttgcgcacgggcattgacgattcaccgctacgtcgatcattacacgaaaacggcgtggccccagtcactggacggggcccaaggcacacgcacgaacacagctcgaccgaaccaaactcacagctgacatccctcgtggtcacaatcagttcaacctgacaccttcaacggacgcttacaccttggtaggtccgaagggaccaagacacaccattgagaacacagagctcacatcaccacttaccattagctcccggacccaattgcaaaggcgactgtctgaaccagacgccaccggtgacacaaaggcccgcgcctcacaccggcggcttcactggtgtcaacacacaacgactactgggctttcgattgcatcatcacnggaacaacagcgcacggcacccnaccacaccggctgctcactgcggtggcgcacactgcccgcccacgtggccgccgcgacaggcacaactgcaccagactgggcaggcacacacaaagccgcagggacaacaaaacatgaacaaggctgaccgcccagcactaaccagcaacacccaagggatgacacgcaagcgacggcacaccacgaagaggaaacagggcgccacccttgacacacaccacatgcaccgccggaacgcgcacacaccccggacacgaccacaataaaacgagacagagcaccacaacaccacgaaggcgacaggcgctaagtacgcacacacacaagcgcacaccaaatcaggacgacacacaggacactaaccgtagcggcacataacacagcgaagcaaccgggacgcatccgctacgacaagagccccacagaggacccaacagaaccaacaatcagagccgcgccgacagcacacgacgcgcagccaccacctcgaacgacacccacgacgaaaggcgggacaaacagacacacacagctccgaaaacaaaacaaggcacgcaacgaaatagatcacaccaatcctattgttcgctctgccccaggctcaacacaacacagcaccaagcagctgaccaagctactggctcaacgcccaagtaagcggcaagcaaccggaaacacgtggcacacagcacgaggccgacccactacagaagccgacagcacaccaact

SEQ ID NO: 682576 - DNA, 128 bp, Homo sapiens
ctgctattcatctgaatgtcgcatcgtctgtttctcactaggggccgcctctgctcatctcactagtatcatttgtaggaacctccatgccttgtggttccgattttttctcagataaaatgaagtgt

SEQ ID NO: 682577 - DNA, 294 bp, Homo sapiens
tccactagtgtaggcatgtactctcagctactagggaggctgaggtgggagaaccactggaacccagacaatcaaggctgcaatgagctatgactgcaccattgcacaccagcccggtcaacaaaataagaccctctctctcagaaaaaaaagaaaataaactgattatctgagttccgcacactgctctagcaaagtattaaacccaagaagacagatacgggaacccccgattggcaacagggtgctcaaaagtatggcgacaacttatgacttgccattggcatctgaagt

SEQ ID NO: 682578 - DNA, 513 bp, Homo sapiens
  misc_feature (11)..(11): n is a, c, g, or t
  misc_feature (128)..(128): n is a, c, g, or t
  misc_feature (389)..(389): n is a, c, g, or t
aaacccccttncgggggcagtttccttccttttcaaccaaggaatgcttcgagcacccacagggccaggacgtctttgactcaattcttgcttgctgctgcgggagctggatgcagaggggtggaagnccgtgcagcagactgtgggcagccggctgcaggccctgcgtggggaagaggtgcaggagcacgccgagtgaccgcaggacctgaacgccgctccagcctccacggggaccccagtgtcttccccagcccccgggagctggagggtggctgccatggccgcagcccccggccccacacaacgccctcccggctttcccaaatcgttccaggacaggagtaggtattagagcctgtatatggggagagggagacactcctgtnagctccatagcagtaaccaggactggctctttgaggtccgcaggttttagtttgggttaggatgcaaaagggaggattttggagtctaccctccggaataaacaatttttccaaggttaaaaaa

SEQ ID NO: 682579 - DNA, 516 bp, Homo sapiens
ctgggtttttccttccatttattcttcttctaggtttgacaatttatgatagatttgctctctagaaagaaacgtctttatttaggagggcaaaaattttggtcatagcattcacttttgctattcccaatctacactggaaagatacataaaaagtgctttgcattgaattttgggatacttcaaaaattccattggtggtgttaagggatagtattaagcctttcaggttccggaaaattaaaaaaatttcctttttgaaatgattccctctttggaagaaaaaaagccagccttttagccccaccaaattgaattatggaaaaccaaaatgggtcccttccatgggcaggtcctgtccccccccgccagtcctccacaccccaactggttttgaatggcctttaaccttttggtggttttttttttttttccaacccctggatttggaggcttttctgtgatttttaaaaggaaacttcctgaaggtggttaataaagtttttttcccaaaaa

SEQ ID NO: 682580 - DNA, 1058 bp, Homo sapiens
gaccggacggagggccggcgaggtgcggggtctggtgatgcgagctgacgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggctgaaactgacacttataatcgtcactggacttgtacagtacccgaggcgaagcagagctcgctgagccctgatttctcttgacgtgtcttcgttccgggcgcagctctcgtgacgcttgaacacgtactctcctgctgggcttcctggcgccgccaccccgttccgggggagccgccactttgcctttcctgctctcccctagctagctagcgtgcctctctccgcgctgctccggccagccggcacctagaggcttggggaccttggcactcgccatcctgcactttacatgcaccccttacagctctgcgcaactaacgcctctcgcgcctcacccgaccgcgctctccggctcaccagcatactcacagaccacagaccttggacgcccttaccactatccacactaacgcggccaccctccaccgcctccagcttgctcgcatctacccgcacgacccctcctcgcctcccttccccgcactccccctcccactagccacacaccggcccgcccccccacccccaccccgccacctcgcctctcgcacacccttccccaccctggcacacccccgccacttcactcgcccccccccccgcacacccaccaacgcacacccttccaccacccgccccctcaccccccgccaccgaaccacgacgccccccactcccgacaaccccggcggctccgccccccccaacaccccaccccctcggccccctcccccaactactgcccccctcccgcccgccacgcgccccaccccgccccccgcccacccaccacccccccccgacccccccctcccatcgccccacacccgcaccgccacccc

SEQ ID NO: 682581 - DNA, 291 bp, Homo sapiens
  misc_feature (35)..(36): n is a, c, g, or t
  misc_feature (58)..(58): n is a, c, g, or t
  misc_feature (63)..(63): n is a, c, g, or t
  misc_feature (65)..(65): n is a, c, g, or t
  misc_feature (108)..(108): n is a, c, g, or t
  misc_feature (127)..(127): n is a, c, g, or t
ggttccgagctcgaaatacagttagctcctgctcnnattgtcacccgtgttaaatttntttcncnaaacttagcaaatggagattaccaccctaatagccttaacctnggagactctagcaaaggancgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgcgtttcacttccga

SEQ ID NO: 682582 - DNA, 149 bp, Homo sapiens
  misc_feature (2)..(2): n is a, c, g, or t
  misc_feature (4)..(4): n is a, c, g, or t
  misc_feature (19)..(19): n is a, c, g, or t
tncntttcaataaattttnatttaatatccagtccagggcatactccggtttctccagttgttccagaaatgtgtttttacagctggttcatcaaaccagggtccagtctagatcttcacgttgcatctggttatgaagagaattatat

SEQ ID NO: 682583 - DNA, 524 bp, Homo sapiens
  misc_feature (7)..(7): n is a, c, g, or t
  misc_feature (22)..(22): n is a, c, g, or t
  misc_feature (34)..(34): n is a, c, g, or t
  misc_feature (175)..(175): n is a, c, g, or t
  misc_feature (178)..(178): n is a, c, g, or t
  misc_feature (187)..(187): n is a, c, g, or t
  misc_feature (194)..(194): n is a, c, g, or t
  misc_feature (215)..(215): n is a, c, g, or t
  misc_feature (246)..(246): n is a, c, g, or t
  misc_feature (293)..(293): n is a, c, g, or t
  misc_feature (308)..(308): n is a, c, g, or t
ataaaantgtgtcgtgcaaggnaagttggcccgntgcctgaaaaaatccaaagccctaaaaaattgtcccctttgtctgttggtccggcccaagatcccagaccacctcctcgtcccactcactgaccgccttctcccccggcccagggcaccctaaatctactttgactacganaantggggccancggaaanaaggaaggcttcacctttgantaccgctaccctggaggaccgggacctccantgaaaccggcccctccctctacccacccccttcccccgcatgctganccccctgcccaggtngagccctgccctggaagactggagggagccccaagccacggggcatccccctctcccaggaatcagggagggggccgggaggttttcctttcaacccaccctgggggcccggggcgagggctgccccctcctcccctccccagtgagggacattttttggtaaacctattttcattttggaaaatatttatgaataaatagttttatatgaaaaaa

SEQ ID NO: 682584 - DNA, 524 bp, Homo sapiens
cttagtagagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaataagagatactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctca

SEQ ID NO: 682585 - DNA, 306 bp, Homo sapiens
caatatcacacaactactctgagcttcaggtagacattcaaaactaggaggatctccttttcaaaagcctttacatgattcagaaatgctaaacagggtaacaagaaagaaatcttagcatatgtcgtattaagtacatgtagacctcttaaaaataaacagatgagcatgtagtagttctctagatctgaatgtgcaacacaaaaaaaacttcgtcagatatttctaggttttaggtttaaacttgcagcccagcacaaatacattagtaaatatgaggtacttccatcagtaaattgcaaaaac

SEQ ID NO: 682586 - DNA, 416 bp, Homo sapiens
ggaagatcgagaagaaggaggaaagaaggccgtgtaagacgattaagaaggaagaaaaagaccaggatgagctggaaaccgcgggacctgacatagatcgtggtcttaggagtcaccaaagatctaggcaagcaggaggaatggagcggtacggtctgtgatgggataacatcgagagaggagagtcccgtcgatttagcgtggataaagccactaagcaggtccataagagagaagctccaacgagtcagggactcgcaaggtcacggaaagcaagagacatgagagagacatctcgtcgtttgataataatcataacgaagaaagggagagagagcgccagaggcgagcgggaacgggagatccgcgaaacggagaggcgggggagcgcgagcagcgggagcggggagcaacgc

SEQ ID NO: 682587 - DNA, 542 bp, Homo sapiens
cgctttaagtaatggcttgctgcctaaaagtttccggtctccatttccatcttaggccagtctcagtgattgtaggtgctgtgctatcttattcagtctggcttttctacttcccactgcagtttcaaggaatcccaggtgatagagtgttcatttagaaggaaaaataatgagcaaaaatgtattgagtatctaccatgtgttagtcattgtgttaatcattgcaaacataaatatccattttacagatgggaaaaataaaactcatgcacattaagctctttgcctaaagtcagacaatccgtaagtggtgaaagtataattctacacctccgccatcgatcaccctcaaacaagtcagttcccggttggtccccacccccctgtgagtggccgccaccgacctgcatgtgagcccggctcgcagaaggtagcagcctgtgcccggcagagctgaggctccatgtgagccgcgcgggaggcgcagagtcgtctgcaccggacggaaggttgcaccggtggcgggcgcgtgcagcggccgc

SEQ ID NO: 682588 - DNA, 503 bp, Homo sapiens
cgctttaagtaatggcttgctgcctaaaagtttccggtctccatttccatcttaggccagtctcagtgattgtaggtgctgtgctatcttattcagtctggcttttctacttcccactgcagtttcaaggaatcccaggtgatagagtgttcatttagaaggaaaaataatgagcaaaaatgtattgagtatctaccatgtgttagtcattgtgttaatcattgcaaacataaatatccattttacagatgggaaaaataaaactcatgcacattaagctctttgcctaaagtcagacaatccgtaagtggtgaaagtataattcaaagccatggctgcttgactccaaaagctgtgccccttcaatttcatcaatgctatattgtgattaaacaaccggatattgattatggaacaagcagaaatgtccattatctcctctactatttaatattgtcagataaattagctaaaatggtaaagtcctaaaaagcaaatagagg

SEQ ID NO: 682589 - DNA, 230 bp, Homo sapiens
tcaaatcgggtcagaagcacacagatgtgtgcctttttgtcttcttgtttcccctctttagagagacagtctcactctgtcacctagtctggaatgcagcgatcatagctcactgcagctttgaacttctaggctcaagcaatccttctgcttcagcctcccgagtagctgggactataggcatgtgccaccacacctgggctaattttaaaaagttgtttatagagtag

SEQ ID NO: 682590 - DNA, 390 bp, Homo sapiens
agaggatcccccggcgtttcaaagcacactggacgctcctagctcagactacgagcaggtgctggagaacttgaatctaagaggttccagcgtggtggattcaaggtctcaagggcggttcctgggcactgaggccggagctgtatgcggtaggactggattcgggccatatccgtggtgacgataaaatgcctatcatggacttcctgactgaggatggatctacgaaaagggccagaagagtctccgtgctctgttccagatcaaaaaggtggatctatcggagtcctttattggcatggtcgccaggaaagtcaccgcctgccacgtggccttggctgcctacctctgcggcaagcctgatgtggccgtgcacaatggcacgtggat

SEQ ID NO: 682591 - DNA, 243 bp, Homo sapiens
gggccttacctacccggttccagtgatatttcttgccctgttccccctggccatgtgcagtggggccagctcagagtacgccttgtagagcggggatgaggccgtcatctgcgaggcctatcccgcctatcccaggcatcccagacgaggactggctgaggctaggcgctctcattatccatcctgccccgggaggtcggcgcgcggaagacagagaaaagcaaacgcgttctctctccatct

SEQ ID NO: 682592 - DNA, 368 bp, Homo sapiens
  misc_feature (368)..(368): n is a, c, g, or t
gaaagatgcaaaggaatatgctaatcaatatatgagggagtattccactaattacggacaagctcgtctgtcactgtgagtcatgttacacctagagttatctttctatggtaggggcctgctgtacctctgctagcccaactgtatgctttatgagagagagactccagcttagacatttatcactgctcaccactctgtcaaatagagtatgctcacaatatgctgcttatggggagaagaaatcatggctcagcaatctcataaagttagcccataacatcctctgcaagatgctgtgagtctgactctgaagattgcatggcctgagagctgtctgaacacacagtgactctgtgacttttgcn

SEQ ID NO: 682593 - DNA, 227 bp, Homo sapiens
ggcacgccgcgatccttcgcgaagcccacggcgcgcagcgtcgcctccggcagtggctctccggggccgccgcgcatcaggtacgcggagatgactagcgccgcggcggagtcgaacaccgacggagggacgctctcggggcgcaggtggttcatcttgcccgcgctgatggcgaacgtgcgctctccgtcgggagtgatgagcgcgaagcagcggccgatcggccc

SEQ ID NO: 682594 - DNA, 878 bp, Homo sapiens
gatcatttgaggccaggagtttgacaccaacctggccaacacggtgaaacctcatctccactaaaaatacaacaaattggctgggtgtggtggcgcatacctgtaatcccagctactcagaaggctgaggcacgagaatcacttgagcctgggaggcataggttgcaatgagtcaagatcgcgccactgcactccagcctgggagacagagcaagactgtctcaaaaaaaaaaaaaaagttatttcactagcaacatattaatttcccattaaaacaacaaggagggttttacaattgaactacacattgcaaaattacacctagaaaagctagatatttttaaaaaccgtggctgaacttactcgggtaaagccaaaatacttgtcacatccataacgttactatttcccccaatggcactctatttcggtaacattgctggttccacattattgacggttcggtacaaaaaggcaaacatcatactgttctacacacatgggcgtacattaacaggatgtcctacacaattattagcccagaaggtctatggtgttaaccctggtattcgccacaaggacgtcgatggcgcacatttctcaattctcacaactggtttcccaacaatacttctcagaactggagaactaaaatcttaccaattggtacacaattggcccaccaaaagaccggctggcgacacacaccgagaacaacgggttatctaacaaagggcctcgcgtctatactgcatttaagagattacccccattttaaacaaacaaccagtcaacacgcagaatactacgcacaccacgaaagacaacaggggggggccgcgccgcccccacaaacgaatactccccccccacaaagg

SEQ ID NO: 682595 - DNA, 144 bp, Homo sapiens
cgagctcggcccccttcttcgaagaacaacggcatctaagcgttagtgctaacatggactgtgatacatgataataccaacgttagctcatgatagtccagacgagctcgattgaacgaagcccaggcagacgacggtggccca

SEQ ID NO: 682596 - DNA, 171 bp, Homo sapiens
  misc_feature (1)..(1): n is a, c, g, or t
  misc_feature (5)..(5): n is a, c, g, or t
naggntaccttacatgcatattttgtgtagtggtgaagtttgggcttgtactctctacatacatttaattaatttatttattaaatatatgtagagagtacaagtgcaggtaccttacatgcacttgtactctctacatatatttaataaataaattaattaaatgtttta

SEQ ID NO: 682597 - DNA, 84 bp, Homo sapiens
gcggccgcctactactactactgctcgaattcaagcttctaacgatgtacggggacatgaaatgtgaataaatgaaaagtaagc

SEQ ID NO: 682598 - DNA, 376 bp, Homo sapiens
aaaaaaaatttttttgccttggggtccggttgatttatgcccttccccccaatcctggggtttttgaaaaatggggggggtccccccagggttaaatggattaaggggggggcaaaatgtgcttttttaaacaaaaggttagagggaggaggccccttaagggttttcccccctccctttttttaaggccccggggaccccaaccctggggagggccgcggggtcttttgcctaggaaaaccaaagccctttgttcctttgtttttttggggcccttcccccccaaattgtcttatggcccggccaaatccccctttgggggaaaccccccagaatggtccataaaaaaattaattaattaattaattaaaaagga

SEQ ID NO: 682599 - DNA, 433 bp, Homo sapiens
cccctcgaactcgacggtttctcacctttgactgccccttacagtcacctggggagcttcacctggtctgacatcatcagtctggctgtggtctgggcctccctgccccgttaattttgcactgtgcagccaggattaggaatatggccatggactgggcgcggtggctcacgtctataatcccagcactttgggaggccgaggcgggcagatcacaaggtcaagagatcgagaccatccctgaccaacatggagaaaccctgtctctactaaaaacacaaaattagccgggcgtggtggtgcatgcctgtaatcccagctactcgggaggctgaggcaggaggatcgcttgaacccaggcggtggaggttgcggtgagccgagatcacaccattgcactccagcctgggaaacgagagtgaaactctgtctc

SEQ ID NO: 682600 - DNA, 1062 bp, Homo sapiens
ccggtgttctcctaggtttggtcgggtactgggcacgtgtcccctgttgcccgttgtttgaagcctgcttggcttctccttccttcgggtattggggtggctcaacccttgtgtttgccaggtcaatcgtttaccctccgggggagtttaatattctgtgtcctgttttactgtctacccatgagagctttagagtcgaagctccttcctcggggacaattttgggctgtcaatgtcaatgaatcatgtcttatcacggatgtttcgtcgtggcaaacgttagctggtgacagcacatgatgatcccaccaatggaaccagctggcttctactgctcaggtgtggatgttatgcctgaaccatccaggccaaatacagcgcacggctaatgcaccctagtattaggatctgctcacgacggctcaacatttggcagtgcatacgttgtgctgagactgaagcgataatagatttgattcggccgtttctggtataagatacgctggaagacttggccctataatttcttgcaagctctggtgatagctgccaattgttagatactgcgttccatcgggcaagcccatgatgtgtttgagagcattctcagaactatccgaccttatggcgtcgtctttagtctgcttcagtggatactcgagatcagacagttgccggtgggtgtcatcaaagcagtggacaagaaggcttgctggagctggcaaggtcaccaagtgctgccctagaaagctcagaaggctaaatgaatattatcccttatacctgccaccccactcttaatctagctcggtaggaagtagacggtcatcaagaacctgtgtgtgtattcacatgtgcgccgattatcaagctcttagttgagcttagagaagacatggtgtaatcgatgaagctactgctatcgttgaaaccttcagataggataaggagaactgttattgtggaccactatggttttcattattttgcgtgtggcagttttaagttacttagtttttacaaaatcaagtactcttttcaactggaaacaacctgaccgga

SEQ ID NO: 682601 - DNA, 1029 bp, Homo sapiens
  misc_feature (4)..(4): n is a, c, g, or t
  misc_feature (767)..(767): n is a, c, g, or t
taangagcatgggaattttatttaactctaggtaccagggattggacatcagtaggaaagactaatgaataagcagccatacaacttttggggtcacgtgggcttcccaagcaccaaaaaagggagctattttctccaattcagtttcatctttaataagctagacagatccgtggctgcattctttgggtttcatagtttataccagttacattcatttagtgtagttatacgtggcagtggtggtggagcaagctcattagtggtagttaccaagtttatacattcactcaataggacctacaacagtggcacatttcttactcttaagtggtagccctcaaagccaacgaggaaatacagagaagaacagcgggtctagtggggtgggagaactgggccctctgtggacaagagtctagtgaatcaccactaaactttatgagggttctagacaaaatccttatctaaggggaggtaacctaaagaggcgggttccttccaagtgggcttattgagaaactatcactatggctatggcaccaaggtggctcagtggctagaagaaatgcaagcgcggaaagaaagccgcgtgtggcatgcgaggcacagcagggggacaattagacgagtgggatgatgccggggtatcggggcagttctcaggtttccacagtaagtctcgtggtcgtggtgagaagagcgctgcggggcaacactttggtgcctcatgatcggcgaagtcggatacgacattctagaaaagncaaatcctgtacttcctgggtgtagacattcagatcccatagagcccataccggaccatggactcccatcggaacccggagcactctccattgggaagacggcctcggttaaaactggggcaaagttccagacttacgaaatttctcagcggagccaactcaagggcgatacaggcgcagaacagaactcccggctccaagggtccaacgccgggcaaacgttgacgtccccatgcacgggcatacccgggacgaggcaaaa

SEQ ID NO: 682602 - DNA, 303 bp, Homo sapiens
ctccattagtcagagagattgaacatggtgtaactgtagagagcctgtcatcctggtgggtgcacttgctgaaagatccgctgaagagcaaccttcgtgaacattggcgggggactggtgctcctataaaacgcactgttttcgtcactgcgaggtgggtctctcaccgcgatggactggctgtgatgacaggggacttcttcgctgggcggtccctgtcacactgatggtgtgagtatgtagggcaggggtgggagtgggcgatgttagtgtgttttgaataaacgtgattttgaagtagaa

SEQ ID NO: 682603 - DNA, 140 bp, Homo sapiens
tgaggaggtagttgtggcataaaaatgattaaggatactagtactaagagatcaggtcgtcctttaatgttgtgcactatgtatatatggtgggatccgtctagtatgtcgaactgcatggctatgcaagtgttggtaca

SEQ ID NO: 682604 - DNA, 1433 bp, Homo sapiens
gctccagagggttctgccggttcccccagtctctggataccacggtactgcatcgcgtacaccatgtatgcgagcctatcgtcccattgctcgtgctcagccattatacatcaaatgctgttgcaatcctggtgataccatacagtacacatcgtggaaacatcctagagtgtcttgcccatgactattgcaagatatcatcctgagcatgatttggtgacctcaaggtccatgatgataggatgctatgcggaccctactgggaggccattttgtgcattgaaccagattgtatgagctaatagacctatttctatcatagaaggcatacagtgatctcaggcgatactcaagctggctcaaagctccaattgaatccgtaacattcaagcccgggaacccatcgccttgcataaaacgtgcttgggaacatataggagcaagagccaaattacaagtgtaaactttaattccacttctcgtaaagaggtgaccaagttcgcatggcccttcgctatcgattcagaataacagggatttgcccgtttgggacgccacctggacataaatttgccagcgccctaataacgatggtcggcgaaagaagtcgagagatcgcaatataactccggagacagaagcggatattatcggggaggatgcacattagttaggatatcgacgcggtaagacgctccattatacgcaggaaaacagccattacaccgattaggttcgccaaaaggatcttgaagcaacctattaccgtgtttgtaaacccccgattgcataatcaattgtcaatagtccacttgtaaacacggcagcttctaagagtctcacataacagggttcgttacactccgtttcaacgtttagacgccatacattgagcgctacactcccacaagttcagttgcgtttggagtctcccacgctacgttttgttatgagcgacgttctagaacccactatgcaaactcgtagggtcctcctcgttgacgcaaatttgccattggatacacagagcgcaaattgcgcccctaactaaggcgccattttgcccaccgcgacaaggaaacatactgggggattcgcggaggcgacaatactgagaaacgccataactgttggcatgacactttcccgacataaagaacacatattaaattctgattccacccacgccaacttagttttggtgaagataacggcttagaaagctataagcacctattcgtcgtgcatgtctgtgccccaacagatcacaagtccatgacaaacaacaaggaaactatccacacaataggaatgacattcacttagtgggccgcagcatggagaacaggtctacaatgttagcaaagcgtatattaagcacacgcatgtaggtgacaattagaatggcagagacactcacaagttagcgcaga

SEQ ID NO: 682605 - DNA, 178 bp, Homo sapiens
aattatgtcgacagcgatttctaggatagtcagtagaggtagaattgtgaagatgatatgtgtagagggaaggttattgtatgatattgctagagaggcgcttccaattaggcgcatgagtaggtggcctgcagtaatgttagcgattagtcgtacggccagggctattggttgaatg

SEQ ID NO: 682606 - DNA, 721 bp, Homo sapiens
caacattctgaaggatttctttgaagaattttaacaataaatgaacatggttttaccagtacatcctgaagacaaagtacaatcaaatcactggctaccaagagttggaagtgagagcagaagcagactgatcaagaacaaaggtcatggcaacactttttttgggatacgcaaggcattttgctcgttgacttttgggagggccaatgaatgccaacatctgcttattgtaagagtattttaagaaagttagctaaagcttgagcagaaaaatgcctaggaaagcttcaccagagagtccttctccaccatgatagtgctcttgctcattcttctcatcaaacaaggtcaattttgggatagttttgatgcacatttattaggcatccaccctacagtcctgatttggctccttctgacctttttatttcttaatcttaaaacgtctataaagcgtatccatttttcttcagttaaaaatgtaaaaaagactgcattgacatggttaatgcaggaccctcagttctttaaggatggactaaatatgtgttattattgcctacaggtgtcttgaccttgatggagcttatgttgagaaataaagtttatactttctattttcatctaattccattttttccacaaactttttggagtccccttgtattaccagaatactgtgaattggctttcaatattggcctaaatattatcccaattt

SEQ ID NO: 682607 - DNA, 1259 bp, Homo sapiens
gctgagcgtctatgtgcagggcgaggacgggccgggatcccagcccggcacccaccctcacccagatgcgcagcgtagctgccgggagaccgctgaggcccggcggacggacacgatagcaagcgccggagagaacgaggcaggacgacgcagcgagcggcagcaacgggagggggacagagaggacaggacggaggccaagcagaagagacaacgggaggacgagacaacgccgagagccacacaacggcagagaaagagggagagcgcgcaggaggagaggaagggaaggggagaaaggaagaagacgaggaaagaggaagagaatgagggccaagaggagaggaagaagcacgagcgagcagcgagggagaaggaggcagagaggggagagggggaatgccggcaagagggagggacgcgacggagggagagggcgagagggacagaaacgagagacgcgagcacgaggcgaggcgaccgaggcagcgagtcagagagggagaggagcgaggcgggacagaagggaggcgaggaagcgaacgacggcagaaggcgagacgagagggaggaagagggagagggacgaaagagaaggccggaggagagagcggagaggaagaagggaacgagaggacgacgagacggagggaggggaggagacgcgagggaagagagaaagggagaaacaccgcaggaacgagacacgcggagagagcaacagcagaggagagaaagagggagcgagaagagggaggaaaacgaaagacaggacgacgaagcaggacgagagcagagcgagggcgccgagaggcgagcgacgacacgaggcgggaggcgacgacagagaagcgggagcgaggagagaggaggagaggaaggggagaacagaaacgagagacaagaaacgagacgaacaaccgcgacaaggagcgggagacaaggctcaaggagagaggagagaagaagaagcaagacaagcaagccggagagagagccggacacgggagggcagcaacgagcggagagagacagacgacgcaaacagggacacagaagaagacaacaggacaacgaacagacaagcgtcagaaagatcggaaagagacaaagcagacacagagacgtacagcacgagagcaggaacggcagagcgcgaggacccgagagacggcacaggagccagacgagagagagaagagagagaagagaaagaggagaacggagcacagaggagaaaagacgaagcgaggagagcg

SEQ ID NO: 682608 - DNA, 349 bp, Homo sapiens
  misc_feature (349)..(349): n is a, c, g, or t
cccacacccaccgcccaccatgtgtcagacttccaaagtgctgggtctacatatttgggaggctgaggttgtgggatcacttgagcccaggagttcaagaccagcctgggcaagtttgagagaccctgtctgtgttagttcattctcatggtgctatgaagaaatacccgagactgagtaatttgtaaaggaggtttaattgatgcacagttccacatggctgagaaggcctgaggaaacttataatcatggtggaaggcacctcttcacagggtggcaggagagagaatgagtggcaagcgggggaagccctttatctggccctgtgattcagatatcttccctggtn

SEQ ID NO: 682609 - DNA, 109 bp, Homo sapiens
ggatttgctggtgcagtacaactaggcttaatagggacatgcgaaggagggcctcctttgtcttgagcatctgaccctggagcctctcaagcctgcactgctgcaaaaa

SEQ ID NO: 682610 - DNA, 1136 bp, Homo sapiens
  misc_feature (744)..(744): n is a, c, g, or t
ttgactattctctacaacagcactagatagaacgattggaacactgatacctattattcggcgcatgagctgtagtgcgtagtgcaccatgctcataatgcctctcttattctgagccgagctgtgggcccaggctcaggcaaccattctaggctcaacgagcactatctactaacgataatctgtcacgagcgccatgcaatatgtaataatctacttcatagtaatacaccatgcataatacgagagggcttctgagcaaaacatgactaaggttaccactctgaagtacatccggagtccacctcgactagtgagacgatttaccctctgctagttacaacaagcgattgaagactctctgaaactctaacctgcccatctcatccctaactcactgacgcgactattctagctcatcagcttggggagtgcccgtgtagccagggaaagcaagtgtttgaaaacgagtcctagacactctcgctttcaggcgaggcggcaaactaaagtgccacaacggcacttgggagtcccatcacgttaggacgcctaaaaacccaactccgtgtcgatactcagttagaacatacccgttaagcagagaggtttgcatcactacacctgtgcgatgaattcacttgtccaagttagagaggcacgacttgcaaacagcgtttcttcgaattggcgagccagaaccaagaacttttccatgctgaaactgagcgtatcaactagacncaccacgcgcctttggtcacaatcaaagctcacctacagataactacaagacaagtcgagccctccgccattgccttatacagggtcgcctctggaacatcgcacagggatgcgacgtaaaaactaccactagctaggagtgaagtataagcagttgaaccaatgccagtgcgcgaaagtaaattacatcgcgcacgcaagtatccccgtactaggtccatttggcgtgtggggcggattcttacagcaactaacactaggcattaagcagtaaacaatcgaggtagaagcacggcgatcaacgccctactactagaactagagcccaaaccagtttcatacagtatagtcgaaatccacccacgagcatctaggggagagaggaacatgag

SEQ ID NO: 682611 - DNA, 485 bp, Homo sapiens
agccttaccttactgccaaaatatgccgtgtcccagctacaggaggagcgggcctcacccttctgatttaagggctgcggggaaggggtcctgcccgggcagccttctcatccactccgtgaggacttccccgccacgagggccaggtggcgcggccttggcagtggacagattaacaggactcccccgccacgagggccaggcagcgtggccttggcagtggacggattaaagggctccccagcccgcgtgggttatggggctttttctatgcccgtcgatctggcagcgaacgccaggtgcccgtagacccaccaaacccccctgcagttggtttgtaccccagctccttttgccttgtagcagatcaccccataatttagtggcttaaagtgactgtttcattttgttcacaatcttgtgggtcaggaactcgggaaggcggatgctgtcctgtgtggcggcccccatcacaaggctcacag

SEQ ID NO: 682612 - DNA, 528 bp, Homo sapiens
  misc_feature (472)..(472): n is a, c, g, or t
  misc_feature (478)..(478): n is a, c, g, or t
  misc_feature (492)..(492): n is a, c, g, or t
agcgcttgatgcaagctcaagttggtccacctgacggcggcacccgtcagtgtggagcagatctcgctgcaaggttttggtctgccttttaccaataccttgagccattcgcctgcgtcgtatgacttgcgtaccaaatacgctcacgtattcgattctgctggcttctatcaaaatagtgttcgcgaaacaatcctggcggtcagggcatacgcgcagtctgagtcccgcacgattaaacctgaaacagggttgaaggcatgaggttggctatatccaacattgcgtgggacatatgcgaggatgaggccgtcgctgccttgctttcagcagttctcggtggatgcggttagatattgcccctggaaagtattttcctgaacttaccaaagcgacaggggaagatatcgctcaagtccaagcttggttgggctgagcgaggagtcgaaatcaccggtatgcagccgctgtngtttgntacgaaggggctgnatatctttggtagtgctcggaggaagttattggcat

SEQ ID NO: 682613 - DNA, 801 bp, Homo sapiens
tccccagacgcccctcattgaggtggccgcccttctaaataaagcgtgggggccgccccccctctctttccagaagatgtctcgaacaacatttgttgtccaaagccccccctctctctggcgacaatataattcaagtatgcctcaatatatggcggaccccgcccccccccccaacctctgtcctaaattagcgcctttcgggtcgcctcaacaagagactgtttccctacccagataaataatggtcgtgaggatagatatagttacagagccgcacgcgcgatcaagtcttatacgtgatatgagtaaaccccacattacggacctccctctctttgctggttctgaaactttacaacacacaaagaggatattctcttttcggggcgggccccgcacactattctcacagagagcccccggcggttattatccccccccgcccgacactgtgtgcggcgttcttcatatggtgaaccctctttactgagtgactcttatagaagagcaaagaaaatcttcaggtgtttatgtcaaacacccgccgtataccacgatgtcctgtgctacacgagagtatatgtttctcgaagcacccaagaacctcgcccatgaacgatcccataatcaatacgtgcgcacaattttgtcatctccttcttatcgacccgcgcgaggattctttgttctctacttcgttgtcacgcggatatgttgtaagaaaaaacagttttacgccgtggcgccccggcaagcttctcgaaaaacaagaccttactaagggccccccacaaaaca

SEQ ID NO: 682614 - DNA, 256 bp, Homo sapiens
ggggttctggctctaccctattattcggcgcattacactgatagtataggtcatcagttctaagcacatacttttttcagtcgatctggggcaaccatgccatcttctatgtgatgatcacctctacaagcgtttctcgtcacagccccactgcggtttcgtaataatcttgcttcatagtaatacctcatcatacttttgtcaattgtccctggattattagtgagcttgagccccttttcctatagttctttgt

SEQ ID NO: 682615 - DNA, 100 bp, Homo sapiens
acaccccgaccacacactactaaagtagcctagctcaaaaattgtatacacttcttaccgttcattacctagtgtaccagaactgcatacccacgagcta

SEQ ID NO: 682616 - DNA, 406 bp, Homo sapiens
gtattgagttagacgagcaggacgcgctaccctggtcggaggagaatggaacccgataaccctagctgggtatggctggtcaggctcgggtctgtcaccctgagtgcacgcaagcttcctatctcctctggtccttactttttacagtgtttgaaagggaggaggccagaggccccgtcaaggccccgtccaggatggggggctacacccactagggttacgcatgtctgatggcaccaacctatgaagcggtctttccagagaagtggaaaacacaaacaggatcatgaagaagatgtcacgacaccactaacgcaaacctgaaaactcgcgtgaactaaacaatgaatgctggccgggtgcggtggctcatgcctgcaatcccagcactttggaaaacatggaa

SEQ ID NO: 682617 - DNA, 939 bp, Homo sapiens
  misc_feature (939)..(939): n is a, c, g, or t
gtgtgacgcgagcgcggcgctcccgatgcgctcgtgccgccccgccgtgctcctcggagccgttgctcggccggtttggtaggcccgggccgccgcaggttccgctggagcccgcacccgccattgacaactacgcagatctttcggataccgagctggaccaccttgcttgcgcggggtacaacatcccgcaacggccttggtgttaggatcacctcgtaggcttacgagaagaaagattcttcgagtacgaagacccagaagggcgggcgggttctcgccccccccagtttcgtcgcgggccctcctcttaataagcttcttcttgactggaatgcgaacttagagcgggatgccagcatattgtatgattcttctttcatttaaccactttcatgcaggctgaagaaggcaaccccctttctagaagcgaagccaatggaggggtctgggctccagagctcaggtcttcggggaaaggtccctgctgacttgcctcaaccagttgcgggttgcggcgtgcgcggccaggggcaggggctcatggtgtatggctgggggggcgctgggcttagcccagaagtagtgttgttcccctgctttgtcccaaccaggagggcagagactcagggcctccatggtcttctggtcattttgtggaaatgcatcctcctttgtcatctgttgggggggggggatcaccaaggcacctgattgttttgggaccacaataaaggccgttttttggaaaaacaaaacaaaaaaaaaatgtgtgggcggcgcgaaagtttaaacactgttggggggccatggagacgtgtctgtccagagtgttaagtgggtccaaaaacggggagggctacacgtgtggtggttcagcattcatttcgcggggggaggatgggcggtgggaggaaacgtgctgtgtatctcttgtgn

SEQ ID NO: 682618 - DNA, 590 bp, Homo sapiens
tcgagatggccggttggcttagtgtcacttcttcctagagccatgggagttttctgtcagcatgtttttgagctgtccgtggtaacttggacgggaagcagtctggaggtgggtgccttccaaatctctgccacagaatctgaacttgcactttgcagcctgttagtcagagctgctaagtttgctctacctggtgtgcctcttggcaccacctgagagatgtatgtagagaggctgctaagaaatgagtgcccctggcatgaagacgtcatatcccagatgtttaacttctggctggaaaaaaaaataaaagagcaaacaaaacaaacaaaaacaccacacaaaagggagggaacttaatttggttcattatctactgcgtacctttcctgtgcggaggggaggaccagtgactttccataatgagctttctcctttaaaaaaacttcagactcttacttactcttttggttcacactaattagcattcattttccagagaaagctgcttgactttgaggaaacaaagacaggtgtccttaaaaatggactggaaatctggatcagtgtcaggtctgctttagggtcca

SEQ ID NO: 682619 - DNA, 571 bp, Homo sapiens
agcgggagagggcgagcgagcgcgggttcccgggccggcccggcccctcccttcacatcgccggcctccgccgccgcctccgttccaccatccgtctcaccccccccaagttgaggcccccatccgggggggggaaggcccgggaccgggaacccgtagcgaatcatcctaaactcccgtcgaactctcactctcgccgcggcccgagtgtgaggagaaagggcccggaccggactgagacgagtggaaggaggaaccacggagacggacccaacgggccggtgttggggagcacttggtccgggctccgaccgtggctgtgctgaaaggaacaccgggggatccccgggtagtaatgacaccgaggaccggcaaagaggcagaaaccaggcaacaggggcaagcgggggtcccagtggaaaccgggaagcacggagccagaacgtgcagatgcaaagaggcaactgggtacgacaccgagaaggcaccagggactgaaccagccacagacacgtcacgaaccagaacggaacacgagaatgggcccccaacaacagccagagactgcaac

SEQ ID NO: 682620 - DNA, 511 bp, Homo sapiens
gcaggcatcttggggacccctcctaggagagctgcagtctcttccctcaggggaacatcccagaaatgcatatccgactcagactctcagccagtgcttcgacaactctcgacacacccccacataaggtggactacattaatgattatagtgttatcttccccttgggcagtcacaatgcatgcgcgcctagtaggcaacgctagaagcgtggtgcctttcgagcttattgggacacaggtcatgcgccataagagtatctccatttctatacacctctgagcaccgtatctcatcggaagagcatgtgtacattcgcgcgaaggctaaggcccgcgtatgcatttggtcacgtatgaggatgggagaccctgaagcgttcgtggccacccataccgcgttccctgaccacaagctctaggagaaccctaaggccctcaaaggtccttagtacgcccaacgcacctttctgtgtgacctatcccaagaagagcaggatgcccaagatttg

SEQ ID NO: 682621 - DNA, 394 bp, Homo sapiens
ctcgacgtcgcctagaacgtcgtgctggctctggccgagaccgggtgacagcagacaggagactccaggacatgctgctgagcaatgctgggagctccgatattacatcagccactaaggctggctggactcagaaacccaagagaagaggacaggccaaggaggttgtcaaagcccaaatactggcgaatggctgaacctaaattcatgcaccagcatgtgactctatcccctgactaacgacgccataacgtatcactaaggctcagcttcaggactgataaccaccacgacgctaaggagccagtgcttgacactgatgtcgaaatggcgcgatggcgcatgaccgagactctgggaatcaaatacctcaggccctgcatcttcaggttgc

SEQ ID NO: 682622 - DNA, 578 bp, Homo sapiens
tttccatgatgatgatgatgggacctcaatgtattttttatttcagtcactcctggataaataacaaattggagaaataaaaatatctaaaataaaaaaaaaaaaaaaaaaaaaaaaaaaaaaaaaaaaaaaaaaaaaaaaaaaaaaaaaaaaaaaaaaagggggggggggaaaaaaaccccgggggggcatggcccgtttttggaaaagggggcccccataaaggaggaggcgctggaatataaataagacgaaagggacgcgggggcgggcggttaaaaacacaggtgcgtggtggggggggaacaaacggagcgccgccgtggggggacaactcgtgtgggaagagggacccccccactactactcgggggggggggggggccaatattgtggggccacaaactcatcctcgatcgaagatagtattttaaagccctcagggagggaaaaattaacaaattttctaagggtggtaatgatgggtggtggtaaccaacagcggcgttaatgtgacggcgggcgcggaggaagaagatgtttgctacataggaggatatatattttaggaaacaagt

SEQ ID NO: 682623 - DNA, 398 bp, Homo sapiens
ccatgaacaactaggtagaattcggcagggaatccaccgggtcctggaacaaaaaacggcaggcaggcgaacaatcatacgcctcgataacagagcctgtcatatggtctattcagagatacacgttcttccaggttaagtcttgggagggtgtatgtgtccaggaatttatccatttcttctagattttctggtttatttgcgtagaggtgtttacagtattctctgatggtagtttgtatttctgtgggatcggtggtgatatcccctttatcattttttattgcgtctatttgattcttctctcttttcttctttattagtcttgctagtggtctatcaattttgttgatcttttcaaaaaaccagctcctggattcattgatttttttgaaggg

SEQ ID NO: 682624 - DNA, 266 bp, Homo sapiens
gcgttcatgggactgagctagcacctagccgtgcggccgtccatccactcatccatccattcacacccccacccatacacacgcccactcatccatctatccacacatctatccactcacccatccatccacacatccatccatccatccatctgtccgtccatccatccatccagccacccatccactcacccacttatccatccacccatccatccacttacccacccatctatgcactcatccaccgattcatcgaacccgcg

SEQ ID NO: 682625 - DNA, 360 bp, Homo sapiens
  misc_feature (13)..(13): n is a, c, g, or t
  misc_feature (33)..(33): n is a, c, g, or t
atcagtggctgcnagctctaggtcccggatcangatttctctactctcggcagtttactagttaagtatcaactttccatgtttgtaactataataatgtagataatgataaactgaactttaaagaaaaccctatatatttcactttttccaccaccttctctttgaaagtagtaatgaccatggcaacataaatttatttttccctaactacgtgaatcatctgacctttgatttgtcaatctttgtgactcctattaatgtatagtccaccttatatttgtttaaattaagttatcaaattccaaataagccattggttttaaaactacaaagtattatctttttgctaccaaaaac

SEQ ID NO: 682626 - DNA, 827 bp, Homo sapiens
tggccattcaaagaacaagtaaatagcataagccaaggctatgatatatcaattagaaatacaaaacaagagaatggaatggaaggagacatggaagggaggggccctctgctgtcttcaagaaagctgccaacctgggggtattcaggataaattcacaggttacaacctgagaagtaaaaagaaaaagaaaaaaaacataaggaataaaaattcatcagagttctctggaaatttttaaaatacccttggagcattactgcctgagtagcagatagtggccaaacactgaatcattcgtctagatgcctgggttgtggagttttaccagaagagagtgagacagaggaggcaacagagattcagaaggaacaggaacatgctcacagatggaaagaaagaatgtttccccgaattgaggaaagtcgtgcattagagcagattcacacacaagagtctataagggacaaaacgcagattcacggaaaccaaattgccaagcaacttaagaatacattctacaatcacaacgaacttcaaaaggttaagaacactatccacaaatcttatatagcgtgacaccgaccaaaaaagagaattcctaagtcatggaacaagccttcttactggtgacaaattagctcaaatagccacatcacaccttcagcagacaaatgaacttccaagaatctgaaactccttcagagtctgtcaatacttatgccccagagaactattattcaaatcgaggatgcacaaaaccaattatcatgcatacgcaacctacgaaaatacaattaaaagacaaagggacctaagaacaatca

SEQ ID NO: 682627 - DNA, 281 bp, Homo sapiens
tgtcagccggtacttccaggcttgagtgcaggcgtgagccatcttgtccctaagcttcacttctagctgtgtgaatcttgctgacatcattaaattctctgggccttaatttactgatagggttcttgtaagtattaaccattagctactattgagaggtgaagaccgctgggcttctgggtcgggtggggacccggagaaccactctgtctagctaaaggactgtaaatgcaccaatcagcactctgcgtccagctaaaggcctgcaatcaagcctggaa

SEQ ID NO: 682628 - DNA, 808 bp, Homo sapiens
ggcttacctagtatcaactgcattgccccttcatactccggtgactactctagagcaaatctaggccaaaatcgatatcacttgtacgatctggcatcggacgttgatctggctgtctcccctcatatcaactatcgtagggtcgcttatccggacattgctccgctgcaggtgtcattgcaggaactatcggccggtaggccattactgacacgcagagtagacatacgattaccatcatacatcgttgtgtagcttgccatgccatattattcgtacacagaccacgtccatcattcaatgactttacatgcatgagtagcacagcctttcggtttacgcaaggacgacacctaagtacctgagattacgtaacgtagatggataggcactactccattagatagcccctggtgaggttgtacccttcgttcttgtgccattggcccgctcgcgcaaacgcgctaaaccctaaacaaccatttccggacaagaataaggtccccgtgagttaacaattcccttatagttcttcatgacccacaaataaagaggggggaacgaggacagcatctggataatggcgcacactccataagttgccttcggtgtatttgcaacgactgtcgctaagagcctcccttattggggcccataccaactctgaaacttatgttttacgacaagaggttgatacttaacgcgccattcaaaagagggaaatctttgtcccccaaatatacgaaccccattagataggacaccattagggcacaaatcgaaacgttgtgcccgtgagcactttcgc

SEQ ID NO: 682629 - DNA, 1311 bp, Homo sapiens
  misc_feature (208)..(208): n is a, c, g, or t
  misc_feature (974)..(974): n is a, c, g, or t
  misc_feature (1310)..(1310): n is a, c, g, or t
cgctgccgttgcgaagcgctgtccgggagtcctgtgctttgctgtgccggtcggcagcaagaagccgccctagcttaagtgcccggcgggctccaaggagtccatgagtgcattacgttgttgtggactcttggacgcaagagacgagggtgacatactggatgcctactttggtagacggttgtgagcccacagagctcagctattncggggggcagagtcacagcgagaccggtcttgtcacttaaatgcaccatcacttacagtctagtgtggataggctccaggctccagtgccgtaggtcgccattcacggtcctgatacgcctcagcgggctacatgtcccctcttgagacggccatgcagcgaggtagtttctggtccggaacgacttgtccattgtgacgtatccgatcgtgccctactagcatggttaccttccgggcgagcgtgtggggccggcagcatccagctgggttgacagcgggtctgccgtaaaaaggagtatcgcgcggtcggctcctttttattcattcctaccttgcgttctatctacgtttcccgagagttgccccttgcattctatgtgcgcacaacattatgaactcttaccgtaccaggggccgcggcgcttctcggaagatgtgctgacaccttcggtcatgcgatacgtgctcgaagtacattacgccagtaccgttcgatagaccgcggctgcctagggagagaagcgcatactttgcgtagcaacacgggatatcgtccgcgcacggtgcgcatcatgccctttggtgccaagctatcgtcgacgaaagttgtgccctagcgtagctgggggtgctatcggccgggtgggtattgcgcctattttcactacaagtcgagccgtccttaaggacctcccccccggtagcttactttggagtggctcgagcaagtgctgcacaagcgtggcatccgtgcctcctggctnactcggcgcgctcggggctcttgctgcgatccagcctgtgccctgttggtaacctgtgttgctcgctgggagtccccggagggccgtttggtttcccattgcgcctggggaacgaccttgcggggcttctggggtcgttcttgtgccccgctaatctcctgagtgggggatcgtctggcttatcccgcgagcgagcatctcagggccgatcgcggggtgtcgcaaacggtccggcttgctgcatgatgtgttcgccgacctagcaccgcacggcggcgtggccgcccgcttgtgggtgcaaccgcgcgagacgagtgtgctttatttgtgtgctgnc

SEQ ID NO: 682630 - DNA, 220 bp, Homo sapiens
aaggacttggaatgtgtggtgtatgtctgcgagttcgggaactagacatacaatgcgatatgtaggtcgcacatatatacggtgtcaaattaggtaatataactcacataagtgaactattaatgttacaagacttttcaaccccaaaagatgctagggagggtattacaaatgaaagtttgtgtatgtcgtgcacatacacgaccataacaccacacaa

SEQ ID NO: 682631 - DNA, 400 bp, Homo sapiens
  misc_feature (253)..(253): n is a, c, g, or t
  misc_feature (276)..(276): n is a, c, g, or t
aacgcccagctgaggatgatcttcccatgaaagccaaaggataaaccatcgaggggctggctcagttcctcaagcaatataaggaagccatacatgatatgaatttcagcaatgaggacatgataagagaatttgacaacatggctagggtggaggataaaaggagaaaaagcaaacagaaattgggggcgtttttgtggatgctaagaaatttacaggaccccttctattctaggggtccaagggaattcangggtggctgcagggccccacganagtacactatatacattttttttgtctcttgtggctcccaagcatatgtcaagccatgtgttttatacctaatcgtattaataggatttattttaatcctttcgataccctattgcgttgtttt

SEQ ID NO: 682632 - DNA, 260 bp, Homo sapiens
gcggaggcgaacatcggcgttcccgtgcgcccgttcccgcgctggatgcgctgcgtgaagtgcggcttgttgtctcctttcgataccggcctgttcgagatcaaggagcaccgtttccgtccggagcgcacccgcttcgtccacaagagctgtcgtggttccaagggcgaccagccggcgaaggaccccgatgcggttcccgcgcgtttcctgctggcctgccgaaacggccatctcgacgacttcccctggcactactt

SEQ ID NO: 682633 - DNA, 413 bp, Homo sapiens
ggacatgataaatcagccggtacccagcagcatagatattaccgacaggtgtagccaaaatctaccatcttaaacatttgtttgttttaaagacagggtcttgctctgtcactcaggctcgagtgcagtggtgtgattgtagctcattgtagccttgaactcctgggctcaagcaatctttctgactcagcctcccaagtagctgggactacagatgtgcaccaccacacctggccaatttttttagtttgtttttaatatagatcggggtcttgctgtgttgcccaggctggatctccaacccctggcctctagtgatcctcctgcctcagcttcccaaagtcctgggattataggcctcagccactgcacctggcccatcttaaacatttttaagtgtacaattcaattgt

SEQ ID NO: 682634 - DNA, 210 bp, Homo sapiens
tctgagtgtaacaggacggcgagtatagctgtttcggattgtaacaggagggcgagtgatagcggtttccggatgtgtaacaggagggcgagtagttaccggttgccggattgtaacacggccgccgagtattaccggccgcctgattttaaccggcggcggagtataaccggaggccgacgtcttcacgggccgcggagtataaccggc

SEQ ID NO: 682635 - DNA, 429 bp, Homo sapiens
tgataggagcaaaatggattagaaggagtcgactatggaatgcacagatagggtatagatgacctggaaaccatgccagatgacctatctgaccacgttggatgacacttgtgatctacatatgcccaccatagaccagagagactaatcaaacagcccccaccaaacggtgaaacccaataggaccatcatcccagcaaagtttacacaataacccgtaccagagttgcccccattcaccattcttacacacctcttccccatttccccagggagtcctgtccatccactccagaatcattcctattaattaagagctgaagcagatgacagtgaatatcactgaaggcagataggaagccagactacactgcatacgtagccatgatccctcagtgcataaaggaggaagacaccccttcagataat

SEQ ID NO: 682636 - DNA, 118 bp, Homo sapiens
gagtctgctcgtcactcctatatcccagatcctcagctaagaatggttctaaaggacccctgtccacagtggctccagccccatctactccctgtgtagaatggttctgcgctgacag

SEQ ID NO: 682637 - DNA, 999 bp, Homo sapiens
aatacctgtctgaggacagtcgatgcgcctgccggtgtgcgtgtcgcccgttctttagtctggagcgacgtcactgtctcacaggcagctctgtgttaaaaatgtgatagtaattgtagaatgactcggatgccatcacgatgagaaatgtgagctgctaacaatgggggtggcgtattaaatagagttagcctgggaagcgtgaatgtgattggtaatagttggctcttgtgacacaacatatgctcgttcgtaacaatgtttgccccctcggtggaggaatagcatatggatgcggtcgacatttataattcacctggatgtccactggagaacggtgcttcaccgggtaactctggggttacgtagacaccctttatactaatgactggtggcttctcagggaactccgggaagtaatccacttgggtcaaccgtaggcccgcaatgactttccccctcgtgacatctaacttaccccatttgaacctcgggagtgggcgtgtcatcacaaaggagggctatttctcaggatgacaacatttgctgagtgccagagaagttacgattatagacacaagtctattatgaacacgacggggacgaatacttaggccagaactccagatgtagctgattctacgcgcaacaacatatggttgggttgaacataacaaaaagatggcggaatgcgagggacgtgcggccaactcatttggaatacctatttaatttgcaagggctattgggcgagacatgtgtgatcacctgtggacggcatccggttgctccgtggcaaagaaaggcactgcagttcaagtacgatatgagaactccgtaaacgacatccaaacagtactgggaaacaagacgcaagaccttaccgtacaacaaaccaggcgtaaaaggcagttaccggccagacgtaccggccaacgttgtccacacccagtgataccgcagggcatactatggctcaaagaaccaaaaacgcgttcc

SEQ ID NO: 682638 - DNA, 527 bp, Homo sapiens
  misc_feature (1)..(1): n is a, c, g, or t
  misc_feature (44)..(45): n is a, c, g, or t
  misc_feature (123)..(123): n is a, c, g, or t
  misc_feature (128)..(129): n is a, c, g, or t
ngtgactgaatcagcagtgctgccctagtcatagctgtgctcannaaactcagcatgattagtgtgggagcaaacaaggatagcaagcacatactgtttttgaaattctatctggtgcttaanctatnntgtaataattaaactttgatgttgagaaatcacaactttattgtacacttcattgcaacttgaaattcatggtcttaaagtgagatttgaatttctattgagcgcctttaaaaaaagtaataccaaaccataaagttaaaatctatgtatattgagtcatatctaaaaccacgtataaacataaattgtatttcctgttttaattccaggcgaagtactgtttgggaaagctattattaggtaaatgttgtacacaattactgtttctcactttcagtcataccctaatgatcccagcaagataatgtcctgtcttctaagatgtgcatcaagcctggtacatactgaaaaccctataaggtcctggataatattagttcgattatacttgaagaaca

SEQ ID NO: 682639 - DNA, 636 bp, Homo sapiens
aacgttttttcttcttttgtttcccaaggccggcataattacaaagggcgtgcaatgaaaacacaggggccaccatcccccgccaacaggcggggtccaattacttggcccttgcctccttggaaaaagacccccccccccctaatggcccaatcccccaacccaaaaaaaagggccctctcccaaaaaaaaaaaaaaaagcccccccacattcacaaattttggactaacaaggaaaaccgggctacacccccaaaaaatgttgccctatacaccgggaccaaaccattaaaatctttgccccagaaaaaaaacaaaaaccccccccaaatttcccaccggggaaaccccgggaaaacccttcccccggggtcaccccccaaacccctcccaccttgtcttggccttatccccccccccccccagttaaaacccaaactccctctggatttcccacccggcccccaaagagtatagccttaaacaagggaataccccaatcctacgggaacaattttttccccgtaaaacccccaccctaaaaatggggcgggaaaataaaagttaaaccctccgtgcgccaaccgagaccctacccacataaatgggcgcgccccccccccccgcaaacaaacg

SEQ ID NO: 682640 - DNA, 387 bp, Homo sapiens
aatctttaaaaaaatcttttgctcttttcctgaacggaaataaaattcccatatctttttctttgcccgaaggttaatgacttatatttaaaaaatgaggtggaatttattccccccggttgctcccccttgatgaaggaagcaaaatttaatggaaccaaaaccttttggctaaaattttccctctcttctttaaccttttttttagggcccaggccccaaaccatgtttgccccagttgaatttgatgatgaggaagccaagaatgagcccgaatgggaaaaacgtaaaattttaaaaatttccttttaaagccgtttgcatgagtgggagggggatggggcagggttggggtttttttttatgctcatgaaattaaaaattcct

SEQ ID NO: 682641 - DNA, 119 bp, Homo sapiens
acgtcactattcatcggcacctcgctattcatcggcacctcgctaattcatcggcacatcgctattcatcggcaccagacttgccctccaatggatactcgttaaacggatttaacagt

SEQ ID NO: 682642 - DNA, 813 bp, Homo sapiens
gggaggatcaggcatcccagggttataaatggggacaagtgctgtcattccatagctgaaacaggacgaagacccgcggaggagagaatatacttcgcagcgctaacggagcgaacactaaagaaaccaaagaccgcaaagccccggtcatccatcacaaaggcaacctgggagagtaactattttggggtgcccttaacaactgtcgtgactccagagaagccgatccccatttgtattgaaagatgtattgagtacattgaagccacaggactgagcacggacacggcatctaccgggtcagcgggaacaagtctagagatggatgagtctgcagagacagtttgatcaagagccacaatcctggacctggcagagaaagactttacggtgaataccgtggctggtgccgatgaagagcttgtagcgtcagaactagcctgagcgccctgggtcccgatataagcatgcagatcgacttggtggaagcacacaaaatcaaacgaacgggagcagaagttgcatgccctctaaggaggtatcaggagaagattgccaaaggaaaacccacgaagtcttcaagtatgtcatctctcacctaaaaccaggtcagccacaagaacaaggtgaatctcatggaccagacgagaaccatctccatctgcttctggcccacattgatgagacctgattgacagcagctaggacgacactcacagcacacgcgcaaactaccagacaatcagtgaaactctttgattccaggaagggccaccctacattccttctacaatcggaccatcaaccgagacc

SEQ ID NO: 682643 - DNA, 173 bp, Homo sapiens
gggcgagtcgaggtgactctaagatctactaagtgtgaacagatactccaccagccaaagcagtgtatgatagaaagcccctctcgagatctatgcatcttctggaaacacgaatattctaggcacatatactgaggtagtatgagcaaatgagagtcagccattgggggtac

SEQ ID NO: 682644 - DNA, 430 bp, Homo sapiens
  misc_feature (5)..(5): n is a, c, g, or t
  misc_feature (46)..(46): n is a, c, g, or t
  misc_feature (329)..(329): n is a, c, g, or t
  misc_feature (362)..(362): n is a, c, g, or t
  misc_feature (421)..(421): n is a, c, g, or t
gtggnaaatttgttaaacgggaattaaacaaatttcaacaacaggnaaaacagctatgaacatgaattacgaaatttaaatacgactcaactaatagggaaatttggccctcgaaggccaaagtggtcctcacggcgatcgtgatcggcttcgcaccaccggcttcgtgatcgagcttgccttgcgcagcggcatgacaaccggaccgaccatgtcgacggcacgacctggcatgccgagcgcgacgagcagcgcagggggcggggcatgatgagcttcgtcgaccatcttcccgtcctgcctgtgctgctgcccgcgctgaccgcgtngctgctgcttctgataggcgaccacggcgcggnatgcccacggcggccacgggcacctcaagttgttgtggggcgcgccgcaagctttattnccctttagt

SEQ ID NO: 682645 - DNA, 313 bp, Homo sapiens
  misc_feature (12)..(12): n is a, c, g, or t
  misc_feature (39)..(39): n is a, c, g, or t
  misc_feature (62)..(62): n is a, c, g, or t
  misc_feature (99)..(99): n is a, c, g, or t
  misc_feature (113)..(113): n is a, c, g, or t
  misc_feature (119)..(119): n is a, c, g, or t
  misc_feature (128)..(128): n is a, c, g, or t
  misc_feature (140)..(140): n is a, c, g, or t
  misc_feature (160)..(160): n is a, c, g, or t
  misc_feature (172)..(173): n is a, c, g, or t
  misc_feature (179)..(179): n is a, c, g, or t
  misc_feature (189)..(189): n is a, c, g, or t
  misc_feature (207)..(208): n is a, c, g, or t
  misc_feature (239)..(239): n is a, c, g, or t
  misc_feature (242)..(242): n is a, c, g, or t
  misc_feature (246)..(246): n is a, c, g, or t
  misc_feature (261)..(261): n is a, c, g, or t
  misc_feature (274)..(274): n is a, c, g, or t
  misc_feature (276)..(276): n is a, c, g, or t
tttggccgcttngtcaaggacatgaagatcaagtccccngaggagatctatctcttctcccngcccattacggaatcagagatcattgatttcttcccnggggcctctctcanggatgnggttttgangattatgccagngcagaagcagacccgtgccngccagcgcaccnngttcanggcatttgtngctatcggggactacaanngccacgtcggtctgggtgttaagtgctccanggnggtngccaccggcatccgnggggccatcatancnggccaagctctccatcgtccccgtgcgagaggctact

SEQ ID NO: 682646 - DNA, 258 bp, Homo sapiens
ttgcgcctcaggcttgaccgctacttccgcagcgttcgcgctccttccgctgctgcttcttggtcttcagtgttctcctcgggcttgtatgagccggctggcggcttggaacgtgtctatcttaggcctgcaggtccaggggcttgtacttcttgcccttgtagaatttcctgaggtattctttctgagtctggttaataactgtgagaacacgggcaattggttttccgggaagaggtccgggatcttaagaagagc

SEQ ID NO: 682647 - DNA, 93 bp, Homo sapiens
ccctttatatgtgatgattgctgcaaatatgctgattgttctatgctcactccatgcctgtgctccatgtgtgacatgagcaacacccttctc

SEQ ID NO: 682648 - DNA, 1036 bp, Homo sapiens
  misc_feature (617)..(618): n is a, c, g, or t
  misc_feature (631)..(631): n is a, c, g, or t
  misc_feature (633)..(633): n is a, c, g, or t
  misc_feature (659)..(659): n is a, c, g, or t
  misc_feature (663)..(664): n is a, c, g, or t
  misc_feature (705)..(705): n is a, c, g, or t
  misc_feature (724)..(724): n is a, c, g, or t
  misc_feature (727)..(727): n is a, c, g, or t
ccgggaaacgtgtgacctgcataccatagcttctgccaattccccagctctacccggccccaacatatgtggtaatgcccatggatacaggactagatttgcttaagacgtgcgtcctaacaagacctgtcgtagaccaaccgctgtgaaccgcgtcgggcccggttggtcgattcttctgggtgccaccgataacattgttccacagctcggttattgcaccgtgattgtacattggctgtcggacattcctgcagcctcaaaggagatgatctagccccggatcagctggtaccttccgtcacattatcacctcgatactcagggagaccttgcagacgtcttcgagtaggtgccgccaaggcccccgtgattagtctgccgtacatgggggcctgcagtggccagaggtttggaccttagtcactcgcctgtgacatccggtactgtgcccaggatgctttcttccaggtgaagcgagctagtacgatcgggtttggctgcccgatgtaggaacactgcagcgcctgcccaaggtcatcgggtacccagagcctcgtcaacgaagcttggccttcaccgcccgacaagatcgatggctgacgaggcctggcagnngggctggtcagcngngtgttcccagacaaagaggtcatgtnggannctgccttagcgctggcggccgagatttccagcaagagcccngtggcggtgcagagcacanagntcaacctgctgtattcccgcgaccattcggtggccgagagcctcaactacgtggcgtcctggaacatgagcatgctgcagacccaagacctcgtgaagtcggtccaggccacgactgagaaacaaggaactgaaaaccgtcaccttctccatagctctgagagccctgcgcgtcccaggccaccagcaaggggcccggccttgtcccgcgctcatccacagaaagggaggatgggcgatgacagttgtgttctaatgccttctgacccagtttcccagtttataaaacttaccgaggatgagtttctca

SEQ ID NO: 682649 - DNA, 923 bp, Homo sapiens
  misc_feature (617)..(618): n is a, c, g, or t
  misc_feature (631)..(631): n is a, c, g, or t
  misc_feature (633)..(633): n is a, c, g, or t
  misc_feature (659)..(659): n is a, c, g, or t
  misc_feature (663)..(664): n is a, c, g, or t
  misc_feature (705)..(705): n is a, c, g, or t
  misc_feature (724)..(724): n is a, c, g, or t
  misc_feature (727)..(727): n is a, c, g, or t
ccgggaaacgtgtgacctgcataccatagcttctgccaattccccagctctacccggccccaacatatgtggtaatgcccatggatacaggactagatttgcttaagacgtgcgtcctaacaagacctgtcgtagaccaaccgctgtgaaccgcgtcgggcccggttggtcgattcttctgggtgccaccgataacattgttccacagctcggttattgcaccgtgattgtacattggctgtcggacattcctgcagcctcaaaggagatgatctagccccggatcagctggtaccttccgtcacattatcacctcgatactcagggagaccttgcagacgtcttcgagtaggtgccgccaaggcccccgtgattagtctgccgtacatgggggcctgcagtggccagaggtttggaccttagtcactcgcctgtgacatccggtactgtgcccaggatgctttcttccaggtgaagcgagctagtacgatcgggtttggctgcccgatgtaggaacactgcagcgcctgcccaaggtcatcgggtacccagagcctcgtcaacgaagcttggccttcaccgcccgacaagatcgatggctgacgaggcctggcagnngggctggtcagcngngtgttcccagacaaagaggtcatgtnggannctgccttagcgctggcggccgagatttccagcaagagcccngtggcggtgcagagcacanagntcaacctgctgtattcccgcgaccattcggtggccgagagcctcaactacgtggcgtcctggaacatgagcatgctgcagacccaagacctcgtgaagtcggtccaggccacgactgagaaacaaggcacgtgggaccgtcaccgttcatcacagcatatactgtccccgggtggaaggcgcagggtcagaaagct

SEQ ID NO: 682650 - DNA, 82 bp, Homo sapiens
aagacagcagcatatatctctgcagcgtcgtcgaggggggcgggagacccagtacttcgggccaggcacgcggctcctggtg

SEQ ID NO: 682651 - DNA, 206 bp, Homo sapiens
cctgggatatacaaatgagaatgaagatttgaactttatactctagcagtggggaaacattggaacaggagcaagacaggtacgcaaagaggaaggactggaggggttagcgcacaaccacctactatgggtggaaggaggatcatatatcagataaggagctgcctaactcagcaaatgacctccatccatgtgaaatcactgac

SEQ ID NO: 682652 - DNA, 440 bp, Homo sapiens
tgtctcatatgcgtagtaatgtatctataccaacaagcgctgcacagtgtcttatcaaactcctcgtgtactaaggctcgtgcgtgatcatgtatgtccattaagcagtatgcactggcagttctacagccagcagtacagtccctcactagctcttcccatgatgattatgtcacagcgatatcattgctcttcatccatcagctttcacgatgatctgacatacatgcccagtagtgcacagcatgtagcttggccatagtgaacttctacggcatgtagctcgataaggaagtcgcatcatagatttgtcagaccacattgattccattgttcgatggaatcggcatatgctttcctgcaaatctctggggtcatcatctaggcatgtcctccagcgacgtatacaactttccagctctggcagttcatcctccgtt

SEQ ID NO: 682653 - DNA, 914 bp, Homo sapiens
tccctaccgctcgcattgcagggagatggctcagcgacattcttctgaggaggttcctggcctctgtcatctccaggaagccctctcagggatcagatggccaccccatcactatccagcagcccatgcagacccccacaactgcagctccctgcgctggccctgaacctgctacacaccgcaagccccagccaccgggcacacctactacacccaccgcacggaactctacccttgcacacacccatctcaccctactcccacggcactggcacccctgcaccctctccacagccacccgaccgctggctccaaccagcctgcaagcaccaccccagccgcgcctccgcctgcgcacctcacatcccaccggcccacccagcctgcgactggctgggaacccacctgccccacgaactcacctgcgcgcgccaccggacgcggatctcacgccagccacacgccactgcgcctcgcgccccaacagaaccctgacccaccgggcccacacacgcgctggcgcctggcacctgggccccccccacgcggcccgccgccacttacctgcggcactcggcacccccaaccaacccagcaaccccaatccggcccccaacctctgcacacgctaactggcaacgaggctggcccccaccgcccgacgcacacgagaccccccacaacaccacatgggccctggggccccctgcggcgccgccccccaaccccgcgccaccacaaccgcacacacaccctcgggccccacggacggcacccccccgccaccggccgccccccggggccgccaccacccacacaaacccgcacgcaaccaccccgccgccaccacgccgcgccaccgcaccacacccagccttccacaccacaccgcgggcgctcaccacaccatggcc

SEQ ID NO: 682654 - DNA, 141 bp, Homo sapiens
  misc_feature (81)..(81): n is a, c, g, or t
tcactctagaggatctacgactagccgacaggcatctgggaggacgaggaagaagactatgaggaaagagctgaccgacanacggaaccggggccggaataagtgccgctactgcgctagagggtggcggggtccaaggtt

SEQ ID NO: 682655 - DNA, 352 bp, Homo sapiens
aacagtaggtgaatgggaggattgcttgagcctgggaggctgcagtgagccatgattatgccgctgcacttcagcctgggcaacagggtgagaccctgtctcacaaaaaaaaaaacaaaaacaaaacattcatgtgcaggtgtttatgtggacataagtgtttgagtaaatatcaaggaattgggtcatatggtaagagtatatttacttttgtaagaatctgccaaactgttttccaaagtggctgtaccattttgcattcccaccagcagtgaaggagagttcctgttgcttcacatccttgacatcacaactggtgttgtcagtgtttggtcttgtggccattcagcct

SEQ ID NO: 682656 - DNA, 402 bp, Homo sapiens
ttgtcgggccagtctcgacactcctgacgtcacgtgatcttcccgcctcgtctcctgttatccagtgatcttcccgcctcggcctcccagagttgctgaggagttacagacgttaacccatgccttgcctggatttttgttttttaggaaggctttctactattggaattcctggcctttagaggatgttatctttctaaggaaaggatttttttgtttttcttcgaacctcctatgctgaagattcccttaataacaagtactgtccctcgtttcccagtgctggaatatagaacatggatagattactgttacttaccatgaaagacttctgaatccaggaagagaaaatgactgggtctcatgtttttcagagacagcgtcttgctctgttgcttatgc

SEQ ID NO: 682657 - DNA, 274 bp, Homo sapiens
gataagattggacctgatgaaacggtattatgcatgcaaaataaaaatgttgtacctgccctttccgttttgtcatgcttcttctcttctccactgtgtaactaaaatcctgagctttcctcacagctattttagttcatggatggctatctaatcatagatgtatgttctttagtccttctgtatatgtgtactggaggaatgcaaggattgaaactaacaacaggatctcctgctctgccgtatttctgacatcactataatttgtctgttt

SEQ ID NO: 682658 - DNA, 149 bp, Homo sapiens
ccctcctagtttgggtaagggctaggctggagtggtaaaaggctcagaaaaatcctgacgaagaatcaaacacttctgaggtaataaatagtattatccctgtatcgaacgcctttttggacaggttgtgtgttggtcacttgcttgct

SEQ ID NO: 682659 - DNA, 232 bp, Homo sapiens
cggcacgaggaacactagtgctgtgatgtaaaccatggacttcaggtgataatgatgtgtcatgtaggctcatcaatcatagcaaatgcaccactctggtggcgggatgttgataacgggggcagctgtacatgtgtgggcacaggacataaatgagaaatctctgtaccatccactcagttttgctgtgaacctaaaagtgctccagaaaaaaaataaagttttttttaga

SEQ ID NO: 682660 - DNA, 229 bp, Homo sapiens
  misc_feature (13)..(13): n is a, c, g, or t
agagccgaggganccagcgcggtgcctagcggaactccagggctggaatcccgagacacaagtgcatctgctagctgttagcacttggcagacggagttctcctctagggtagttctaactttgggtaataatgtttgtcagctacctgatattaacattgctccacgttcaaacagcagtgttagcaagacctgggggagaggtaagccaaataaaatatcttgtcag

SEQ ID NO: 682661 - DNA, 514 bp, Homo sapiens
actaattggttggccttcgggctggtgatgtcttcccaattaaagggggggccgggtgaggacacgggaacacatctgggtgggttctcttctataccggcactatcgggcacaaatagtgatgggatggagggatggatggatgaatgatgggatgattgagtaaatggattggaatggaatgagcaaatgaattaagtcctcataggattgattggatgattggatgatggggcaaatgatttaaatcctcacttcgggatggacagctcttccagggcagggtcctggtccccaggtcatctcagtagcctcccccaacggtagaggggtcactcaatggaatggggggtggaatgattaagtggcccagggtgggcccagggctcaccatggcagaaatcagaccaaaagagctagaaccacccaagagagcccttcaggggacctccaagataccacaggaggaagggtaccaccttcctctcgtgcagtaggcatggtgccagttgag

SEQ ID NO: 682662 - DNA, 253 bp, Homo sapiens
  misc_feature (10)..(10): n is a, c, g, or t
  misc_feature (167)..(167): n is a, c, g, or t
  misc_feature (213)..(213): n is a, c, g, or t
  misc_feature (240)..(240): n is a, c, g, or t
accccccacntggtgttcctgtgttccaggacaagcactttttcagaagcccgtggccctgctgaggagagacagcccacccccagcttgcaagagaggcagccagaggccaggtatttgttggccgctgatgaccagttccgcagtgaacagagggggccttgccnggattgattgtgtggcatggagcatggtttttcccccaagtgcaanacttgaaaattgggaggaataaatttntgtttttaatttg

SEQ ID NO: 682663 - DNA, 169 bp, Homo sapiens
gagctctcagaaaggcaaaatgtgccgatgcttgaatagtgaattgaagaactgtgagcgaacaacttgaatgtcactggaggctcaggctgaaaagtactctcagaacgtagacagagtatgaggaagagatcatggtcctttccgacaagctgaaggacgctgagac

SEQ ID NO: 682664 - DNA, 111 bp, Homo sapiens
ccctatatctctgaccatcttcccctagccttgtatcataaatgctgaagagtgacacagcagctcatgctcaccagttatgtttttcatgaaatgtcagtcatcattgtg

SEQ ID NO: 682665 - DNA, 784 bp, Homo sapiens
tccatgatttataaatgcttaatgggaattgcaaccgtaacaaggtaaaaaacaaaacccaagcatgtggcatttggccgaaaattatcttagcgttaaaaggaccatgagatggagtactcaaaccacggcccgacaagggtgacccgaggtcggcgagtgccaacaggttgcacattcaggtgtagtgcgcggtgggaggctctacacaagggtagagggacaagaagagacggggactccacaaaagaggggagaccccccacatgtgacaaaccatttggggagaccacccgagagagacagagacaaccaacaactggaagacgccacgcagcacatatagcgcaccgggacaggctacaaaacgaggccagcccgcggggcccagagaagtggtataagagagcgccccaagggggaacaaagctgtgaaaaacacctgtggagtacacagccaaagaggagccagtgagaccaggaacagtagtgcacccccgtgaaaaaacaccccacacaccgagcagaaaggggacacaaaaatataataaacaccaacgagcgagactagagacagatgagagggataggatcacagagaaaaacacaaaagtggggacacgagggcgaaaacaaaatcccggggagaagggagtgacaccaatcagcaaaagcaacgacataaagaggaagaacaccaacaacaacggggacccaacaaagtgaatagagagtattcccccaacacaaatggtggggtatcacaccaacactcatgaggcgc

SEQ ID NO: 682666 - DNA, 165 bp, Homo sapiens
tatctacgccgaggtttggtcgaggtcgtgccagccacggggtcacacgattaagccaagtcaagtagaagccggggtaacagagtgttttagatcaccccctccccaataaaggctaaaactcaccgtgagtcgtaaaaaactccagtggccgaagctggatca

SEQ ID NO: 682667 - DNA, 394 bp, Homo sapiens
atttttttacaagatacatggtaaaatgcatcccgattaaacgcagtggattacatgcagcatggctaaatggatcccgagtgaatgcagtagattccatgcagtgtcattgaatgcagtggattccatgcagcatggtaaaatgcgtcacgattgatgcagtggattccatgcattgtcattgaatgcagtggattccatgcagcaaggtaaaatgcatcccgattgatgcagtggattccatgcagtgtgaataaatgcagtggattccaggcagcatgataaaatgcatcccgattgatgcagtggattccatgcagcggggttaaatggatcccaattgaatgcagtggattcgatgcagcgtggcccaatggagtatcttgtaaaaaat

SEQ ID NO: 682668 - DNA, 377 bp, Homo sapiens
  misc_feature (358)..(358): n is a, c, g, or t
  misc_feature (369)..(369): n is a, c, g, or t
gacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaaggcgcacggccacccttcaggcatgagggaacacggaggcgttcatggaaggaaaggggggcttatttctcttgccaggattttcttgnaaagttttttncctttcca

SEQ ID NO: 682669 - DNA, 327 bp, Homo sapiens
aactagtgcgatccccgggctgcaggaattcggcacgagctcgatttcctgacctcgtgatctgcccacctcagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcgccactgcagtccgcagtccggcctgtgcaacagagcgagactccgtct

SEQ ID NO: 682670 - DNA, 667 bp, Homo sapiens
  misc_feature (3)..(3): n is a, c, g, or t
  misc_feature (35)..(35): n is a, c, g, or t
  misc_feature (69)..(69): n is a, c, g, or t
  misc_feature (100)..(100): n is a, c, g, or t
  misc_feature (103)..(103): n is a, c, g, or t
  misc_feature (107)..(107): n is a, c, g, or t
  misc_feature (119)..(119): n is a, c, g, or t
  misc_feature (132)..(132): n is a, c, g, or t
  misc_feature (226)..(227): n is a, c, g, or t
  misc_feature (233)..(233): n is a, c, g, or t
  misc_feature (235)..(235): n is a, c, g, or t
  misc_feature (237)..(237): n is a, c, g, or t
  misc_feature (251)..(251): n is a, c, g, or t
  misc_feature (253)..(258): n is a, c, g, or t
  misc_feature (268)..(268): n is a, c, g, or t
  misc_feature (272)..(274): n is a, c, g, or t
  misc_feature (281)..(281): n is a, c, g, or t
  misc_feature (283)..(283): n is a, c, g, or t
  misc_feature (302)..(302): n is a, c, g, or t
  misc_feature (310)..(310): n is a, c, g, or t
  misc_feature (321)..(321): n is a, c, g, or t
  misc_feature (327)..(327): n is a, c, g, or t
  misc_feature (339)..(339): n is a, c, g, or t
  misc_feature (341)..(341): n is a, c, g, or t
  misc_feature (346)..(346): n is a, c, g, or t
  misc_feature (349)..(349): n is a, c, g, or t
  misc_feature (352)..(352): n is a, c, g, or t
  misc_feature (360)..(360): n is a, c, g, or t
  misc_feature (362)..(362): n is a, c, g, or t
  misc_feature (380)..(380): n is a, c, g, or t
  misc_feature (386)..(387): n is a, c, g, or t
  misc_feature (394)..(394): n is a, c, g, or t
  misc_feature (400)..(400): n is a, c, g, or t
  misc_feature (406)..(406): n is a, c, g, or t
  misc_feature (408)..(408): n is a, c, g, or t
  misc_feature (439)..(439): n is a, c, g, or t
  misc_feature (446)..(446): n is a, c, g, or t
  misc_feature (453)..(454): n is a, c, g, or t
  misc_feature (458)..(458): n is a, c, g, or t
  misc_feature (466)..(467): n is a, c, g, or t
  misc_feature (476)..(476): n is a, c, g, or t
  misc_feature (484)..(484): n is a, c, g, or t
  misc_feature (493)..(495): n is a, c, g, or t
  misc_feature (497)..(497): n is a, c, g, or t
  misc_feature (504)..(504): n is a, c, g, or t
  misc_feature (507)..(507): n is a, c, g, or t
  misc_feature (514)..(514): n is a, c, g, or t
  misc_feature (520)..(520): n is a, c, g, or t
  misc_feature (537)..(540): n is a, c, g, or t
  misc_feature (543)..(543): n is a, c, g, or t
  misc_feature (548)..(548): n is a, c, g, or t
  misc_feature (554)..(555): n is a, c, g, or t
  misc_feature (558)..(558): n is a, c, g, or t
  misc_feature (564)..(564): n is a, c, g, or t
  misc_feature (572)..(572): n is a, c, g, or t
  misc_feature (589)..(589): n is a, c, g, or t
  misc_feature (603)..(603): n is a, c, g, or t
  misc_feature (661)..(661): n is a, c, g, or t
tgntaatgttgtatcagtgcatattctatggaaanttcatatctcaagtaactagcctagaaatcaganacagcactatgtcaagctagtatacaaggtnaangacncaatgctgccantgcaattagtatntagaaataatacgcagctgttagaaaaagtctgtggccaagtggataaaacagtagcagtgcactgcactgacatccagaacagaaaatagggnnggaccngngnatgcacttcctgcnannnnnngtccggtggntccnnngcacaangngttcccaactgtctcaccngctctctnactcatgtgtncctgcnccttcctcttgnantctgnacnttntaataccncncgccactttccgcctccngtgggnnggctccngccacncgccgntntttcgtcctgcttcccgtcatctcatatctnaaggtcntggcttnngttnggcaatannacctgtggntttgggcntctttggtnnngnggctggncanatcccanattttnttcccattttcttgtgnnnntanacttncataanncancagacnctgttcangattactgagttttggntgatggcgaaatantttttatgtaagtatactgaataaacatacaaacaaatatccttaacaaaatactgtncgacca

SEQ ID NO: 682671 - DNA, 157 bp, Homo sapiens
  misc_feature (10)..(10): n is a, c, g, or t
  misc_feature (14)..(14): n is a, c, g, or t
  misc_feature (118)..(118): n is a, c, g, or t
tgagataatncagncgggagaagggagggaaaaaatttttttccatgtgaaaaactgcccccccccccccccccagcaggagagcagcaaaatttatgcaaatctttgacggggtttnccttgtcctgccaggattaaaagccatgagtttcttgtc

SEQ ID NO: 682672 - DNA, 157 bp, Homo sapiens
acagggtactatcgaactgtagtggtaccggtgggccggcatccatatagtcactccagcgtttatgcgacgggttctactactattaggacttttcgcttcgaagcgaaggcttctcaaatcatgaaaattattaatattactagctgttagccga

SEQ ID NO: 682673 - DNA, 674 bp, Homo sapiens
  misc_feature (674)..(674): n is a, c, g, or t
tgcataagcaaagcagacttatgcactgaggcactcaaactgcggctcaacctggtggggggcatgtatgacacggtgcagcgcagcacccagcagaccacggagtgggccatgctcctcctggagatcatcatcgagcggcactgtcgacatgcagtcgcgaacaatgagctcttcactgactgtgtgggaacatgctgagcagtgctcatcaatgggcacattggctgcaagtacatgtctagcgatctcgcaaggtagcatgtgaggacaaccaagcgtgcatacttgaaccgtggcgaagcaacttgcagaaggagctcggcgggagcggccagtcagacagtctggcaaaaggttcgccagtgttgcgtgccacatgaccaagcagaacctgagatgtcatcaacgttgtgaggccacagggcatcccgttatcgataccaaggccaactagaagattgctggcttcgaatctccatctttcaacgacggacgggctctacaggtttccaccaaacagaagatctcgtcccttggcgatctttactgaggggcttgacagccgtcagcaccacttctcttggagctggtttggaaacagtccgagatggaccggcgcagtggctcgagcaagagggagcagcacgcaggtcgctgctctacgcactacn

SEQ ID NO: 682674 - DNA, 440 bp, Homo sapiens
ccgacaccctggggcatcacggtcctggtagggtagatctcagaacgcgacagatcaccagatcggacaagggggtgcaacagcgtcagagcacaatacaagtgttgatgggtggtgtacaactcgtggcgaagagctcggttagctctatccagcccatcagcatgcagaaccaggttctgatggtagaagggctctcaggtgacagtggagtaggcagtagtgtagtacccctccgcaccaacatcggatgtgatagcaatgtgcctgaaaggggaggtatccaactcccaatactctccacgaagacgtgtcagagcagcataagcagcatcgtggactgccatgtcgatagtcactccaacaccatgagcagtgtgcaacacggtagtggagtcatactcccgagagtagaggtggaccatggcccggtgtcgacg

SEQ ID NO: 682675 - DNA, 586 bp, Homo sapiens
  misc_feature (71)..(71): n is a, c, g, or t
  misc_feature (423)..(423): n is a, c, g, or t
  misc_feature (447)..(447): n is a, c, g, or t
  misc_feature (491)..(491): n is a, c, g, or t
  misc_feature (522)..(522): n is a, c, g, or t
  misc_feature (525)..(525): n is a, c, g, or t
  misc_feature (547)..(547): n is a, c, g, or t
gggaagggccctggcatgaggtgatagggagtggtggggcccgttgcaagctggagggcacaccccaactntgaagcggctcctgctttgctccagcgggctgggccacgtggcgtgcaggcccagagctggacatcacccaggttcccaaaagaagccagaaggcaggaatttacctgctggtttaagatactgtcaacagattcaaatattttgaaatatgtgattcaaaacccatctactggccaaatctggcccatgggcccagtttgtggcatctgtttcaggaagagacaagacctagtttgtgttttttttagtgggggcggggaggatgcggtgtataagaaattttgagtgaattaaaaaaaatttatgaaaaatttcaagggctgggtgcagtgtctcacgttcgtaatccanctctttgggaggttgaagcggganaattggtttaggccaggagtttcagaccagcctgggcaacatancgagacccctacaaaaataaatttctccctntanaaaattttttttttaaaaattntacctttgagggggggccggtccccaattcccctttgtg

SEQ ID NO: 682676 - DNA, 374 bp, Homo sapiens
aataaacagatcccaactccagggtgacccggatgttgaattaacagacaaaacttttaaagcagtgattaatactttatctatgaggtaaaggcaaacccaattgaagtgaatgaaaatacaaaagttctcaccacaaaaataaaaactattaaaaaaatgcagatccaaattttagagacagaaaaacacaatatgtgaaatcaaaatttcactggatagactcaatagaagaatgaaaaaaaagtcagtgaacttgaatctattggatcaatataaatgatccactgtgaagaacaaagagaaaaaataagactgaaaaaaaaaatgaacagcatgtaaatgatgcatctgtgggacaatatcaaaaggtt

SEQ ID NO: 682677 - DNA, 214 bp, Homo sapiens
acccggctccactggtgctgtgtgaaaagactcagatggagggaaagtagatggagactggtaggagatactagagtattaggcagagatgacgtactaggactggatgctagtggtggagtggtgagccgtgatcagactcgatatattcctgaggtagagtccacaggattggctgatggactgcatgagggtgtgagaggagagtcaggat

SEQ ID NO: 682678 - DNA, 683 bp, Homo sapiens
  misc_feature (1)..(1): n is a, c, g, or t
  misc_feature (19)..(19): n is a, c, g, or t
  misc_feature (90)..(90): n is a, c, g, or t
  misc_feature (98)..(98): n is a, c, g, or t
  misc_feature (117)..(117): n is a, c, g, or t
  misc_feature (148)..(148): n is a, c, g, or t
ntttaaagtctttgaaaanttagtaagtggaaagcaaactccaacccacttgacttgtagtagctggctgagctgagaaatggccatagnaaatcaantgctgctcaaggttattantgcatttattctcctctgcatccaaaggctnttgaagggaattaattcaacatattgcatattgcctgtgacctgtgggcctgtccatgcagttgacaagacacgctgagctgagccagcctgcctgcaggtgtcttcattcagcaccatagaggctgcaggacctgcttcactctgggccctagggtccattagtcaatcctggcttccccatctgtttgccatctgtaagcgggctcaatttgatcacttttcctagtgtcttcaagatgcaaggatcattgcaaccagctgagaatgacatgaaagaaggagcactcacacctgtaatcccagcactttgggaggccgaggcgggtgcatcacgaggtcaggagattgagaccatcctggccaacatggtgaaaccccgtctctacttaaaatacaaaaattagctgggtattgtggtgtgcgcctgtagtcccagctactcaggaggctgaggcaggagaattgcttgaacctgggaggcggaggttgcagtgagcagagattgtgccactgcactccagcctgggtgacag

SEQ ID NO: 682679 - DNA, 243 bp, Homo sapiens
gcagcattggattcactggatagcagtgcaatcaagtgtctctctgatattggggactcgtaaatttctgattctcatggtggcagcagttagtggactgggtacacccaccacctctctcctagttgatgaatgactcagaggtgtcattcagttggatgaataatagaggtggagactactctcaccaccgagatgaaagaaaccatcatagcctttgcctgggaaccaaatggaagtaag

SEQ ID NO: 682680 - DNA, 1500 bp, Homo sapiens
  misc_feature (228)..(228): n is a, c, g, or t
  misc_feature (613)..(613): n is a, c, g, or t
attaaattcatgtagggtggcgaataagaagcttggatgaagtggatcttcttcaccctgacgtgttcgtctaccgacgtgtatctcagtgatacagtatacgatctatgcgattcgtggaaagcgtatcgtactaccaggaagattagtgaccactatgatatgtggaacatgtgaagtgtccactataattatccacactactcttggggcatgacttagattggnggcgtactgtaacctcacatgttgtctagagatcgagcaacacacacttatgatacactaaaccgaacaacatacctacctacctgactaactgactagtgtttccactggtgcacgcaatgtaactctcacacgtacgtacaattgcgctgcgcgcgcaatgcacctgtgatacagaaatatctgacagctgtccttatgtgtttttatcatgagcggacgaagggagggggtggacttgactatagggagaagacacaaactgatacgtttgttgttggccaggtctgaacaaagtttatatggccaatattgggcagtgacttcactaagccgtgtaggcagagaccacatacagggttgcattggtacaccaatcgaatgnactcataggcgctaagcacacatttacccatgcgtaaagtctgatttgatgggcttacccaaaaattgcggctttatatggaggattctctcgtacaaggaaattttactctctggaagataatctttcatgtaagttatggcacatggtccatattcatattctctatgaactcgcatgtagagtaatccatatctccctagtttcgactaccaggggtggcaagcaaggaatttgattcatatgcgctggatagtgtgaggcccctttactgctccgtgtggtacgaaggcagaaagcacgaatgtgctttaacctttagtggtgggggcacccacttgttggccttctggcgcaaaaaagagggtctgtcgaatggaatccttttaactggagccttcccagacgtccaaggtagttactaaaagggcgacccctgggctgtcccttttgggacttgggctttcccgacaggaaggaatatgccgcttcaaatcttaatttaacttggcagtgcacaattctacttccattaagtgtggataaggacctggggtgaataaatcgcatatgatagaaccctgaacgtatatcctggaataggggtcgggccatagggtctggacttgtaaaacacgttcggccatgaagccaccacatatatttctaaataaggatgagggggtaaaatatatgcccaaggcccacttgaacgagatatcccgaaaacaggcagaaacaccaaaaaaagcggttaaagaaggggactccgctgaaagtcacaccaaaaggcacatacagggggaaagacaaaaaaaaaagcacaagaacgaagcggaggccacgaagacaaagacaggtgacgaaagaacccgaagcacaggaaa

SEQ ID NO: 682681 - DNA, 94 bp, Homo sapiens
ccgcagggccaaacccaacttccgtgatgtgatctggctacagtttggagcccacatatttcaagccaaccccatggcctccatgactttttca

SEQ ID NO: 682682 - DNA, 704 bp, Homo sapiens
agccgtcgcgtacctaatggatgccgcgtggaagccggaagccagcacctcccgcatggcccctccggccagtccgggcccctctagatgagagctgcacccaggccagacaccagtcgctcagccaccagcagcggcacccccatctgcagttggcatcttctgctgcttgctgccccggcatgccaggtctgatggccctagatggcaaccacatgcagctggcgtggctgtgggcctctgcctgtggggcacacaattgggtcactgccattactggcgggcttcagtgagaggaagtaagagctgagcctgcgaggcctgacatcacttagccaggtagcctcagggaacccagccagcacagctagcagcagccttgccttctatgagatcaaacagtttctggagtgtgcccagaaccagggtgacatcaagctctgtgagggtttcactgaggctgctgaagacagtgccgacttgcaaacggattggcctaatcgaagaagttcaacctggacgacgatggaacaatcagctctcataacgtaagttaatttagtatactaatcagcaattgatagtgcagggtagtaagtgtaaccatcagttaaacctctcctgtcattcctagcttcttgcttcagaattgaaatggaagtgggggtgtcctactctgtgaatctggactgggcccatgttgt

SEQ ID NO: 682683 - DNA, 186 bp, Homo sapiens
  misc_feature (59)..(59): n is a, c, g, or t
  misc_feature (74)..(74): n is a, c, g, or t
  misc_feature (110)..(110): n is a, c, g, or t
  misc_feature (116)..(116): n is a, c, g, or t
atgtccgcgtctcgtcgcacagtgatacagcgggcgtagtattcagagctcaggctatngagctccatgaaggntgtgctcgcggatgtgtcccgttttatggagactcnggcctngtcgccaacgctatctcttccccaacgctatctcttcccaacgctatctcttccaacgctatctcttccc

SEQ ID NO: 682684 - DNA, 420 bp, Homo sapiens
aaatcagtgggcccacctcagcaagagctcttcagtgagagagatttcatgcaaatactccaggctctcaccttctctcaaaagagcaatgcgagagctagcatttctgctgagtacaatgtcagcaaacaacccagatcttgatgacttgccacaagaagtcccagtgcaccagtatcatgtgcttcccctccttcaggtcctcagtcccctatgttgaccatatgggtcccgatgcgctgatggcagagttctgagccaagttcagattagcctgaatgatgaaaaggggtcagcttcttctggttgattgttctttcatcaattgtgtctggcactgaccggttgatcattgtacaaaggacaatgccatctccaatagcattaaagagatcatccgtgtcaggattcattgggatg

SEQ ID NO: 682685 - DNA, 124 bp, Homo sapiens
ctaagatccgcagtggtgtggactggccgaggcggtctgtgtattgctgcgtctgctcacagcgctgtaggtgcgacatgctaggtcaggctttgggggtgaggctggcagattctccgtcact

SEQ ID NO: 682686 - DNA, 613 bp, Homo sapiens
  misc_feature (377)..(377): n is a, c, g, or t
  misc_feature (427)..(427): n is a, c, g, or t
aatgtttactaaagagacccagtcttgggaatgtcctaatatcccgatatcttgagaacaaagacattcctaattttgctttaaagataataatattgattcttgcaaaatatagtaattaagtttttttatcctgtatataaacaagcattatacctagggtggacgcattcctcctcttgctttcaggaatgccttactctgtctatggagtagctgtgctttcaccactttactttcttaataaacttgcttttgcttcattctgtggactcaccctgaattctttcttgcatgagatccaagaaccccctcttggtgtctggatcatgacacctttcctgtaacattctaaatattaatctcttgtcatgcangtagtttgcaaatattttctcccatgctgtgggttgtctctttactttgntgattgtttcctttactgtgtagaaactttttagcttgatggaatcccattgtccatcttttgctttagttgcctgtacttattaggtcttactcaatacatctttacggataccaatattctagatagtttccccatattttcttctaatatttcatagttccagactacatttaaatctaacct

SEQ ID NO: 682687 - DNA, 314 bp, Homo sapiens
cggcacgaggttggtgcacggctccgcggaatcccggagacattggggcaggtagcaaaacccttggagaagtatccagccccctccaaggaggaggaagttggagttgatggccactccgaagcgcccgagaaagcagcccaagttgggttattgtttcttaaactgttagggaaagttgagattgttaagaattccttggtcgcccttgcatggcagacggccttgcatcacttgccaggacccgtttatatttttcccatcacacacagcttggagcacccatggcccactccgagctgtgtgtgttggca

SEQ ID NO: 682688 - DNA, 241 bp, Homo sapiens
gttatcgtgaatagtctttgttatacatgaggtcactatggacttaccctaaagattatctgtacttctctcttccatcaggcacacatgcatacgtactcaccatacctcatctcttgaggttattcattgtagtctctgcataccattgttcatgcaatttcacacatcaataccaattcatggaaatagtaccaaaaaaaaaacaaaccacaaaaccaaacaacacaacaaaacacaa

SEQ ID NO: 682689 - DNA, 456 bp, Homo sapiens
  misc_feature (103)..(104): n is a, c, g, or t
  misc_feature (215)..(215): n is a, c, g, or t
  misc_feature (250)..(250): n is a, c, g, or t
tatccgttgtgcgatggcaatcccactttatggcacctgatcactaaagtcctactttcgtacctgcttccacccgtcggtgtcgcagtcaagctcccttctnnctttgactctttgaatggtttccgaccattctgagggaaccttcgagcgcctccgatactctttcggaggcgaccgcccagtcaaactccccgtctggcatgtcccccggncggataacggctgcaggttagaaatccagcaatanaggggtggtatcccaacggcgactctgcattaactggcgtccatgcttcttagtctcccacctatcctgtacgagtattaccgtatcgcagtaccaaactggagtaaagctccatggggtctttccgtcctgcgcgggtaaccagcatcttcactggtacttcaattatcaccgggtgcattgttgagacagcatatttaggatcc

SEQ ID NO: 682690 - DNA, 117 bp, Homo sapiens
gagaagtgaggtcctaggtggaggtagcagaggacggagccccacaacagagctagtcggtcacagcctcggcaacaccaaccctaacttggcaaagaccgccggggacatacataa

SEQ ID NO: 682691 - DNA, 1355 bp, Homo sapiens
  misc_feature (287)..(287): n is a, c, g, or t
  misc_feature (731)..(731): n is a, c, g, or t
  misc_feature (753)..(753): n is a, c, g, or t
  misc_feature (917)..(917): n is a, c, g, or t
  misc_feature (999)..(999): n is a, c, g, or t
gccgaggtccccgtgccagatatgcagtcggggcttcccatacattccacacccatctgcgccctctgttcgcctcttctccgggagccagtccgtgcctccgccgccgtcctaggtgctcagtcgctctccctccgacagaccggtgtccactatggcttgcgtgctcctcgctcctcctaccgtcaggcatgttcgtgctggtccgcgtggcgtcctcgagccggccgggctcctgccgcgaggcgactggttgactttacagttccacgcactgctaccatacnagcccctcgtggcgagtcgccgcgtgtcgccgctctcatttagcgatcacagtcttgccttcgtatccgctcctcagtctcctcggcgtgccgcgctcgttgctattgctctcggcgcttccatcgttgtcgcgcttgactggccgttgcttggaccgtcacgtcgcttgccccgggtgcgtttgctgggactcccccttgccaggggtagcttgcggtgtttgtgcagcgtttgccgtcgggcgttgcgccccgggacctggcaccatctgctacacctatccgttacgatttcccacggagagccattccccgaccacctcagaccgtccagaccatagggtgttgtgtcaaggccgttggccccagtcgccagtccttggcagagtgaaaacacctgccttaatcgtggccccaaacaacaatttgaggcactcagaaccnttgaaggggtgttgtcgggtcnttctcccccctttatgaggataggccacaatcctccaagtaaacactccaggaggcgaatcaccccttggctttgtgagccacgggttaaggcccctcctggggagtgacccaaagggcgcttgccgaaattgaggacggccaacgagaaacgcggcccgattncggattacggggcccgagcccgcgtataggctgtgggggaagcacctttccattaaccaggacaagcgcaacagtgcaacgnaattatgcccagatggggaaccgcccttttgacagcgcccaggtgtcaacacgggttttggggaccaccatgacgttaataaccccataggcaggaaccattagaaaggccccccggtcggattccgcaaggtgggttgaggaaatgttccgccccgaaccaagaaacaccgttgttgacccgaacgtgcacccattttcattgagccggccctttccgggggaggaagacaatttcggccagggcgaagcggcacgaactttgctttgtcagccacgtttaagcaacgagggaaagtgcgtccgccaaaataaaaggggtttccccttgagaaaacttttttttattccagcgac

SEQ ID NO: 682692 - DNA, 899 bp, Homo sapiens
  misc_feature (666)..(666): n is a, c, g, or t
agcgggggttaggcgctgagacggatttggcggtgagatcgctgtggccaggctgcagctgaatgggcctcgtgaaacccgggaaactgtatagcaaatcacacacagaaggatcttgcgcgcattccaggaacacgatcgagcgcggctactcgcatgcctccatgtaagtttgtcgggtaacgcccaagcgagccacgcgagggcgcgtggcagtgacatggcgcagcatgcaaaggctcgtcgtagagccttatggccgcgaggccgcgtgagcacagaacgctggtatgctgccggtgagatatataatcgagacgctgcgtcgtatggcagctcgatattacagaattagaaagtgggaggggaatacttatgggatgggggctaagcgtggtgatatgtaacgaagtgtaggagagtgcatacggatctagggagtaatattacggtagaggcgttgatatgagggaattggttgcttgggggaattactgccttaggaagaggtgccagcaaggggggtgcatgcttcaaaggaatgctgggggtgaaaatcctaaacatgggtagaatggcagcatgcaggacttggggttagggggtgtagagagattgtagggacatttccagtggcaagcagggaaagacagagaaggtaggcgntgaagcgaaacttgccagggcatataggagatccactttatgcaaagggaagataaactcttgggagagagtgggggacccgtggatacaagtgagatataggaaaaggggcgtaaacgcgtcccgggagaaataatgcgagatgagacgtgggcatacaaatagaataggtttttgaaacagatgggctctaggaacaagataaaattgtagtaagatggatggcaatggtg

SEQ ID NO: 682693 - DNA, 182 bp, Homo sapiens
ataaagggcatcatgtattctacagcatactacaaaattctaaaatatataatattatgccctagatattcatttcctatattattggaaacacctcagaatgcttttttatagctctcttaaataattatattatccccagatttttgaaaggttagatgtactttgatttccatgatggc

SEQ ID NO: 682694 - DNA, 863 bp, Homo sapiens
tggccctcaccctggcgaaggttggacacatacgagtacagcataggtccgggataagaagtaggggtttccctggcatccttcctgcccctagcaacctctcgatgctcgactcatcatgcaatcgcttgcacgatgccaaattcgcctcgtggattactttgagagaggggagccaatccagattggtgcgtgcaggtacgcgggtgtgctagaccacatccaatggtgctggactggacatcatgtgaggatggatgagcctcttccaaacgtgcgagcccttcaaccatccgtcatagaggcgccgatattctgactgcctagggtgagctcacgcacacaaatccgttgtcatccggtatgctgacctggcgacgatgggactcctgtgtactcgttgaggcgcacatagcgctcggcgtagcgtatatcttgccatgtacgccacagtcgtctggaacggagcactcgtccaactgataagcattgtcctaattactcctttctaaggtgcctggccaatagtggaacgccttgggcttgcccatatagggctcgaggtaggtgtgcccctgggcaaaagggaaggctgacgatttacacacgagaaaaggagtgcctgcgcgatgtggacttcgccttggcacacgtcctggcacggcagcacctttgcgtggctagcgttgctgtgcttcccttggttgtaactttgttgcgacaccgtgttctttgctttgtagttagcccggcgtagcttaccgcttactagtgtatgtgcttggggtcccagtaggccgggtacctgtttgcctttgtggcccttttcgtatccttgcttcctctttcaagtaggggggggg

SEQ ID NO: 682695 - DNA, 823 bp, Homo sapiens
ccatccttttccttatactaaaattaactcaagatggattaaatatttaaatgtaaaacccaaaactataaaatccctagaagaaaatcttggcaataccattcaggacataggcatgggcgaagatttcatgatgaaaacaccaaaagcaattgcaacaaaagcaaaaattgacaaatgggatctaattaaactaaagagcttctgcacagcaaaagaaactatcatcagagtgaacagacaacctacagaataggagaatatttttgcaatctatccaattgacaaaggtctaatattgagtctacgaggaacttaaacaaatttacaagaaaaaaaccaaccccattaaaaagtgggcaaggacatgaacagacactactcaaaagaagatgtttatgtggccaacaaacatgaaaaaaagctcaacagcactcatcattagagaaatgcaaatcaaaaccacaatgagataccatctcatgccagtcagaatagtgattattaaaaagtcaagaaacaacagaggctggcaaggttaaggagaaaaaggaacacttttacactgttggtggaaatgtaaactagttcaaccattgtggaagacagtgtggtgattcctcaaagatctagaacagaaataccatttgactcagcaatcccattagtgggtatatacaacccaaaatataaatcattctattataaagatacatgccatgttgtttcccacagcactattcacatagcaagactggatgaaccaatgccatcaatgatggatgcttacgaacagtgggtccctcctggaagttgccgtcgt

SEQ ID NO: 682696 - DNA, 377 bp, Homo sapiens
gatcgtttatatgactctataaccgcacctatccatgatgtgattacatgtgcggaatgtaatcaaagtacaggctcagaatagatactcattcaaatgtagtttgtgtcttagactaaaaatatcacagttaaaaatattcttattgaaaggccacttaatcttttaagtatgcaggacaatgatccagatcaaagcaccaagtacaatgaataacaacactaacagatattttcaaagcctattaaattttaaactcaagagatggaggatagaagacagcaaagatttaatatttgttaccaatatgccacaaatatagttctcagcccaataccaaatgagatgaacacagcaatactttgcatttctatgac

SEQ ID NO: 682697 - DNA, 295 bp, Homo sapiens
gatctttcttcagcttcttgggcaaacaggagctttcctgtggactcagcttgtctttaaatcctgctgtgaagccaagaactgctctggctccagggcagctctccagctgaatcccaggtgttcaggaatggaacccaattttccagtcgattcctggcggtggggctggcatctctgaaggaagcatgagggcccccaggtgatcaaatgtcccactgggtctagcttgggaagagtaaggcgcattgtgggacgattccgcgtggggaaaattgggcaggaagtggggaat

SEQ ID NO: 682698 - DNA, 165 bp, Homo sapiens
agaggatccttcgctatcatcggcaccaatgaaactccatgagtacttacagagctgtattgaagtgggggacacatgtattggtatgccctcaaccgggtggaagaacaaagttttcaagcctcgtgctaggctatttttgcccatctcttgcggtcccagtct

SEQ ID NO: 682699 - DNA, 324 bp, Homo sapiens
  misc_feature (282)..(282): n is a, c, g, or t
cttaaacagcagcaaacgcttctcacagttctggaggctgggaattccgctcaggatcaaggcatcagctaatgcagtttctggtgagggccctcttcccagtttgcagatagatgtccttctttgtcctcacatgagagagagatcaactctcttatgtctcttataatggcactaaccccattcatgagggctctaccctcatgatctaattacctcccaatggccccacctccaaataccatcatattggaggttagggcttaacacatgaattttggnggaacacaaagattcactccatcagcctctgtggggatcctc

SEQ ID NO: 682700 - DNA, 726 bp, Homo sapiens
cgaggatggccgtcatggcgccccgaaccctcctcctgctactctcgggggccctggccctgacccagacctgggcgggctcccactccatgaggtatttcttcacatccgtgtcccggcccggccgcggggtagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggtggaccctgcgcggctactacaaccagagcgaggacggttctcacaccatccaagattattggattggcgtggcaagtggggcgccgagagggcgcgataaccctcgcggggtgtaccgcggcagagacgccataagacgggacaaggattacatcgccctgaacgaggacctgcgctcttggaccgcggcggacatgggcagctcagatcaccaagcgcaagtgggaggcgagccatgcggcggagcagcggagagtctacctggagggccggtgcgtggacgggctccgcagatacctggcagaacgggaaaggagacgctgcagcgcacgagacccccccaagacacatatgacccaacacccaatctctgaccatgaagccacctgaggtgcagaggccgggcaataac

SEQ ID NO: 682701 - DNA, 395 bp, Homo sapiens
  misc_feature (4)..(4): n is a, c, g, or t
  misc_feature (250)..(250): n is a, c, g, or t
ctgngcaggacggtgtgctgagagaagaatctggggaccaggctggagtgcagtggcatgatctcggcttactgcaaccactgtgttccaggttcaagctattctcccgcctcagcctcccaagtagctgggattacaggtgcccaccaccacgcctggctaatttttgtatttttagtagagacaaggttttgccatgttggccaggctggttcaaactcctgacctcaggtgatttgcctgcctcggnctccctaagtgctggtatcgcaggcgtgagccaccgcgccttgcctaggattcttacagttaaatgttgctgttttaatcttgaaatcttgagaactgaatgggatgaatttgttctgattttcacttctgttttctttagcttt

SEQ ID NO: 682702 - DNA, 234 bp, Homo sapiens
  misc_feature (47)..(47): n is a, c, g, or t
ccttcgtattccgaggatgaacggtgccgtccggcttcgtgtacgtngtgtggacttatgcgaacagctttctatgcgccctcctacacaatcttcggggtgaacgtgcggtattaaacgccgagcatggactggaaggtgtcgttggatgtgaagaacttgaccaatgagaaatacgtgacggctgtgcagtcgttgtatgacgcgaaggggcaggatacggcgtcgtggtat

SEQ ID NO: 682703 - DNA, 245 bp, Homo sapiens
tgtcaacttagagaattggagatacaacagattagatgaaatatgtcagagttcgatagaaatgaagacagctagacagtagtgggagtatgaagatagaaaatatagagccaaaattggattaaatagcactgaaaaaatgaggaaattattggttacccatttattttaaaagccccatcatttaatttctggggggggcgaagttagaaggtaaagctggagaagatgaaggggttacgtgt

SEQ ID NO: 682704 - DNA, 207 bp, Homo sapiens
cgagtaagcggtctacaacactgcattgactccactgcattgaatcttgatgcatgcaatccactgcattaaattggtatcaattacacaatgctgcagggaatccactgcattcaatccggatccattgcagcatgctgcatggattccacttcattcaacctggatacattgccccatgctgcatgcaatccactgcattcactc

SEQ ID NO: 682705 - DNA, 896 bp, Homo sapiens
ggaatacttgtggcgatgcctactgggagacttgattcgaatgcccagttgggccgacaggtggaggaggagggggaggactgacaaatgtgttgcagccagcgagctcctcataggggctccctgctggcctcaggctgacaccagggcctgaggccagaggctactggcgggaggctccagctggccgaagctcccaaggtaggtcactcgagggaaatgtaacagacaggtgagctagagtacagagaatagatgaggagtgggcaagaaggtagcgagagtggtcgcgcaccgtgtcagggatggagagcccgggaaggctgtcgaaggctgtcgcatggaggaagaaactggaagaagttcgggaactgcagagtggagcccccccggatgccaatgtggcgatcacactgtcaggtgacgatgtctctatgacgtgcatcaccagcaaagaggagctgaactgctaggaggaggaggaccctatgaacaaactcgagggccaggaagatcgtgtcctgccgcatctggtgaggcgagcactggatcacccgctgccccttacgagggtacgctggggcccagtgcagaatgagctggcgggcagctgggctgtttactggcgagaaggagcaagctgcgggagaacttagagccggtgtaggccatgccgaaaccagacggggagtatgtgccggcgaggctgtggacggggccaaccgcgcgggacttcgtggcgccaccgtgaatctggtaagccgccccgggttccacctggtacggaccgggaacacggggaagttcggtggccactccgcatacggaaggcaaccggcgcacaggtggtgtaaccccgcgagggccacacgggggggaccccacttgggtcccca

SEQ ID NO: 682706 - DNA, 405 bp, Homo sapiens
ttttgggtgtatttttttgggggggggagggtgggccaaaacatggggggagttttgagttgttaaaaatggttttgaatccagtttgtttgaaaacacgtgggcctttggaccccttataagatggtcataagaccccaaaactgataagctttggtttttttttggtttggtttggtttttgcttcatttaccccttcatgcctaggggtcccttattggaaccctaagcttgtgggagttatttttatcctactggtcaaggtcatcccccagatttgatttttcataaaaaacctttgtggccttcggcataaatggggtaaggggccctccctgaaactgcaatgcagatatgttcagataacttttattttttaattaaaaataaatctttccaaagga

SEQ ID NO: 682707 - DNA, 462 bp, Homo sapiens
gggtgccactgcaacacattggtttagtcagttttcatgctgctgataagacatcccaacactgagcaatttacaaaagaaagaggtttatggacttacaattccacatgctgggaggcctcacaatcatggcagaaggcaaggagaagcaagtcacatattacctggatgacagtgggccaaaaaaaaaaggagcttgtgcaaggaaactcccttttataaaaccctaagattcttatgagaaccatttcattatcagcacaggaaagacccctacattattcattcatctcccaccagctccctcccgcaattctgctgataaagatttacccaagactgggcaatatacaattgaaagaggtttattgggcttacagtttcctcatggctggggaggcctcacaatcacggtggaaaacaaggaggaacaattcacattttatgtggatagcagcagac

SEQ ID NO: 682708 - DNA, 190 bp, Homo sapiens
taacgatatatggagtgtcagcacggatgctcacgtgtcgagggaacttgtccagtgatgtgcatgcaccgcattggtgaatacacgtcgaccaggctccatctttccgagcttgggccgtcagcacggtgctcacgtgtctgacggaacttgtccagggaggcatgcaccgcagtggtgaatacacgta

SEQ ID NO: 682709 - DNA, 532 bp, Homo sapiens
tcggagctccgggcactcagacatcatgagttggtccttgcaccgcccggaattgaagtatctctacttctatgctcttcttatttcgctcttcaggatgtcgtagcatatgttgctcaccagagtacaacgtgctgcgatcttagatgcacagattcggatagttattgtccagagtacctgtggcatttgcagatttcctgtgctatcgtgtactcgaaaccaagagtatgacaaggactctacagtgcgttggaagagcagtcttacatcaagttgaaaacgaaaagcatcagaagtcaaacagctgataataagcaatccaagtcacttataattcctgatgaatcatcagaagcaaatatgatagacgcgtgttactttgaatgtccaggaagaatgttaggaacgagaattagtgagaatatgaacgcgatcgacttatgtgaacacatgtactctaagtattcgaatagttggcggacagtatataagttcaaataatcaaaatgattgttaatctgaactgacg

SEQ ID NO: 682710 - DNA, 1639 bp, Homo sapiens
  misc_feature (32)..(33): n is a, c, g, or t
  misc_feature (810)..(810): n is a, c, g, or t
  misc_feature (1327)..(1327): n is a, c, g, or t
ggctgcgtcattcgttgtctgatctcctggtnngcccgcgtctcgtccatcacactgtggtgtctgcttgctatgtgttcgtctcccctgccctgggtgtactcggtttggtcaccagtgttcggtgcggaatgtcttgagtgtctttctctgtgtctctattgtttgctcccccctctggggagtgtgtggctgtccctcccctctttctcttggccctcttcttccccgtgtgtcctatttttatgggggggggtgtctcgccccaccaaagaacgcgcctccctcgttgtccgtgggtgttcgccccctctcctttgttgtggggggggagatcctctcccgcggcgccgcttttttggttcctgttaaataggtggggtgttcgcgcggccccttgggggcctttttttacttgtctggcttctatattcggggcgcctatataatgtcgacccgcagtgcgccccaccccagggttgccccacctccagacagccctgttgaaggaaccgatatgtgcgctccgcgtaatatgaagcaattggtgggaggggtatttgatattggcctccttttaagggaagtcttccgtcccagacctcgctttgtgtggcagccccccaaaaaacgggggggttggtaaatttcgttgggcgtttgaacaaatgtggggaaggagcaacccacgtcaggaaggaaaaggaaaggcgccctcggtggaaccctccctatagagggcgcggtggccccccctgggagagaattgcgcccacaattctggaaacccatcgggaggtctttgacggngaatgttttcccaaagggagatactttgagaagagttgtgaaagtgaatgaataagggacaccgttgtttttaaaaatgtgtaatgtttgtggagatcgccttctgttccaacgtggcacccccacagtttggaggaaagaaatagctctgggaactttccccccgtggccctgttgggttctctggtggtccctggggcacacatatgagagtttctacatctccccacactctcacaaggtgtcacaccctgggctgagagcccccgacgccctggagaccacggccgccacacactcttcacattcacgggcttctcacgccaccccccgcagggaatgggagattcaccgcttctatatgaatataccacttgagataacccccgcggctaacacagtggcccccgcgggttcctctcctaagaaaatgtggcacgcccacttccacgcaccaccacggctttctgcacagccaattcttctgagaggggtataaagcccgcgttgggaaggnctccacagccacggccacggagaggtccccaaggaccacggagacttgcgaccctctgaaagcccacaggaattctcacacttgtggggcctccctctgtcacgccttctgctgtctcgttctcacgaagccacttctggaatgaagtgtcccgaccacccctctctcggaatgcccgggcacaggagccaccccacggctggtcagactctgatgttgggtagctggcctctgtggggattgtaagtgcccctgaggccctctgtactagaaactgctcttaataataacccgtgattattggttgcccgc

SEQ ID NO: 682711 - DNA, 535 bp, Homo sapiens
cctcctagccaagatgctcatcgtaagacaaagtccgtcgctggacgtgtctaggtgccagagctcatccatgccaaaatatgcccgggctatgcggccagatggtcctagaccaccatttagtactatgagaccagcttcttcacaggttccacgagtcatgtcaacacagcatgttgctaacacatcaacacagacgatgggtccacgtcctgcagctgcgagcctgagcaactactcctgctgtccgcaccgttccacagtataaatatgcggcaggagtgcgcgaatcctcagcaacatctgtaatgcagctagtcacaggttacaatgcaacaggctgcggtccatgtacaaggtcaggaagcttagactgattccatgtgggcatctgcccctcctcaagagcaaaagcgaatgttgggtgaacggctggttcctcttattcaagccatgcaccctactcttgctggtaaaatcaccggcatgttgttggagattgataattcagaacttcttcatatgctcgagtctc

SEQ ID NO: 682712 - DNA, 201 bp, Homo sapiens
ttatcaacctaggtacagaatgagtaccaaagtatggagagaggaagaaagagaaactagaaggaatagaactaacgatgtgttgccgaggatggggacagtgggcagatgccagaggacagtagaatgtcatttttcagagaggaagaataagttcaggatatctataggacaacatggtaccttagggtttcgatgaca

SEQ ID NO: 682713 - DNA, 338 bp, Homo sapiens
tggcggacacgtcggacacgaggaggagacaagatgaagccacgactaggcacggaggtcagacaggcagcccgggccaggatggttagtggcccaggggagagctgcaaacctggggacgcaaggggctggtcggcgagtgcccccgggaacacccactccggccactacgtgtccggccacgtggccggacacgtagctgtttctgtgtgtgtgctgtgtgctaggtgtgtgtgctgtgtgtgcatgtgtgtgcgtgtgctgtgcgtttgtgtgctgtgtgctcgtgtgtgtgctgtgtgtgcgtgtgtgctgtgcgtttgtgtgtgctgtgcgtt

SEQ ID NO: 682714 - DNA, 1004 bp, Homo sapiens
ggatgcttttttagatatagtccgaagcttcgttctcgctggttgcctgctccaggtgtctccctcagttagaacgtcaattccaatcgcctgtttgttgctcccttccatatgtggatagtaaacttccttggtacctagtttcctctagtcctttccggtacatcctaagtcgagtaagtacgcaggcggtgatcctgggttgtaaacatattttccaacacaatggtataactagcttactgacccatttaaggctctattttcagagtgtacattctataagaaaccaaaggttttgtaccaaaaaagagtcatgtcttgtgttctcggatcgctggaatttctccaggcaatttacaatatatcttagtgaaagacgatagtacagttagtcttagtactatctgattagcatctaaccttccctttgagaccgtccgctaaacatgctacacttcacatgtcctgttaagatacgtatccacttatctccaggcgttccgaacttgtgtaaatccaggtaccttcacaggtcgttcagagaatttgggagcctcgttccacatcacgttttccccagcctcagcagcacaataacgcatatcagctgacaagattcagtgttccacgttctcaaggcctctccgatagttaatccctccttatcgcacacgatatactgccctagctcagacccgtctcatacgttctgtgaaactgacacgagacaacctcacatttggaggctaactggtgctccttatctttaagtcccaaaagtacaccgtatttaccaacacagatccaaaacctcgtaactcctttctcaaaatcctgtaatgccctgtcaattgcattcagaagaaaaccaccttttcatcctttctccctttaagagcacattggtaagagtgtaaatcccagttctaccaccttagtaggtttatttcatttgtaacctctatctcatttgtaaaaaaaaagaatcatagacctgcgta

SEQ ID NO: 682715 - DNA, 518 bp, Homo sapiens
accatgttgccccggctcgttcttgagcgtctaggctcaagagatcctctcagagctgttgagcttacaggcgtgacgtcaccgcgcctggcctatccttccttttggcggtgagcagcttacagaattcttttttcacagtgctgctgttgttcctattcttttttggtctgcacaatgaaaatgaaatagtgctaaaactatctagttctgagtggaaatttggaatctgttacagtagcctgataactcaggtaaattattatggctctacattagctgggcagttgagattcgaagaatgattgcccagcacttgaacagactagaagggtctgtttaaacactcctaattcctggcggttcatttgttatttataaaacacatactttgtggccatgagcgcacgtggctcacgcctgtaatcccagccctttggaagccaaggcgggcggatcacgaggtcgggagatcgagcccgtcctgtgctaacacggtgaatagcctggtctctact

SEQ ID NO: 682716 - DNA, 507 bp, Homo sapiens
gaaaatgtgtcttctcaaaggctgcccctactccctattgccattcagctgcattccatcatcctcttcctcactggtcgctttttataccacctcaaaagggggctgagctctgggaccaggaactgagacgcctctggacacgcaccagcagcaacgggtgcagtgagggctggctagcttctccccagtctccttaaacacccagccacggccaagggcttgttgaggttaatgagtttctgtttaatctgcttctaggcttggggattttctctggagtgttgtttttgcagtgcaaggtgagtcggtgtgggtgtttgaatgctgctgtttgcctgtttttaaaagcctttttaccctcccatgggggttcttcaacaagaaattttaccttgtcttaaaccccacattcaaaactggtgcaggttcccaaggggaattaacccccgtttataaggggcctgtttggcaaaattgttcgttgcccatggtttttaaactctt

SEQ ID NO: 682717 - DNA, 235 bp, Homo sapiens
ccactagtgtaggcttaccaacaaatcagctgaacttgaatttttttttttgtgctgttaaaacaagagcaagcctcctttcgtgggcaggaaaggaatgtaaaaaaggaaaagcattaaaaactgtccaattcacattggttatccgtttgcttttttttgaaagcttggggaaggttataacggggttggaaacatcaacaccttgccttgcataagtgttaagactggaggg

SEQ ID NO: 682718 - DNA, 867 bp, Homo sapiens
  misc_feature (44)..(44): n is a, c, g, or t
  misc_feature (86)..(86): n is a, c, g, or t
  misc_feature (115)..(115): n is a, c, g, or t
  misc_feature (117)..(117): n is a, c, g, or t
  misc_feature (140)..(140): n is a, c, g, or t
  misc_feature (142)..(142): n is a, c, g, or t
  misc_feature (157)..(159): n is a, c, g, or t
  misc_feature (162)..(162): n is a, c, g, or t
  misc_feature (174)..(174): n is a, c, g, or t
  misc_feature (177)..(177): n is a, c, g, or t
  misc_feature (194)..(194): n is a, c, g, or t
  misc_feature (201)..(202): n is a, c, g, or t
  misc_feature (207)..(208): n is a, c, g, or t
  misc_feature (212)..(212): n is a, c, g, or t
  misc_feature (216)..(216): n is a, c, g, or t
  misc_feature (220)..(220): n is a, c, g, or t
  misc_feature (223)..(223): n is a, c, g, or t
  misc_feature (245)..(245): n is a, c, g, or t
  misc_feature (260)..(260): n is a, c, g, or t
  misc_feature (262)..(262): n is a, c, g, or t
  misc_feature (264)..(265): n is a, c, g, or t
  misc_feature (275)..(275): n is a, c, g, or t
  misc_feature (279)..(279): n is a, c, g, or t
  misc_feature (281)..(282): n is a, c, g, or t
  misc_feature (284)..(284): n is a, c, g, or t
  misc_feature (292)..(293): n is a, c, g, or t
  misc_feature (306)..(306): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (314)..(316): n is a, c, g, or t
  misc_feature (320)..(321): n is a, c, g, or t
  misc_feature (337)..(337): n is a, c, g, or t
  misc_feature (340)..(340): n is a, c, g, or t
  misc_feature (342)..(342): n is a, c, g, or t
  misc_feature (345)..(346): n is a, c, g, or t
  misc_feature (374)..(374): n is a, c, g, or t
  misc_feature (384)..(384): n is a, c, g, or t
  misc_feature (431)..(431): n is a, c, g, or t
  misc_feature (433)..(434): n is a, c, g, or t
  misc_feature (442)..(442): n is a, c, g, or t
  misc_feature (451)..(451): n is a, c, g, or t
  misc_feature (509)..(509): n is a, c, g, or t
  misc_feature (528)..(528): n is a, c, g, or t
  misc_feature (591)..(591): n is a, c, g, or t
  misc_feature (860)..(860): n is a, c, g, or t
gtggttgactgggacttcaccttttttaaccaaacaatgttaanataaacatatctgaatagaaaactgtatctggttcttttttntgtcaaatgtaaaatactttaatagagananttccatttttctgcatctatttngntgatattacaataannngcngtgtggattggngancatagctagtgagaatnttaggtnntgtcnntttngggngagnttngcttttccatatgacatcccanccatgatcacataantncnncatgattatncggncnncngtcccccnncccagtcccatcncncntncnnnttcnngtccggcacatatatnacncnctnnccccacatcaaacaatataacaccaatntctactaacntctactagcacagtaagggttactaaagcttagctaattattaaccncnnccccgccnagttccccnatgccttctgtcacccagaatattctctgtgccatgccagccggttgacgccccgtcnttttcaggattctccaganttcatacgtatttccccgtccactcctgtcgaaccccaccattccttattgactgtggttgancctcccaacagaccttcatttatgagaacataagcatatactcatcacaattttgaaaagaatggaagtccttcatacatatcagtttttaattttatccaatcattaattttctgcagagttgttttttcttgacttaatatttttgcaacttttttcattttttgttcatttctttctatgtatttcaacccttccaactgcagctgatccagcttttcatttcgactttcatctagaggtatgttttcacacattacaggattgantctaaaa

SEQ ID NO: 682719 - DNA, 361 bp, Homo sapiens
ctcccttcaacaatggctaagctttagtctgtaaacataaactctgacacttgaacccatcatcaattaccaacagattttcttcatcactgtctggagaccacattcatgatttctataagacagaaataaagcagataaactatactgtatgctgagcacagacttgggaacataatggtgtacatgaaaactactgacaacactccagtctctagagactagagggagagaaagtattaccaacaatgtactgtttttactgtagtgtaaagagcaaaccaagtgtccaagtgtcgacacgaaagtagtccatcgtctcccagtttcctgtgagacaggctgatacttgtcagattaa

SEQ ID NO: 682720 - DNA, 157 bp, Homo sapiens
acacaggactattctagccatgcactactcaccagacgcctccgtggatcccagcgagtgaaattgaggcatctgtggaagatgctccaactcctgagaaacctaggaaggttcatgcaaagtggatcctggacaccgacaccttcaactgaactgg

SEQ ID NO: 682721 - DNA, 390 bp, Homo sapiens
ctggcccctgatttccccgaccacctcctctttctcagctagcgaagtttaaattagcaagattattcgtttacggcagagaagaaatgttagcacttttccttaaagacaacaagataccttccgaccttctggataaagaatttctgcctatcctccaggaggaaccccttcccaccattggcttcctggtaccctttacagaagaagaacagagaaacttttccatgtctgtaaatagtgctgctgtcctgagattgacaggacgaggaggaggaggaacagtggtgggggctcctagaggtcgaagttcttcaagagggcgaggcagaggcagaggtgaatgtggtttctaaccaaagaagttttgatgaagtagagggtgttttt

SEQ ID NO: 682722 - DNA, 147 bp, Homo sapiens
gtaggacagcgttgtggaggtgaattctgagatacttgcgcccccagcaactaggcaggccacttccggtattcttcccgaaccttcttgttgagcaggcagtgcagcaggtagaggaagatggtggagcccacgaaggaggcagat

SEQ ID NO: 682723 - DNA, 321 bp, Homo sapiens
gggtgtgtatttcagtgcacgagggatggattctgcatatcattgactaggcctcattgagctgtcaccaaactcctacctgccagcggacgacgtggtcagcatcatcgaggaggtggaggagaagcggaagcggaagaagaacgcccctcccgagcccgtgccgcacaagtgaaagaaaaagaaaaaaaaagaaaaaaaaaagaaaagaaagcaaaaacaacagaacagaaaaaacgagacagcacagacgagaaagaaaagaatttaaacaaaaaagacagaagaacggcaaagcaacaaaacaacataacgaccaac

SEQ ID NO: 682724 - DNA, 1072 bp, Homo sapiens
  misc_feature (1)..(1): n is a, c, g, or t
naggaagagagtatagcggtaatttatggtgggtgtggctgcctgcctgggttcgtctgggtatttgaggttttcgttctttcatcacagtcgactggccttgtgggtttcagtcggtggactactgccagctgttgtgcttgaaccatcgcctgctgacctcaggccctgttaggcatggccggatctactgtctgatgtccgtaacatcttccgtggcccagcgaactcatggctcacttgcaccagtttggctggctccttcagtgggcatcagggacctcgattgctgttgtcgcgatcctggacgtcgggcgcttgccggcagagtgaaggtgggaaggagtgaccaagctgcgcgagggccggcgcaaggtggcccggcagcgcagcttccggatcacctttgactgagcgacagcagccctggggccccgcaggtcccttagggagttacaatgaggggaatgcgcccttggttgtctgtagtttggggttgctggcaagatactttgtcatgtttgtttctttctttcacaggactgcccttgacatgatcgctgtgtgctttgcggttttccatttaggaggctattctgggccttcatgcccaggcagcagcctcatgggtgtggcttctgtgacgtttcatttgagtatctttggcccacttttcacctactgcgaccacccacctcatcctggctcagcctggtgatggagaagtgctgatggtcatggtcccagccagggtcgtgtgggggcagccactctccatccaaagcatagtcatgggtgtcatgaaaagtatatccaaatgtaagagaaacctccaagatccacgggcgcagtggctcacccctgtaatctcagcactttgggttggccaacggcgggcatgattcgactctgaggtcaggagttcgagaccagcctggccaacatggtgaaaccccgtctctacctctaaatacaataattagtcaggtcgtggtggacgcatgtgatcgcaatctcaggctactcgggaggctgaggcaggagaatcacttgaacatacatggacgggtgt

SEQ ID NO: 682725 - DNA, 1289 bp, Homo sapiens
  misc_feature (98)..(98): n is a, c, g, or t
  misc_feature (101)..(101): n is a, c, g, or t
  misc_feature (108)..(108): n is a, c, g, or t
  misc_feature (112)..(112): n is a, c, g, or t
  misc_feature (118)..(119): n is a, c, g, or t
  misc_feature (124)..(125): n is a, c, g, or t
tgcagcctctgattaacgacggaggcagaacttggcaaatggaagagcaggagcacctcaggaagctggaggctgagagacttcgaagaatgcttggnaanggatganggantgaaanntgttnngaaaccaaaacactactgtcacgcagactgactctgaactgactggcttcgctgctacgactacaccgactgaccacggcgatttgctttccatacaaacgactggacacacgactgacactgtcgacggacacgactgtcccaggacagacgcaacagcaacggaacgccagtgacccctgacgacgcaaccgacggacacgaacggtagacagttcacggcggggacggacacagacggagacgcgaccacgcccagactagccacttggacctggaactccaacgtggcagcgtgaggacagccaaccgagacagccagcaacaagagcacgaggcagactcctgcggaccagggcagcatcacacgcggccacggaacagagctcgcgaaacagctaccagaagcacgagctagacctacacagtacgcagaccctgaatccataatgaggaacagagatctcacgccgccaggacagatcgatggaagacgcagacacagccggcggcgcgcacatccaccacgaagcaacacaaccgacaatctcgccacacggacacgacgcaacaacacgcaccaaccagaaggctaaacacgagcgaacacgaaagagcgcatcggcaacagcatgaaccaacaagaaccacacaggcacactcgaactcaaactcggacgcgagcaccgacacctcatcatacgcccaaaaaggaacccagcacatctgccagagcacgcaacacacaaataggcaccccggcacacgagacagcaggacagagtggccgaaagaggagaggaaacagcgagacccgggagcacaggcagagcagcgaacaggagaacaaaagaaacgaaaacacaaaggccacgcacaagacagccaagagaagacaagcaaccagagtgataaccaaggcgacaggcccgcacagcgcccccaaccggaagaaaagcacccaaagaaagactagaaggccagcaagagaccaccgacgcgaaaacaacaactgcacggagtgtaaagaagcagacaacagagacaacgacgagacaaacgcagacgccaggagcgaggacagcacacacaggcgacgtaacgacatcctggagagagaaagaagaggagaacagccgcgagcgcccgaggagagcaaccaac

SEQ ID NO: 682726 - DNA, 716 bp, Homo sapiens
  misc_feature (139)..(139): n is a, c, g, or t
agcggttaggtgtaagaattaggttgagctgagttttggtttgtttgtttgttttgtttgtttgttttgttttttgcctgtgaatgtccaatttctccagcacaatttgctggaaaggctatttttcttccattgaatngcttttgtaacttcattgaaaatcacttgggcatacttgtgtgggtctatttctgggttcgttcctctgttctattgatcgttgtgtgtattcttccaccagcatcaaacagtcccaattactgtagctatataataagtcgaaaatcaggtagaccgattcctctcattgtgttcttccctttcaaaatggtttcagctattctagttcattgcctgtccatataaattttagagtagtcttgtctatatctacaaagaaatcttgctaggatttctaataggaatttcattaaagctgtgtatcaatttggcaatgaattaaccctttgctgtgctgagtcttatgacatggtttgtctctccatttacttagatctttgatttcttgcaatatttcgtgttttcagcatgcaagtcctgcttatatattagatttgcatctgtattagtttgtgatggcttctgtaacaaaatactacaaaccgaatagcttaaacaacagaaatttactttctcacagttccagatgctagaaatctgaaatcaagatatcagcagagttggttccttcctag

SEQ ID NO: 682727 - DNA, 96 bp, Homo sapiens
gcctttgccacggcttgcggcaggagtttgcagccagccgggccgcagctgatgcccgaggacgcgctggacaccggtctgcagccgcttccaacc

SEQ ID NO: 682728 - DNA, 1489 bp, Homo sapiens
  misc_feature (78)..(78): n is a, c, g, or t
  misc_feature (1292)..(1292): n is a, c, g, or t
gacagaattgcggcaagtaaggcaggccatcggcggctgcggaagagttgtgcctctcgacttgtgtctgatgagatngaaggaatagtgatagacttcgctattcacataggtcggttgagatggtactttgggtagacgaagaatgggcgtaaggaagttgtgtggcatttgtgcaaggagaagcatccatgtgcgcaagtgggacgagccatcacgccggatgttgtgagaatgttcacggtgtaatactcgatcagcttcgaaccgcagtggatccacgacgtcaaccttcttctatctatactgccgcgtctgagccaggtcgctcctcccattgaagagctttaccaccaacttgcttgacacccgatcgagaccgcgtttgtgcatccgcacacaatcaaggtttagcctacacgaattagccttcaagtggctttgagttccccattatttgcttatcaaggaccccacgggagcacccacaaaggccaccccgaaggcacattcaaaaggcccatcaagaacatgtgctattgcgttcgcagagcggaccctgaacgcaccagcactaaggagtggcagtctagcgggcacaaaagcgggttgtacaaggtcccaccaagagctacacagccaagagaaaccgagaacggtggaatcccaatttcttgaagaagcagagaagtcgtaagttttgtcagttctattcaacgcttaagggaaccttgggcgccatttctgttgacttgtagaaaggcgctatatccagaaggacgattacaacggcttttccaggtccttgtgcgtaagagggtttcccattatatgacggcaccccttcggggcactggggatctggagtgtctttcttccccgacttctcgtggattagccttattggcggccttggaggttcctttcttctccttactttgtgcctcattttgccctccgcctataggtgtgttgtcctggtggacacaaaaggtttaggcgaagcgggggtccccccactgatcagaacgttgtcgacgagcttttgattctcccacatagggtgcagagaggcatcctgggcatctaggggccacactctggcgtttgagccagaggtccatccaccgttttcgcgtaccccactcgtggggcattaaacccggttgttgtcgccccgaagcgtttggtatctggccgcttgtttctgcccagacatagggagtttcgaccaacggcttccgggggatacccgcaggaggaacacagggtgcgggcgtaccaaatgagancgttacaaaggcaattcgactttgcgaaaagcgagccttaagatctatatgcccgcacatacatcgaaatttttaacgagcaagcacctggacacaccgcgactgttactcgcgagccatgcacttagagtccagagcgcccgtttgacaatatatggggagcttttggcccaacctcgtactccaaagggcagcgg

SEQ ID NO: 682729 - DNA, 166 bp, Homo sapiens
gacacttgtgctagctacaaacgcgtgacttgtttactgaagacacatgggatccaccttctgatgaacaaatctgagatgaaggcacgcattctagcattactctgcaccttttagcagaccattctggtctaggcagatagtgagattagctctagaagtcgaa

SEQ ID NO: 682730 - DNA, 214 bp, Homo sapiens
  misc_feature (6)..(6): n is a, c, g, or t
  misc_feature (14)..(14): n is a, c, g, or t
  misc_feature (52)..(52): n is a, c, g, or t
  misc_feature (169)..(169): n is a, c, g, or t
  misc_feature (172)..(172): n is a, c, g, or t
  misc_feature (209)..(209): n is a, c, g, or t
cctgcnagctcgtnagcccgagcgcgaacaggctgcccgcgaacacgtagcngccgacgctgtgaacgtccgacatccagaatgcgaagatgttgtacgagccccatgtctgattcttcaggggtgccaaatcttcgttgtacagacgttcactgtaaccatttcgcangcngggtcgccgccctcgccgccttcttccgccggattanggctg

SEQ ID NO: 682731 - DNA, 198 bp, Homo sapiens
ccagacctggctctacattggatatggaagaaccgggagaggatccttcagttctgggccattccaggaccctccagaaacacagtgtttcaagagaccctaaaaaacctgcctgtcccatgcctcattgttatttccatcagggttctgcaagacagtgacatctttcacaactgcaacgtctgccagctggctcag

SEQ ID NO: 682732 - DNA, 178 bp, Homo sapiens
ctcgggcctggattcgctcgggttactaacatcatgcagtagcttcttctattctctcttatttttttggaaacggagtctcgctcttgttgcccaggctggagtgcaatggcacgatcttggctcactgcaacctccgctttcgaggttcaagcgattctcctgcctcagcttccca

SEQ ID NO: 682733 - DNA, 100 bp, Homo sapiens
tattgttcccatcagaacgaactataagtggactagctgaaaacgctcccctacataccctggtgatggaggtgaaaactactgatgggagaagactgcg

SEQ ID NO: 682734 - DNA, 234 bp, Homo sapiens
gtgattcccctctgaccttggtgctgttctgggtcacaacaaggatactacagttggtccatagccctgctggttcgatggttcctatgctcagttgtacaccatagggtgcttgctcaggaggacggcctaggtcgaagatccaggagtcacttctggtttgtcaccctggaagtctagacacactgtagtccggagcatgtttcctcatcgcagcacttttcagagtaccag

SEQ ID NO: 682735 - DNA, 390 bp, Homo sapiens
gccaaacaagggccgccgcggttcctgtttccttactggggatttcagggctgggggttcagggagcatttccttttcctgggagtactgaccgcgaagttgtcatgtgccgcgcccttacatgagattgtgtatcctattgctggagactctgtctgacctggcactatcgaatgatcgctggcggcagaggtggcacaggacagtaaaggagatgctgtgctggccttcagcctggacagggtctctgctgactgccaggggcgggggctctgcatagccaggatgacggttttcatgtcccaaagaccgcgatgacatcatattttgattccctgtgattgccatgattatgatggacatgacagactttacccgattggactctgg

SEQ ID NO: 682736 - DNA, 305 bp, Homo sapiens
cgaccggggtatctcatcagttgcggctggtccgtattctgcgcagcaccgattatggttcgcgtaggtggaggatggatggccttggaataaattttgagtgaaaaatgatccctgccgagcaagaggtagaactaacattgaacttagagcgaaattcatcctaccagagggagcatcccagggaatgacccccttccgctcacggggtcagaaggtccaaaccatcttcccgggcagcttccccttactcgttccagctccagtgctagtccagagtaaccacagctgtacatccatgccat

SEQ ID NO: 682737 - DNA, 411 bp, Homo sapiens
atatgctcagcgtagtccataccctctgggatggctggcgagatgagactgtactagtggttcccgaagtaggtccacgggtgtactctgacccaaataccccctcgagagtggtctggcctgtgtctgtggtgacactgatagctgatatcaaggatcctctcgttccctgacacccacggggtgtgttctgaggacagaactcgcggttttcagcggaagtcagcctcattgatctccatggaatctcggatccactcagccccataccttcagctcctcaaggcgcagaagcagcagttgcacctgagcttcgctcaagcccttcccctggctgagctcatccagggcacccagcaaggtgcagacacaggacacggctgcataacaagcttcgatgccacccttgat

SEQ ID NO: 682738 - DNA, 404 bp, Homo sapiens
atcatgctctaacattagattatagtgatagtaggcacaactctaaatatactaaaaatcattgaattgtacacttccaattggtggactttatgatataaaagttgcctatcagtacacattgtatgtcagtaaagctttaccacacaagtggttgtcgcaaaatcaggactgtatgctttttccatactctaatgcccgtttaaagaatattagatctaaacgagcgactcaaatcactttataaacttttgccagaactacctctgtattataatggtatgagttcttagaaatagatatatcgaatgatatctaacactatttattatactcattatttttaagagaccgggtctctgtgtcacccccggctggattgcagtggcccaatcctagcacac

SEQ ID NO: 682739 - DNA, 411 bp, Homo sapiens
cagcaagaggactcgcatgatcccgggccactggcagggggccatccgcaacgaggaggagctgaacaaactgctaggccgcttgaccatagctcaaggcggcgaccttcctaacatccaggccgagcttgtgcctaagaagaccgttagcgaccacatggccacgggcaagtgataggacaggaatctgagctaccggaagcgctctccccagaaggctctttgcagggcccgattaccggttcataggacgagccaacctcactgatggtacgtagacggggaataggcactgaggttgcaagagcttctcatgacagagcgacgccaggatcctaagaggctgccagactgaccaagcttaaggattaagtggatggatgcttactgattcctgcattactgattgtg

SEQ ID NO: 682740 - DNA, 820 bp, Homo sapiens
ggaggctgaggcaggagaatggcttggacccggggggcggaggttgcagtgagccgggattgcaccactgcactccagcctgggcaacagagtgagacttcatctcaaaaaaaaaaaaagtagcctgatgaacagaaacagaagaggcacttggtcaaataagtgtatctaaaagggataataccatcattcagaattcggaccatttaaggagactctgtctagtagcatggtcatctcctgagtctataggccggtcagtgcgtcggtcggtaaggcacggtatcggtctctctgggcgagggagtctccactctgttggcccaggctggcaacgtgctagtcgcgggcaacatctcggcttcacggcggccctcgtgcataccgggggttacaggcatatttcttcgcttgtccatcggggcgtcccatagcgggtctgggaacttgacacggccggttgcagctacacacagtgccacgcagccatgcactggcgacaagtatttacacgtagcaacagttggggatctcgtccaccccatgggtgttgggcaccccagcgcggtggggtcccttcgggaagagcggcccttaagtaactgctccacaggcttggaattgcttcccccgcgcaccttgggggcacattccccccaaaaagtcgtgcctaagagcattctggccacggccccaaaatggaacccccatggtggccacccgccggggaccccaaaggtttatacattcatgcgtctacagtgtacgtcgtcccgctcagagggaacaaggagtcaacagtggggtgatcacatgctag

SEQ ID NO: 682741 - DNA, 908 bp, Homo sapiens
cctcccgtcccccgctgtgtgcctcggtccctcccccgcgggtgtctgctcgtaacgttcttggcccatgggccccgcgcatcccccgttttggatctcccgctgccccatggagacacggtgtccgtgccggaaagaactattcctggttcccgctcttttgtgtgacaaagcgtgctacaggggcccccctcattttcgtgcacgttcttgggggtgtcacgcgcctggctggttaataacgtgtcttctctgacgacacccacaatcttggttgagacagcttcttgcgcagcatcatcccccctctctctggggacagcctttctggcggcgcctgaaattgcggcacaccccctcggcccgcggtggcggcctgcctaatctgaatcccgctcgtcacatcacaaaaggctcttgctgaaagtctgcccccatgtcgctcccaataacttcgtcgcgaaagcatgcttcttacgacgactcacccacaccgtatgtcttattgcaccctattagtctcctccccgccgccccgccttcttacacgactggcgtgagaaacaacacacggcgctctctttgtagacacgagctttgtgtctaccagggcgcgccttattcaaattcggtgcgaccctgtcaagctcccgcgtttactgatgcaacgcaagggttggtggctgacccccccccactccgtaggaaaggaagacaattttgttttggcggccccactctgcctattattatggttgtcacggagtgagcccaccttgatacagggatgatcatcgcctcttgcttgaattcccatttgcttgtgttcatgcggggagcctcctctcccccccacaatttccatccgagggtagctttgcccccccaaaaaagaaacggcaacatgc

SEQ ID NO: 682742 - DNA, 237 bp, Homo sapiens
gtgcatgatagaatcgagctcggtaccttccgtgtgtggaatgacttcagtcacctgtggcagagcccagctcgagcaggcgtgcatgatgagcagtgaggcccaagacactacccagtggcccagcatcccccaaacgcaagctggaagcagccgaggaaccacctggtgaagaactcggcagctctggggttggcaactctgccacccgggcccgtttgctgagttcttcaccag

SEQ ID NO: 682743 - DNA, 214 bp, Homo sapiens
tggaaatactttcttttggtaaaaacacttcacgaagaaaatctaatgaaagtcttgcagaaaatgtaaaatctggcaaaccatatttgggaacttccgcaggaagcaatattgcaggactcaatatgaaaactaccaatgatatgcctattgtatatcctccaagttttgattgtatgagtttggttccttttaatattaatccgcattatct

SEQ ID NO: 682744 - DNA, 104 bp, Homo sapiens
tataggcgctaggtatctgcgcaccagcaggttttttttttttgggtcccaagggctagagattggccttggaaaaagcttgaccagaaaatctctcaaaagta

SEQ ID NO: 682745 - DNA, 258 bp, Homo sapiens
  misc_feature (228)..(228): n is a, c, g, or t
agtgatctagagtgatccacgcatcttggtggctagcactacagcttgtcagtgggctaacgcagtggtcatgctgtaatccagcactttcggaggccaggcaagctgatcacccgaggtcaggagctcgagaacagccgacaacacggaggaaacccacgtctactaaaaatacaaaattagctgggtgtggtggcgcatgcctgtaatcccagctactcaggaggncgaggcaagagaatggcgcgaaccccggag

SEQ ID NO: 682746 - DNA, 469 bp, Homo sapiens
  misc_feature (95)..(95): n is a, c, g, or t
cgccgggaatcgtggttgcccgactcaagtcgcccgcgcgtgtcgcggagccccgcggcagttgtggttgggtggcttctgtgatccaaggaganatgagccaaattgctacagaagttgagtcaacccactgccctcaaatcctgagatgtattcccagtgggaaaaggaacactccttcaggactttgtaccccaaattccacgagacccacagacaccctcagcccagcccagctccaggacagaccataatgaaagatgctttaccttgaaaactaaatggacaggacttgatcacaaagcatcacctctcccctggactccagaggatcgttcctaactgcttacttgacacatctattaggtatctcaaactggaaggtctaaaactgaactctccctcctccataatctgcctccccttagccttcccttcgtcagtaaatgatgagttttttccaaaaaaa

SEQ ID NO: 682747 - DNA, 552 bp, Homo sapiens
  misc_feature (59)..(59): n is a, c, g, or t
  misc_feature (85)..(85): n is a, c, g, or t
  misc_feature (124)..(124): n is a, c, g, or t
  misc_feature (217)..(217): n is a, c, g, or t
  misc_feature (270)..(270): n is a, c, g, or t
caaagaaaaaggtttttccaaaaaaggaaaacaaaggcttggtgaagggaaaggtggtntgcccctgtccctaatcaatctcccngggacatccttgctcatcatagtaccaagtgaaccccanagatccctactaaactggggtcaggaaattcctagagaacctttccggaaaaagtctggaaaaatggaaaaggtggaaaggggctccccctanagagggtgggggtgtagttacccacccagttggccagaaaacctgggccttgnagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgtt

SEQ ID NO: 682748 - DNA, 103 bp, Homo sapiens
tcaagtatcttgatgtctggacttttttccacccaaaacaaggcctttagcgccaagtcttttcctttctttctgatttgacactgtggcagccacttcgggg

SEQ ID NO: 682749 - DNA, 213 bp, Homo sapiens
atccagctctgtgggcatcatgattcaattcgccaagtaagcatgcttcatcatcacagtgagaaaccggacgatgacctttggagcacggcctaataagcacctggcgtttgcctctctttacggcattgttgatacctacttgagagcatctgccaggacattcatgcgcaccattgtggcttagattgcaggatggtgcaacacgaagga

SEQ ID NO: 682750 - DNA, 1534 bp, Homo sapiens
  misc_feature (399)..(399): n is a, c, g, or t
  misc_feature (1221)..(1221): n is a, c, g, or t
  misc_feature (1233)..(1233): n is a, c, g, or t
caatagtttgtgtcgacccgcgaagaaaagatatgtgtggtcgttgggggtgtgtagagaacatactttaataatgaggaagcggtgtaattttcccggtggggggtctctatatactaaatatagggccccactaatgtgttggtcccctccctgataagtgtgttgtcgtcccccccctactaccactaagggggaggggggggacaccccctcccgtgggaaagtgttcctttgttgggtggtccagcagcaataaggacgtccccccccctcctttcggggtggttgtggttggtcgtccacatacggccgcgtggtgttgtgttggccgccccctcgttcctccgtcttcctgcccccgaggagttgttccaccaccaacacgcggtggggtgngctccccaccactatatgttatatagggcgctcctctggtctcaaccagaagaaagtgttgtggtgaagtaaaagtattatatgaaaaccaccacgtctggtgaagcagcagcggcggcgggggaagaaacaacaaccacactactaccagtaggtcctctacccaccacagagaatagtagtgttttttgcgagacaagaatgataattttccttgctggtgtgttttggaaaagacgcctctctctgagaacccccctcttatggcccactctctatacagggagagagatttctgagaggtgacagagagacgaccctctccccccacaaagtggttgtccccccccgcggggagtactccctctacttctggagatattgttcttcttgtgagccgtccccgctgttgtggccgccgaccaccacttgctgctcgttgtggtggtcacaccacacggctccccacaggggagtacttctctctacaggtagaggagacaccacagctgtgctgtgacgacacaccacggttgtgtgctcctcacactgggggtgtctgtgtcgcgtctcacaccctactctcacagagtatatatataggacgacctctctctctcacacaggcaccacacacgtgctcacagctgttgttcgtgacacacacatctcacacccacacaccacacaccacactgggctctgagaagagagatttttatagagaccctctggtgaacacacacaccacacattttttataagagagactctatttataggcgcacagctctcctgctgttttatccactctcgtgtgtngtcctcttgtgngggcacatagaatagtgtgttatacacctctgttgctcttataaagaagcacaccacgctcgtgaaaattctataaaaggcacctctttttgttaagagaggtatataaaagaaaaaactaagaatgtaaatataaataaagagatccactcgggaaggctcttatatgtgaaaaaaagttgaaatgttatatatagttaaaaaaaagatatttaagtaaggacccgtttggctaaaacccagattttgtttgtaattgatttcctttgccaattaattaatagaataattatattaaaat

SEQ ID NO: 682751 - DNA, 980 bp, Homo sapiens
tgcccctcatttacagtgaatataatactagcatttaccatctcacttctaggaatactagtatatcgactcacgcctcatatgctccctactatgcgtagaaggaataatatctatggctgtgcatcatagctagtcgcataacccgtgcaatcacccactcccgtcttgagcctggatgattgtgcctatatgccggtacgtgagatcttatgcgcgccatgacagcaaagtcacctggttgggtcgtgagtcccaatatagtcgtcatatctcgcaagacattatggaccttagaagataacgttacagtaaaatctaaacctaggtcgcatatgctctaaactcattcagtaccacatgaatgtatattactaaccacgtgagcatgattttcgagaaacacacttactttgtattgaacactaccagccacagcctgatttatagaggatcaatccctcttagtgatatcattatccaagatcaaacagacaagctagcatagtcctcgtgccgcacccttataacgtacacgacccccgtaaaataacacaattacttagtaatagtgacctgactcctggcccctcaataactcatggagaggccaagcgaggtatccaagagaatccagaatcgcgactaaatatggagctcttctacaatttaatgctccgttaggagctgcattaactaataagcattatgcgcaaggtactaatcctattttatatcttcttcgaacgcctttatgcccaactgtgtgtcttaccgagagggaacagcagcacgcggaggcaggaacataggtctgtctacaacggtatagagcgtcacaacgcggagccttaaccaagcgctggactgaatcatggctgcacgccaagataccggcgccttagacacacacagctctcaaagtcagccttccaaactgccctcaatcccaaggaggtcaccaccaccacaatctacaa

SEQ ID NO: 682752 - DNA, 364 bp, Homo sapiens
  misc_feature (167)..(167): n is a, c, g, or t
  misc_feature (180)..(180): n is a, c, g, or t
tgtgtattgagaacacataatactttctgcctcaataaaaatttcagagctataaaaaaaaattcatttcctctcaaactgatggataatttcgagaattggagactctaactcctagaaactctgttacctttccagaacgagtatataatcttgtagacatcagnacttacgtttttnccaggttaacaaaaaccgtggagtaacagagtttgaatgacgaataagaaaaaaatgtgtcttacatttttgagatatttacttacctctccaagcttttccaatttgatgtaggtttccatttttccaaagccaatttctgactgaaaagtaaacaatgaaaaatttagtatttacttttttt

SEQ ID NO: 682753 - DNA, 573 bp, Homo sapiens
agatcatcgagccagagattcacacagacacctgtcacttgattccaagggctgtgatgtggaagaagctctatactgttggcaatgggagcttgaagtctggaacaaagccctttgagtgttccgctgtgactcgtagtgttctggcgagcagtactgattgattaaactgtggagatatagtggctaaacatagtgtaggtatctaagtccctaagttttgagtatcttagctattgtgtgttcaggtatgtacagaccatctaacagataagtactattttgatgtcactctggcgttctctagcaagctcaggtgagttcaagcttaattgaggagagatgtgatctacaacactcttaacgcacgtgccttctattgacttgcggttgatctgtgtgcccgcggtgtgctggcacgaccttgaccaaccctgggcttagtataggttagtttcgctttcgtctcttgctcgaggttagtcactgctgtttcccgtgtgggtgtgggtaggctaggcgtggcgcgctgcattgctgctgtgtttgatgcttgtcccttttgctcgtggt

SEQ ID NO: 682754 - DNA, 405 bp, Homo sapiens
  misc_feature (228)..(228): n is a, c, g, or t
gcttattcagggcaggaatactaccagcagtggagccgggaggagggcgagccttgctccagggacatgtccacctatacccgggaggagctgggagcacatcacgtctgagtacacacttcagaaccaggataccttctcaggggctgtctccttcctgacgggccgaatcgtctacatttcgggagcaggcagcctgtcctggtgcgttgcaagcggggacgtgtncgggggtacccgcttctctgagctctgggctccccaggatgggggagtcttctatggttccatggctccatctcgcttgcccacctgggggcacaggggcctcagcaggtacaggcctcagggacttaacccaggagaagtccgtctactggcgaatcagaggaggtcctgaccggg

SEQ ID NO: 682755 - DNA, 194 bp, Homo sapiens
gacacgtctaggggcgggcaggcgacgacgtgacgcatgaagggcagcgtgaggtagtcgagtaccatgagcgaagcgagcggcgtatacgcggggtgaagacaaggcgaggttaaaaattttgcatgttatttatcttgtggatattacagaagtgcctgacttcaacaacatgtatgagtcatacgatccat

SEQ ID NO: 682756 - DNA, 1194 bp, Homo sapiens
gggcttagcatcagcaacatcctagacggcctattcctttgtctcagaaaatcctgagcgagcagactctgtactttgttatctggacgtgtgcatcgggctggtgctgacccatggctgctctggtgataattggatctcttgaccaaacagactgcaggacggagtcccgggaagaagatacctgcaggacagagagagcagaagagaaagcagagacaagcgaggacaggaagagaaggacaccgagatccagactactcataccgatgacggagacaacagacagataacgagacggacataaggaacaaagcaatgagatacaaaacatacatagaggagaaagcaaggacgccgcggcaccaagacgagctgagaagagcaacagcgacagcagcaatccaatacaaaggaacgaatcagagcatgaactgacaagacagcaggaagccacgaggacaccaaagaggcctgaactcgacatactacatcaggagaacgcagaaaggaaacccacgggaacaaacaacatggagggcacgaccatcggaaaaggaagagcagacactgacagaggaccacagaagaggacacaacaaaggaaaaagaaaccacagagaacaacacagaaaaaacaaaatggatgaatagacaggaggcacaaacaagacacagggacagatgggaccccatataaacaaaagcacccgaggaagacatgggcaccgaaaaaagggaacaacacaggtataatggagacgcaaaggagaacacaaacacaaaagccaacaaatcagacacaatagacacgggataacaacacagcggaagagaaaaaaacactccaaaatgagcaaatggagaacagaagacagaacccggaggaacaacagcaaacagagcaaccaaacaagacacagacaaaatcgcacgaaaaaacactagaaaacagaaaacataaaaaaaaagcagacacaagagaggcagatacccacacatgcacaagaagaggaaagacagaaggagaaggcagacaaagagcaaccgagaacgaagacgacaaaccagagcgaggcagagcagaccggaatcgaaaaaaccgaagaacccaacagagaaaaggaaacgaaacgaacagccagagctacaacaaagaagaagagagcaagcgaacggcgcgacgaagagcgc

SEQ ID NO: 682757 - DNA, 410 bp, Homo sapiens
  misc_feature (240)..(240): n is a, c, g, or t
  misc_feature (341)..(341): n is a, c, g, or t
  misc_feature (359)..(359): n is a, c, g, or t
caaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgacccccgggnggcggaggcttgcagtgagcgaagatcgtgccactgcacttccagcctggggcggacagagagtgtctcaaaaaaataacaaatttgaaaaattgtttttnaacaaaggagccccagtntggaagaatcagaacattagatctgtgatcactgcctttcaaagagcccat

SEQ ID NO: 682758 - DNA, 408 bp, Homo sapiens
gagttcgacacaccatgctgactgtgagcgttaagcgtgatctgctcttccaagccctgtgccgcacctacactgactaagaatttgatgaactatgatttgaatttggtctggagcttgatgaaattacagtcgacaaggaaataataagtaaagaacaagggaatgtaaaggcagcaggagcctctgatgttgccatttacaaaattgacgtcagtgccaatagatatgatctactgtgtctggaaggatggtgtacgggacttcaggtctttaaagaaaggataaaggctccagtgtataaacgggtaatgcctgatggatccaatatcgattatacaggagagaccggtcagatacgtacttttgcagtagcagttaatcttcgtatctgcttacttgatcgtc

SEQ ID NO: 682759 - DNA, 243 bp, Homo sapiens
cattggtccgagagaaattagttgtggcgatcaaaatgattaaggatactagttatacgagatcaggttcgtcctttactgttgtgtatggttatcatttgttttgaggttcgttctgattagtcttgttgggtggtgattagtctgttgttgatgagatatttggaggtggggatcaatctagggggaaatagaattgatcagtactgcgtgcgggtaggcctaatttctctcggaccaatg

SEQ ID NO: 682760 - DNA, 790 bp, Homo sapiens
tgcatttgcataaattctatactgtttacgagcttaaagctacagaagcattgttaggaactgcttggacactgaacttttaaagcttctcttgacattgttaacaagcatgttcatctttctcttgtcactagtccaagaacaaatatgcttaatgtatattacaaaggcttgctatatgttaccctgcttcttaatgccaaaagttggcttcgtccacacatttccttcaagacctcttcagacacagggcactttgtttgccttaatgaatactgcttgggaaaaaaacacagctataatgagtgaaacagggcagcaagcaacgaacatttctcacatcttcagcgactccaagacagaatgagtcatccacattcacgatggccacatccatgcaggcactttcacatctttcctttaacacacaactaatgtccccttctctctctctctctcatacacatgattctctaagtactactttcttcatgccaggaccagcttttacaagccttgatgtaccagtgactgtggtccaaatcgtcccttacagtggccaccctctatacatctttacccatatggtgagcatcttgtctgtctggacgggggatatgacaataaatctacagattggcaccatcctggtaccaaacgtaggacaagcctttaggtacttcactcagtgtggatgggtaaatcctttattgcctattctccctggactatactggcattggtaagcctggggacactacctccttgtttaccatgcaccaactcgcca

SEQ ID NO: 682761 - DNA, 165 bp, Homo sapiens
  misc_feature (86)..(86): n is a, c, g, or t
  misc_feature (126)..(126): n is a, c, g, or t
  misc_feature (147)..(147): n is a, c, g, or t
attggatatcggatgagggtgacagtgacgcatctaactggcagtgctgatccttagaaactcatctcgaatgaagtacttggccngggtcagcgtgggtcctctccgggctcgggagtagcatcntaggagtagtgtagcgaaaanttctggaaacgtacgctc

SEQ ID NO: 682762 - DNA, 233 bp, Homo sapiens
tctctaggagaaaattgattagtgatacgagttccagcgcaagggttctggttggccatgaagaaagtgagctcatggatcagaacaacagcctgcaccttacgctcaggcttggctcccctcaggctgccatgactctcggaatccctatctttagtccaatgatgccttatggtactggactgaccccacagcctattcagaacaccaatagtctgtctatttcggaagag

SEQ ID NO: 682763 - DNA, 359 bp, Homo sapiens
gtgaagattaaataggctcctctgaaaccacagaatacaacgtgcaccagcatctcatagcctacagctactacataacctgggcctcctgcaggcaggcctactggagacatcgtgccaggcttcagtggttatgatggccaccctggtggtaccgatccaggtccccatccacacctcgccaaagcagccctggcccagcttgacctaccagccgcagcgactcccgagggatctcccaggacatcctatggccaggccctgaatactgcggatatggcggaatcagcggggaacgaagaccctgttgagcttgactctagtctggcacggtgaagagacgtgagagatggaaggat

SEQ ID NO: 682764 - DNA, 355 bp, Homo sapiens
tcagaacctctctctagttacagcaaccctgtatgcttgagtctctgctgccgcagcttctgcaggtaactctgcacctgtaggccagccttcacgccacctccagctctgctgattccatccagaactctctcttcacagtggcctctgccagcgagtgtgtgtccaacaccaccaccgtgtccaaggcacagtgagctgtccagagcgtgagtcctgccagaagctttgttcactgtgcaatgtgattggactgccagccagagtttaataaactgtaaccattgtgagttggcttccttctcgccttgttgtgagggcaatggagagaaggaagaaaacatatgctaacttg

SEQ ID NO: 682765 - DNA, 263 bp, Homo sapiens
cccccccccccctcccttgggggggccccccccggtcctggcccccttgttttacgccccctttttttgggccccccgggggtgtccccggggtcccccctttgggggggggccccccccgggcccccgggggggtttttttttttggggttccccccccggggttccccgggttccccctttttcccccccccccggggggggggcttttttccctttaagggggggttttgggggcctttcttggggggctttttttttta

SEQ ID NO: 682766 - DNA, 279 bp, Homo sapiens
tatcctcatgtacaaaacactcaatgaactatacaagaaaagatccataagatgacagagaggcacaattgaacgtagaaaaatctataggccaggtgcggtggctcacacttgtaatcccagcaccttgggaggctgaggcaggcagatcatgaggtcaggagatcgagaccatcctggctaacatggtgaaaccccgtctctactaaaaatacaaaaaattagccgagcgtggtggtaggcacctttttttctcagttactcgggaggctgaggcag

SEQ ID NO: 682767 - DNA, 191 bp, Homo sapiens
tctgttcactgaaggggcctttcctgtcgtggcagccaagtgcagagagagaggagacagtagagacatgcttacgccgttactttcatcagtatcagagacttttagtactttcactaatttgctactgctatctaaaaggcagagccagtgtgtacagagatgtctcaccgcatattgcaatggcgtac

SEQ ID NO: 682768 - DNA, 687 bp, Homo sapiens
agtgtgtgaaaagacgaagactgagcggttgtggtcgactgtagtcgatctccagactggcaagatgcagtgcttctctacgcagaacccgggagtaggacactgtcacgagatcgatctcgtcttgtccgcttccccttctggtgtagattttcccgatcttcagacgtacatgttgcggcctttggtgagacatgctataccaatcaaacaggagtgggcgatggggacgttaccgaatgagacagatcttcgctccatgaactcccgtgtctcattgggaatcgtcagcactcttgtggtcaagaaatctgatgtggaggcaaatcttgtcgaagtatggcaaaagttgtgggcgtgcttcgtgtacataagggcttgtcttcgttccagtatgttaatgagagaaatgcccggggttgtctgtaggcagggagagggatggcagcacgtgattgctggccaggtttggagatattaaaccgtggctgcagagcaagaagtgagccgaggaaacagcaggtgtgaaaccgattcttgccagggagattgtacggctcctcttttgactggactatgactttccaccgggactactgatgatcggatgtacagttcacccagaacgtgtactacatcctcctcctatgatcgggcttgtagtgacctcgaaagtcaggtgtatca

SEQ ID NO: 682769 - DNA, 298 bp, Homo sapiens
ggcgtccgtggggactggaatgctatgtctggagtcgaccgatggtgttgacgccaaccctggtgatcctgagacattactcgcgcacgtacgtgtgtgaaggggtcccccgctagagaacaaattagtcgtgtgggaagtggagcacgattcatttctgtatgtcacgtagagtctgaaaatgactggtgggtgagcaagcacattaaaaagccgattcggtccagatgtcctcagcttggattggcatcccaagcaagagtattgctggcaggaggatcatgtgatcttcaaatgg

SEQ ID NO: 682770 - DNA, 830 bp, Homo sapiens
gcttggaccgtgggggccgtgtcccccttcccattgagggccgaaaagaaggggtatacattaaggtggataagtcagtgccggagcctgcagatgaggtgcccaccccaggtgatgggatcctggagcatgacccgttcttctgcccacccactgaggccccagaccgtgacttcttggtggatgctctggtcaccctcctggtgcccctgctggtggccctgcttctcaccttgctgctggcctatgtcatgtgctgccggcgggagggaaggctgaagagagacctggtacctccgacatccagatggtccaccactgcaccatccacgggaacacagaggagctgcggcagatggcggccagccgcgaggtgccccggcactctccaccctgcccatgttcaatgtgcacacaggtgagcggttgcctccccgcgtgaacagcgccaggtgcccctcattctggaccagcactgacagccagcagtggttccaggtccagcctgaattcatcctcccttctctgtccacaccacgagtggacatcccactggtgattccagctcctggccctctggaaaccaggtctaaacaagcaggagaggggtggggtgggtgagaagtgtgtggagtaggacttcgattaattattgctggtccggtcaccattgtgtggagtttccaaaaaaaaaaaaaaaaaaaaaatttcggccgcgcgaaattttaacactttgggcggccattagaacggcaggcagaaacgccaaggggtcccaaaaccggccgtctaaacacggtgtttgtctcagcactcccgccccggagaag

SEQ ID NO: 682771 - DNA, 344 bp, Homo sapiens
cgctccacagtctcggacggatctgctcagaaagggagggtcacaaaacacgaagggggttccccctggcgcctgcctcttcctttctgagcagatccgtccgagactgtggagcggaatcgccagcccctgtgcaggatgggggcgtccaccagggcgtgtcgtgggtgggctgcttcagctgtgttgccgcgcctgtctgccacggcttcttctctggactgcgcctctgccctgtgcccgcggatccacctcggtcccggccaccagacacacctcgagcagcgccagaccactgtccgtcggcctttctgctgcttctgctgcgtgatagggcactccga

SEQ ID NO: 682772 - DNA, 439 bp, Homo sapiens
taaggtttggagggggaatgctgggaaatggtaatgggtttggaaacttgtcatataagtaaggctagggtgagtggtaggaatgtttttccataggaggtgtatgatgtgggtcgtaccggaatcgggggtatgctggtccgaattcataaagaacggggaggttacaatgtagggtctgggtgacaaaatatgtcggttgtaaagtctcaggggagagtgcgtcatatgtttgtccctaggaacgattggtagtgggtcgaggtgtgttcatacataataatgcgtcggttgttctccgcgctatgaacgaatagggccgaagggcgccttgcgagcgtaatacgattgtttgaaccgcctgcaaacatacttcgagactcccccttccggccaaggtcccaagggcggtccatggtattgcgtctcatgcaagtga

SEQ ID NO: 682773 - DNA, 338 bp, Homo sapiens
gaatgctgggcccctgctcaagtttaccctgatcccctcagggcataaagcatgtttcattttttgaaaaatggtttgtttcctgtttcagaccagcccccccatgcaacttcctttgactttttgtggacccctgggataaaggaatcaaaagggccatttagctttccatactttgaacaacccaatgtgccttgaatacttttaaacccaaggggctggatttgcaggtgggatgagggagacagaccccttttttatattgcagtgtgaatgctgggcccctgctcaagtttaccctgatccccccagggcataaagcatgtttccttttttta

SEQ ID NO: 682774 - DNA, 112 bp, Homo sapiens
ctcagtgcaaagaacaaagaactcatcttccaacaggcgtggaatcagataagaataatccacaaaatatctatctctttacagactcacagattgcttgcatgtttacggg

SEQ ID NO: 682775 - DNA, 140 bp, Homo sapiens
  misc_feature (41)..(41): n is a, c, g, or t
ggtgatagatctagagtataccctagagcgctatcgagcgnagcgaagattcaggacgagcagtgataaagagaaggaagaagtggacagaggaaagaaagtagccaggatcaccagaagaagctaaaaagccagatagt

SEQ ID NO: 682776 - DNA, 560 bp, Homo sapiens
cctctgggcgcccacggggcaaaagggggttttttccccaaaagcaagcggggtatatggtgcttataaactttgggacggggacctctcgcggtcccccccgcacgaggttgtctcttttttcgcgagcaagaccccccccgcgaattgttggtcggcgtggccgcgccctgctgacccccaacttcgagtattccgccccacgttgtggaattcccccaacgttttgttgctgagatgcagtatccatcaaagaagagagaaacttgcgggaagcccccaccacccagcgagaaggagtggagttttttgagccacccacgaaaaagaggggaaataattaggagtttacggggccgcgccaagagttgaatcacaggaaaactgtggggctccccacaattgttccccaaataccaaaggtatattcctcacggtccacggggaatacctcgcgagatactgtgtttggttctggacggaaggggaagatttattcccccccaaatggggttttaaaattttttaaaacccatataaaaacgggctttaaaaaaaaa

SEQ ID NO: 682777 - DNA, 365 bp, Homo sapiens
  misc_feature (347)..(347): n is a, c, g, or t
  misc_feature (359)..(359): n is a, c, g, or t
gggctgtggcaagtttaacatctccaattgctgtcttaacataggcaataatggagaagaggttctggaaatcgcttcaaacatcagaaaagtagcccgtgtaccagtccaaacctgggagggatgggacccagcaaaccttctaggagggtggttctctaatttaggaggatttaaaatgctggtggggacagtcattttcatcactggggtcctcctgtttctcccctgtgggtatcccattaaaactcttgtttgaaactacagtttaacctcctggacaatccaggatgatgctcctgctacagcgggcacgatgggatacccaacccgttttcttcaaggantacccccaaaanttaagt

SEQ ID NO: 682778 - DNA, 177 bp, Homo sapiens
atcagtttcctctctattaaactggagaatattttctgtaggtttaaatcatgcgcacagtatatgatctcttctattctgcagactttctttacccgtgcagaccatatggaaaactcggccattatataatatattaatctccccgggctcctgagcccactgagcgtcaagtag

SEQ ID NO: 682779 - DNA, 121 bp, Homo sapiens
ccgttggtcgcaagtcgaggctgcagctagccgaaactgttactgcattccagtctggacagctcacgcctgtaatcccagaatttggggaggctgaggcaggagaattgcttgagcccag

SEQ ID NO: 682780 - DNA, 128 bp, Homo sapiens
aacatacccagactgtgctaattacaaataatgaggtttaatttggacttacatgtttcacatgtgctggggaaggtctcactgatcactggcagagtggtgaaagagaattcttacatgtgcagagt

SEQ ID NO: 682781 - DNA, 311 bp, Homo sapiens
ggggggggttttacccccaatttttcccccacaaaaccaaggaaaacccgttttttcccccccaaattcccaggaaggcccccccttaaacggggggaggggcacccttgggtttcctttcttcttttttaaggccaaaaagggggccagggcttaaaggccaaaagttttccccttttttaaaagggggaaaaaaaaccctttttttaagggggcaagggccctttttctgtttccttttcccccccaaattttttccccgtttttggggccccgggggggaaaaaactggggttttttttcctttttga

SEQ ID NO: 682782 - DNA, 260 bp, Homo sapiens
  misc_feature (19)..(19): n is a, c, g, or t
  misc_feature (29)..(29): n is a, c, g, or t
  misc_feature (65)..(65): n is a, c, g, or t
  misc_feature (100)..(100): n is a, c, g, or t
  misc_feature (131)..(131): n is a, c, g, or t
  misc_feature (210)..(210): n is a, c, g, or t
  misc_feature (212)..(212): n is a, c, g, or t
ccgaggggaccctgctcanagccttctanatggtgctactgctcttggagtggacatgaccaganaccgcaccccctggatctggctgagggctcagganacaggcccagccaccccccagggccctccanaggccgctgcataacagcgatacagtacttaagtgtctgtgtagacaaccaaagaataaatgattcatggttttttatntnttggtttgttcagacaatggaaatttgcccattctgtcaaaaaaaaaa

SEQ ID NO: 682783 - DNA, 297 bp, Homo sapiens
actggggacgttgtacaaagagaaaccttatccactgggagcagtgctaccccccggatcctatatactccaagaagcagtgttgactctgggtcgctatttacgggtcgctcaccattcccatagccaaagaaataaatgtgggcctttagttcactgcaaactgtggaatatcttccggtttacatgttacatcgataaggtacagctgaatcagccttcaggacataaatcagaattattgaaaggctaagagttagaaactgagcacagcaaaggtctacgattctttgcaaa

SEQ ID NO: 682784 - DNA, 571 bp, Homo sapiens
  misc_feature (123)..(123): n is a, c, g, or t
  misc_feature (128)..(128): n is a, c, g, or t
  misc_feature (141)..(141): n is a, c, g, or t
ccagacaccattgcaaccatcgagtaagagatgcgtgagctattcaacatccctgcgggagcgtataacacggctctggatccaatacatgagcaactcctacgagcagttgagcaagctagncaacnctgtccaggatgntgggctatacagggtcaggtgctagtaattgagcctcaaaatgaagatggcacatggcccaggcagaccttgcagtcaaaaatctgtcattatgtcaggtgacatggcaaaagggactttgcagatgggattaagcacaatggccaggagcagtggctcatgcctgtagtcccagcactttgggaggccgaggtgggcggctcacctggggttgagagtttgagaccagcctgaccaacgtggagaaaccctgtctctgctaagggtgcagaattggccgggcgtggtggtgcatatctgtggtttcagctgcttgggaggctgaggcaggagaatcgcttgagcccgggaggcggaggttgcggggagctgggattgcgccattgcactctagcctggggaacaagagcgaaactccatctcaaaaaaa

SEQ ID NO: 682785 - DNA, 507 bp, Homo sapiens
  misc_feature (7)..(7): n is a, c, g, or t
  misc_feature (127)..(127): n is a, c, g, or t
  misc_feature (144)..(144): n is a, c, g, or t
  misc_feature (271)..(271): n is a, c, g, or t
  misc_feature (410)..(410): n is a, c, g, or t
  misc_feature (441)..(441): n is a, c, g, or t
gccactnacttttaaaaaaggacatggctaccgtctaggtagaacaattaaggcctctagaaaaccctgtctaaagaggcctctggttattataaaagaatgggcatcctgtgtgaaatacagtagnagtcgactggggccccnagatgtttcttcagtctgctcctttccccatgcagagaactgtgacatgtggttcaccaaaatagaacttttcatttttactaatcatttgttattaaaacaggatttagaaatgctttggtgaggncagctcatgcctgtaatcccagcactttgggaggccgaggtgggtggatcacttgaggtcaggagttcgagaccagcctggccaacatggtgaaaccttgtttctactaaaaacacaaaaaattagccaggtatggtgnggggcacctgttatcccagctactcaggtgntgaggcagaagaatcacttgaacctgggaggagagcttgcggtgagccaagatcccgccactgcac

SEQ ID NO: 682786 - DNA, 177 bp, Homo sapiens
  misc_feature (69)..(69): n is a, c, g, or t
  misc_feature (177)..(177): n is a, c, g, or t
gtacgtgataatctgacactatggacttcagacatgcagggtgacggtgaagagcagaataaagaagcnttgcaggacgtggaagacgaaaatcagttagacataagccaacaagagaaaccatctttgaccagcccctgcttcccattccaacctttggaaactccccaatgtttn

SEQ ID NO: 682787 - DNA, 188 bp, Homo sapiens
ttatagaggatcccggtacgagcggtctgcgtataattctgaggggaacacatacaaaccgttgtgatacaagatgggttgagtgcaagggaagtccagagctggaccagaagagcgcctggcagttatgtagtccactcattcctcttacaggtaaaaaacagaggcagagagaaatcaagtgattt

SEQ ID NO: 682788 - DNA, 892 bp, Homo sapiens
atctcccgagcgacataagtatgatagacaagatgcacaattgtctcatatcttaccgaagagtagtatatccggtcagatctcagattctcgactcgatatggcctagaaggggttaatacttatcgggtgtgtccactttatacgctaactctttcagtaagcgctggattcaggctcaactacctcaactatacgtcccagaacggcggagcacaattgacaatcccgtagtgctttgatcgctgtgccgaacgaatagagggctgaggtccctcgagtccgtacctacctatcacctaccgcaatcagtattatggtcctgagactagggtccatagagtctatccctaagtcatacagctcagatttggagagggtaacggagtagattgaatatttaactgaagttacgtgcagaattgacttggcgctattaaagaaatatcattacttcgtgggagattacattacaaagcaatgtatgacaggaggaaaactaagtgagaggctcgatgcacgttctatgtattgggggacaaagtcaaaagtaaggaacatcacaggcatatgaaggcttgttatccgaatcattgaatgtacaaggacaacaaagaaagtattagcagcttcattaagtagtgttccctagattggattgcttaaccacattcagaatgcaaatggccgggacagtcgtcaaaccctaatccaagtgatccacccgatacacgaaccgcgaagttttaccacggggcaaatgcactggcactcgtgtgtgcagaacacatagatattgcccatccgccgtagaatcagttccaaaaacttcttgaacccaggccggtattacttagtgaaaaccccgtacgctaaaagcgaaagattaccg

SEQ ID NO: 682789 - DNA, 816 bp, Homo sapiens
tctgaggcttcattcctgaagccggcaagatcacaaacccagggggaggaacaaacaactctggacttgccacctttaagagctgtaacactcactgcaaaggtctgcggcttcactcctgaagtcagcgagaccacgaacccaccagaaggaagaaattccggacacatctgaacatctgaaggaacaaactccagccacaccatttttaagaactgtaacgctcaccgtgagggtccatggcttcattcctgaagtccgcgagaccaagaacccactggaaggaataaattccagacacagtggcagctggcactgtgctgcttacagatcaaagacctacaggattacaagacacgtggctgagaaagagaagggaaggtggagccgccatgttgaacatgtctagtccctagttcctgctggtattcaccaatgcaagctcccagcttgcttgcctatgtctgcagcttgactttcaggctgctcttaggaaaaaaagatttggggctgcttttccttaaaaaaaaagccttacagggcttccatacccttactatctggcttaagggatttcttcttaactcctgtgatcggaagaagcaaaaatttttaccatccctccttaaaaagttggagttaattttaatagttaatatacacagtaacttgttaaatatcacattggtttagagaatttacctgaccttttgaaataccggttatttagcgtcatttcgtggcgtcgggacgggtggatcggatgcccctatgatggtaataccgcggtgacacttggatttattgttttgtttg

SEQ ID NO: 682790 - DNA, 931 bp, Homo sapiens
gctggaccttcccggggtggactgggtgggcggcggctcttcccaggtggaccaggtggtgcggctggctccgtgggagcggtcgcctggaccttcccggggtggaccgggtgggtggccggctcttcccccggtggacagggtgggcgccggctccgcgggacggtcacctgaagccaggcccggactgcacacctgcttcttcgcatcaaagccacgaagaggcgtccaagaaaaggcgttgcagcccagaggcaagaacagtcagagtcgccaagagcaggaacgaggacggggcggagcagcgcctatgccaggaagggggtcatggggatcagcgaaggccaagagaggaagagagaacatctggggaaaagaagagctggggtgggcctgactggtgctgactcacacccctgagccctgcttagaagtcaggggcatctgcctgctttgactttggaggctcctcccacacccaaactgccggcacatgacgtgcagctgggtggactgggcatggatgtctcacacctgagctgcacagaccagaggaagccacggctcaagggcccaaggtcatttctgcgcagcccgcacggccgggggcttttcctctggggatcagttggcccaaggtctcttctggagcatgctcagggacttgctgtgcctggaaggccagggcagctgatttctcctggtgccatggcacttttctttgcttccagaggcattcactgggacccctgtaatttctctgggaccctttttgaatctgagggtcttcttcttggattgcggaggttgatggaggcagcgctgtgggccttagggaccttctgtgttccagggactggatccttccaggatggtggcgttctcctgttcaggggcttcagggctcctccatttcagaaggggcatatcc

SEQ ID NO: 682791 - DNA, 751 bp, Homo sapiens
gctactgctaagatgaagactatctcaggagtcagactgacgagagttcgatcaatatgtctaagattagatcgggcatgaaggcacagcactcgtgatgtgccccataggaaccctggggacagaccctcgttcacatgactgtagaactcagccttgttgtgtgatagtctcaagagggctgcgtgtttagaacagatgaggtcggggtagactggagcaggaacgaagtgataccggctctggactaatatattgtcagtcctgttcacgtagcaatagtgtcacagggttgtacacttggcgttaccagattaccacagagtgaagtggtcttgcttatcgctcacatatcccctagtcgtaccgatttgttctccaagggctgactgcgcgttctcgttgttagacactccgaagattgtcgaaggagtgaccgatagctttccgtgacgtgtctgccgcgagtgcctagccatgggtgttgaccttgattcaggtagtcatcaaagtcacgcagtacaggaatgaccttacattcctgttgtcaagggacccatgaccgggttgcacgcctttgattccagaggaatgtcaggacgtgacttgtgagaattcagtgcaacgcgcagaaagatgtagaaaaaaaactggggattgatcagaggacgaggtgtccaagggaataggtagatctacctggtctcgtgagtaggaaggaaaggaatgttacgaaacaaggggttgagtg

SEQ ID NO: 682792 - DNA, 80 bp, Homo sapiens
cctaggtgcgctgctgagcgcgctgctggacctgcgcacaggcggtggagccggtatgggcccgcctggccctgggcgcc

SEQ ID NO: 682793 - DNA, 481 bp, Homo sapiens
  misc_feature (453)..(453): n is a, c, g, or t
cactgtgtacgcacaggaggtcatgtgttctatcaagcccactgacaactagaggcccagggctctggccagagctggagttgtggtcattgcagagaatgagcgtgagaatgacggggagtggggggcccgtagccctggcgtggcgcccacgtcatggggcaaagctggctgtgtcctaggcaccctccacaaccgccccagtgctgggcctgccttccgaggccactgccgatgtacggggaagccccatggattgtcgaggcagacctggcatccgccactctctggcgtggtcttccttccaaggcctggggcagcagtgttgggggtcccggagcaggtggggagatagtgccttctctaccttttctggtgcctttctggtactgctggcagtaagcagctggaaggaccagcaggtggcactgggctcatgcgggtggtgactgngacccggcgtaaggaaacagaaaggctc

SEQ ID NO: 682794 - DNA, 187 bp, Homo sapiens
attcgcggccgcgtcgactggaatggaatggaatgaacatgcattggattcaactcgattgcaatggaatggagtagaatggaatggaatggaatggaatggaatttattttaatagaatggaatggaggggaatggttcggaacggaacggtgcggaacgtattggaagggcttgtaatggaatgg

SEQ ID NO: 682795 - DNA, 102 bp, Homo sapiens
ctacatttggaactgatatgaggacttcacctcatccactattggccaccatgtaacgtagtgtgtagagcagggaagggaactgtatcctgcctatattta

SEQ ID NO: 682796 - DNA, 673 bp, Homo sapiens
  misc_feature (86)..(86): n is a, c, g, or t
tgatggcgctgatgacaccattacgagatcgcgtttccccgtccgaatgatcgcctcggctggcaccagtaggctgtcatcctgtngcccggacggatggagggaaacctgcgcggtcatgcctgggcgcaaccggccgccggggttgggcagttctatacgaggccgcaaggtgcggctttgcagatccgcatcagccagcaatgcggtcagcttgccgggaacaggttcgcctgggaacgctgccagattcgcctgcactgcctgtccctcctgtaagtgatggcgctgatgacacctagtgtcgacatgagttacgccgagtgatagggcttgctcggcggatagtagttttggcccgtaatgctcattgtgccaagctttgacttccgtttgcagcgaggcgaacacaggcagtttcttctgataatccaagataatacctgtacggtatctctccatcattattgcgattgccgaagatactacgtgctgcccataactcaattgggctgtgaaggtgttcatgtgctttggcatggaggtagaggccccctcccatgatggcgacgcctacgaggacaagggccgctgcggcccaaccggcgaaggggacaaacgatgtggcgcctgcaacggcaagtctgcctcaagggtgtcatcagcgccatca

SEQ ID NO: 682797 - DNA, 581 bp, Homo sapiens
tcggcggggggcatgggatagtcgtcgaactgggacggcttcacccaggccagcgcctgatgctcacgccgctccacgaacccctcccagcgccgcaacagatagagcggcatgaggaggtgaaagtcctcgtaggtatggctggcgaagacgaagggggcgaggcaggcctgggccgcccgaattcccagctcctcctccagctcgcgcaccagacaggcctccggcgtctcgccggcttcgagcttgccgccgggaaattcccacaggccggcgagctgcttgccctctggtcgctggcagatcagcacccggccgtccacgtccaccagggcggcggcggccacgatcagcatcttcatgcgtctgttcccttgttgagaccgcctttagacctcccgcgccagggtggccactgatgtcgccgctcctcgcccagctctatcgcgccttcgccgaggccccggccctcaccgggcggcgcttgcaggtctatctgtggctcttgtttggtctcaacccgcggtggcgctgatctggctcgggctcgccgtgatgcacgggggtctggcgcagaccgg

SEQ ID NO: 682798 - DNA, 154 bp, Homo sapiens
ctcgagctcggtaccgggttcattcatttctctaacagcagtaatattaagtaatttcatgattgagaagcttcgttcgaaagcgagatgtcctaatagtagaagaaccctccataaacctggagtgactatatggatgccccccgcccgctag

SEQ ID NO: 682799 - DNA, 356 bp, Homo sapiens
gaagatatatatatacatatatatatatatatatatatatatacacacacacaatttcttattaggtctctatggtgctttggcattcaagtcaaaaaaactggtccagacatctcaggatttcactggtctgtctggctgcacagcttgctgtggcctagaaaataaatttcttccttgcaattgttgtggacttttcctaccattttgaatgaagtcactcacagcagagccacagccactgtcggtagtttatcagactgctgatatttcagggagacgaacaaaaagttaatgcattattgagacttaaaatagcaaataaatgcagattatttttaaaaacccaaaaagcc

SEQ ID NO: 682800 - DNA, 136 bp, Homo sapiens
  misc_feature (9)..(9): n is a, c, g, or t
  misc_feature (11)..(11): n is a, c, g, or t
  misc_feature (35)..(35): n is a, c, g, or t
gttacggtngncgaaatacccagtggtgtatttgngttgctggggtaggtgcgaggagcccgaatgcctgctttgtggaaacatcatgtcaatcgcggcggggggcgcgggctgcgccccggctaagcgccccggc

SEQ ID NO: 682801 - DNA, 181 bp, Homo sapiens
ttgtcataccccttcgtgcgcgtgacatcttcccagtgagcacttcagagaccagcggcaattctctcacccaggctctctagtccagccaggcctagccattcagggaccatgaaccggttcctttctggtgggccctggaagaagggatcccatcatacccagctttcagcaaggtatt

SEQ ID NO: 682802 - DNA, 148 bp, Homo sapiens
tacttaacgacaggatatgggtagggggcgttctgtccatccagccctggccccagcccatgtggttttggcagcaataaggggtatggggtaagggggcaccaacacataacaatggtttgtagtgtgtatggtcggtgctttgggt

SEQ ID NO: 682803 - DNA, 295 bp, Homo sapiens
cgaaggataggaagctcggttctacaaggcggtcgacgatctccgggccgctcgacgatcgacagcgacaattacaaggcgatcatcgagctcggcatgaatttcggcatcgccgcgcgcgacagcaggcggcgcggtgttcgagatcgccgccgaaagcgcgccgaccgtcgcgctgccgcaatatctctacggccactttctgatcaatcaccgcgcgttcgagcgcgggctcagctatgtcgattcgcgcgctggcgattgatccgctgcaggcggagaatcatgtcggccg

SEQ ID NO: 682804 - DNA, 115 bp, Homo sapiens
caactagactggacagatacggaaattgagtgatgtaaaatggttgtcggcctggtagctgagcagtttatcagtggaaaactgaaaacactaaaatgtccaccggggatcctct

SEQ ID NO: 682805 - DNA, 430 bp, Homo sapiens
ccacgccctgttccatgcctgggaccagaagtgcagagagccgctgttctctgctccctcccgtcaaacacttgtccccacaatggtggtcgccggaggtgtctggaccaccgcagggtccatgcggtgccttgtgcccttggtcctgaagccgtagttttgcttggatccagctcctcagtgtcgtgatccatgcaggctggacgagggcgtccttcagagggcccttggcctccatgctggaagctgcgctggacgagttgcagaggaggatctaccgacttggtagtatggaggcgctgtcagcgcggagctcctatgctgctgctggtctgaggccgagtctgtgcctgtggtgctctcagtagcctgagcgcgctgattcaaggccgctctggttgtgccgcgtgagcccgacgagaggaccctg

SEQ ID NO: 682806 - DNA, 548 bp, Homo sapiens
tttggtgagccagcccggaggaagagtgagtcatcatctgtttcatttatctggcattcctaagctacctttgtcgggctgcaggaattaatggaacacaccagtttctaagcaaactttttggattttaggcttcctgatgcttcaagcagggtcaccaggaccgctcagggagagagaacccagaaacctagcatgccagcaaaaggatggatcagagggcccctgaatcatccagaaaagagtgtattttcacaggtaaagaaagctttttatggtttaaatcttctggaaacattagagaaagactgtcattgctatccacactacaacaaaacttcatccacactacagcaagactttgggctttggattcatggcctcaaaactgagaagggtccctccacatttttggaactgtgcacccattggaacccttgagggaaagctaaccagggaaatttgaagaggatgccatccttgatgggaacagcttttcccaaggtcacagattaagacttatattgtcatgaaaatcttacctttga

SEQ ID NO: 682807 - DNA, 1230 bp, Homo sapiens
gccggggcgggggggcacccggagtggggcggggactcaccctttagctgctcgggtccttgaccgcttcgcacaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682808 - DNA, 353 bp, Homo sapiens
ttagggctgttgaagaggggctatgctatctgtctccacctgagactggctccctgccagtgttgctcttctgcatcctccttcatctctgatgtcagtgggatggtctcctgaggaagcctctgccttggccttgtactcctcctcagaccagcctctcaaacataattggcatagagcttccttctcccgggcaagctgacttcggatccgctgctggcacacagccagctgggtcttggcgggctttgttgtaggggtagagctgcaggaccttctgaaaatcagcccgtgccagttcacaagtccattcacggccaaggtgggcctctccccggcggcagcggcccttt

SEQ ID NO: 682809 - DNA, 1266 bp, Homo sapiens
ggccttgagccgcggcgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682810 - DNA, 2129 bp, Homo sapiens
ggccttgagccgcggcgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctggtgggttgtaatcctatatgggcttcctttagggaagtgtgtctacatttctgtgacgtccagtccccaaccttgctgtgtgtagaaaggggtttgggttatttagtgactatactactcatggaaataggtcttagctagtgttgcttcctgctgggcaccctgtctggtttctggtgcttgcgctcccaggcccccggtaggagctcacagagggcttgctgagggcagggctgctgctccgcagagaacagacttggccctctgtgtcactccccggtacgtctgtgtttatgttggacttatacgtacctctggttggtctcatcttgataaggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgaggtgggcgaatcacgaggtcaggagatggagaccatcctgactaacatggtgaaaccccgtctctactaaaagtacaaaaaattagccaggcgtggtggcgggtgtctgtagtcccagttacttgggaggctgaggcaggagaatcacttgaaccctgaaccctggaggcggagtttcagtgagccgagatcgtgccactgcactcggagcgagacttcgtctcaaaaaataaattaattaattaaaaaatgcagttttgctctcccagtgccaggtctgtgaggcccaggggaggaagtttggcagcggggcattgctgctgtctttttctttttccccagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682811 - DNA, 502 bp, Homo sapiens
  misc_feature (175)..(175): n is a, c, g, or t
  misc_feature (177)..(177): n is a, c, g, or t
ggtcgacgatgtcatggagccgacactgttcgcgactaaacgaagggggtggcggctgtaccaggttagtcgaccggccaataggaaaccggcgcacccgagggtgcctacgcacagccaccataaacctgggggcataaaaaacgccggccataaggtatgggggcgctgctgntngagctcgggcgactaaacccgttcactgcaattgggcagtgacaaacggagactagtcacgtggctggacaggcgcaaggcgttgggattttctaggaaatgtcgctcaagaaaaagcgatttgtctggtgctgaggttgttctgcccaggttttttcaatcccggtgagtgaatgggttggcctcaacactgccgtcttgaggccgaacacggaccttgtaggagtagggctatgcgccggagggggccttgaggacggcaaaagcttctcgagcagccctctcctacaggttcccggtgtctttaggtcgacacggcgcaatt

SEQ ID NO: 682812 - DNA, 1697 bp, Homo sapiens
gccggggcgggggggcacccggagtggggcggggactcaccctttagctgctcgggtccttgaccgcttcgcacaggtgggcaccaatcttactgacatcgtggcacagagaaagatcaccatccgggagcttggggggtgcatgggccccatctggtccagttactatggaaactgccgttctctcctgggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgaggtgggcgaatcacgaggtcaggagatggagaccatcctgactaacatggtgaaaccccgtctctactaaaagtacaaaaaattagccaggcgtggtggcgggtgtctgtagtcccagttacttgggaggctgaggcaggagaatcacttgaaccctgaaccctggaggcggagtttcagtgagccgagatcgtgccactgcactcggagcgagacttcgtctcaaaaaataaattaattaattaaaaaatgcagttttgctctcccagtgccaggtctgtgaggcccaggggaggaagtttggcagcggggcattgctgctgtctttttctttttccccagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682813 - DNA, 1356 bp, Homo sapiens
gccggggcgggggggcacccggagtggggcggggactcaccctttagctgctcgggtccttgaccgcttcgcacaggtgggcaccaatcttactgacatcgtggcacagagaaagatcaccatccgggagcttggggggtgcatgggccccatctggtccagttactatggaaactgccgttctctcctgggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682814 - DNA, 1452 bp, Homo sapiens
ggccttgagccgcggcgccgagctacgggtgccgggtggagcgaagcacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgggcctgtgccgcggataccagtatggagaactgatggccacatgaggacagagacgagtgacaccaggtcgtcttcataaaactcgattccctctgcttctgcttgttcccaaagctttgtttaaagctactttgggccgggcgcggtggcttactcctgtaatcccagcactttgggaagctgagtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattgactgcacggcagaggcgcagctggcctgagctggggagaggtggcagagggcagtatggctttgctgccaatagtttcttctcacaggggcagaataacccaaagtaaccctacatgatggggctctgtgctgagatgcaatgatgtgtaaactgaggcatgtggagatggaagttgacatctggcctctgaaaaaagtgtccccaggggctaggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactgcacctgggcaacaagagtgaaactccgtcttaaaaaatataagaaataaaaaaataaaaacctgaaaaaaaaaaagacacacccaaaagaaaaaaatccggggctcccaagcgccgggcgcggaaaaggcggtaacgcatgcgcaatgggcaataacgggtcccggaccaagtttctggtccaagggggaatcggcgggcccctaaaggagcggataaattcaaaccaggtacga

SEQ ID NO: 682815 - DNA, 312 bp, Homo sapiens
actcagatgagcctggtcgcagaagggggaagcctttttagtatctactgcaatgctgtcggatagagggtgatatctgatgcaagctgcacaggactacatggggtcttcgttgcagagtccttaacagtttatttgtgatagtatccaatgtctgaaggagtcgtagctgattatcccattcaagggtatcatttctttcatcgggtaatggcgacactagctgtgatgttaaaaattaacttacttttatagtcagatcatggggcacttcttttaatccgtgaggacttggcattgccgatgcttgtg

SEQ ID NO: 682816 - DNA, 109 bp, Homo sapiens
ggaccctttccacaggcaagaataattagaacattcatcttggtatataatttctcctgtctcatatttatcaacatgaaacaggttctgcattccttagaattattag

SEQ ID NO: 682817 - DNA, 152 bp, Homo sapiens
agctactctagaggatcttgcgagtgcaatggtattcacaggcgcgatccactactgatcagcacgggagttttgacctgctccgtttccgaactgtgctggttcaacccctcctttatggcaactggttgtccccccggttccggggaggt

SEQ ID NO: 682818 - DNA, 176 bp, Homo sapiens
atcttatgcctcctagaaggagtccaaggctgagcgcgtggtcagtagcgcactacttctgggagctcagaacccgctctcccaggctgatcgcgctcctcagctgtttgcagatccccgtcctccaccctctgctcccgttcctgtggtatcatcattggggtctagggcttcct

SEQ ID NO: 682819 - DNA, 457 bp, Homo sapiens
  misc_feature (24)..(24): n is a, c, g, or t
gggataagtccctctaactccttntgcaatacctacaagaatttcactcaaagatgaggcattttcctttggctgcttgaaggtttttctgtgcaatacaagaaggcaaaggcaggacgactcagcacaccccatgcagaaagaaacgactgggttaagatttgtgttcttactcatctctcctgttcacctttgtttactgtaatttgcagaaaagagggggtacaagagaagctgaatgatgggggatactcctcttttctgtctacaagaaagctgagttacacctaggaaccagagctacctcttcttggtttttaggaaaataaccactgaagacagaactaaggaagaatctggaaaggtgtggtcacttccttggctacattctaacactcatttttataaccatcactagcaatcagtcttaagagataaaagtttatttggaaaaaaa

SEQ ID NO: 682820 - DNA, 140 bp, Homo sapiens
gggcccccattttttttttggtcccaaaaccttttttataaaacacaaaagcctttttttaaaattaatcccgaaaatttttaatgtttaaaaaaaaaagtttgtttatacccaaaatttaaaaaccccccctttggcca

SEQ ID NO: 682821 - DNA, 179 bp, Homo sapiens
  misc_feature (154)..(154): n is a, c, g, or t
ggcccaggttcttatgttactgctgctatgggtatctggtacctgtggggacattgtagatccgcagaacattcagctcgtaaacgctaatggcagctggcacatcaacaggactgccttgaattgcaatgagtcctcaacactgggtctgcgntgttctatgtaacagtcactgtcga

SEQ ID NO: 682822 - DNA, 648 bp, Homo sapiens
ccagcctgggcaacatggtgaaaccccgtctctaccaaaaataaaaataaaaattatccaggcgtggtggcatgtgcctatagccccagctactcaggaagctaaagcacgagaattatgtgcatcctggaggtgaaggttgcagtgagccaagatcacaccactccactccagtctggacaacagagtgagaccctgtgtcaaaaaaaaaaaaaagaaagaaagaaagaaaaatattgctttatggcccagtgcagtgggctcacgcctataatctctagcacttgggaaggctacggccaggaggattggcttgaggccaggagtccaacacaaaagcctgggcaactttggacaatgaccccaaacttctcacaacaaaacgaaaaattgggccgggagcggtgatgtcgtgcctgtagtcccagttactcgggagactgaggtggcgagaatcacttgagcctggcgaggttcgagcgctgcagtgacgctgtgtttataccatctgcaatccagcctgctgggctaaacagcagcaagactccatctcaaaaacgaaaagacaacatgcttcgcttaccataatgaggccaggcgatacacaccaagcgtcctgtggacaaccctctttccacaaaccatccg

SEQ ID NO: 682823 - DNA, 761 bp, Homo sapiens
agcgcggtggcgggccgggccgagagaccccagaaaggccccgatttccgcagacgaagaatcctgatggcaggcactctaatctcaggtggacatggagtgcaggtcccatgcgagccatcgtgcctgacgtgggtgctagcaacatgaccttgtgaatgtgatcctgcatagaagcctgtggagtggagccgtccacctccatagccttaggtaccgatggaatccatcttatggggcttggtccagcttgactctgggcaactggcaagctgctacctggtcgagcgaaccccttgatgcggtcccacgtcaggagatggaacagcaactagggatgaacagtcgagggcgcctgtgatcacttcactaccgaagatatacgtccgtgctcgagcaaggtgctctgaggcccctggacattgcagcacgtcccttcccctggaaaccaccctcccaaactgtggcccgttctgccagtccgactttctcgggacatggcggggcctaaataggcggcctttacagccgcatgggcaagtcatcgcacgggtaatcgcctcgatgagacgcttccttgggccatgtagcccttgggtatcctgggcgaatatggccgaaaccaattgactcctttcaccccttagggcggggccccctgagacatttgtggcattaacccaacctaccttcacaggaaacagcacacacggggggctagttagaaagcccactagacttggctccttaaccccttaata

SEQ ID NO: 682824 - DNA, 113 bp, Homo sapiens
tgctggtgacttagaggatcccctcgcggaacgtgttatcccccgggctagtcggggctgtcgggctagtcggggactgtcgggctagtcggggactgtcgggctagtcgggg

SEQ ID NO: 682825 - DNA, 224 bp, Homo sapiens
  misc_feature (136)..(136): n is a, c, g, or t
atggattgatcgtcgggtgcaaatttgagcattattacaagagctttctgtagaggtattctgttcaaataaaacagatctcaaatacaacataagctgaactacttgattttttttctccctctagttaccaagngaatatcggtatctcagatgcatggcctactatcacactggtctttaaaggaaaagaagcccagggaggggggggccccgggcccagg

SEQ ID NO: 682826 - DNA, 339 bp, Homo sapiens
tgctgggattacgggcgtaagccaccacgccgggccctggagtgcagcagttttatcatagcttactgcagccttgaattcctgggctcaagccgtcttccagtctcagtctcctgagtagcagggactacaggatgtgttgccaccatgcctggctagtttttaaatttttagtagagatgggggggatttcactatattgtccaggctggtctctaactccttacctctagtgattttcccaccttggcctcccaaagtgctgggattataggcatgatccactgtgcctggcccagaggccatatttttaacttctctgttatatttcttagtttc

SEQ ID NO: 682827 - DNA, 437 bp, Homo sapiens
  misc_feature (4)..(4): n is a, c, g, or t
  misc_feature (10)..(10): n is a, c, g, or t
  misc_feature (30)..(30): n is a, c, g, or t
  misc_feature (80)..(80): n is a, c, g, or t
  misc_feature (86)..(86): n is a, c, g, or t
  misc_feature (90)..(90): n is a, c, g, or t
  misc_feature (102)..(102): n is a, c, g, or t
  misc_feature (107)..(107): n is a, c, g, or t
  misc_feature (110)..(111): n is a, c, g, or t
  misc_feature (122)..(122): n is a, c, g, or t
accncggggngcttcaaaatgccaaatgancgtatacttgagccttattcatagattttgtatttgagaatttgcctacnccactnaaanaatgtttttaanccccnaannaatactgtggnactttctcagttattcgcagacacacagagacaaaaaatttgaaattcctggcttggcctggtgcttacccctgtaaacccaacactttgggaggccgaggcaggcgggtcacaaggtcaagaggtcgagaccatcctggccaacatggtgaaaccccgtctctactaaaaatacaaaaattagctgggcatggtggggcatgcctgtagtcccagctactcagaagggtgaggcaggagaattgcctgaacccgcgaggcggagactgcagtgagccgagatcgcaccactgagctccagcctggtgacagagc

SEQ ID NO: 682828 - DNA, 209 bp, Homo sapiens
aggtactctagaggattccctcgaatcgacggtatctccatagtgaggctgtgtctctgaactccgtgatctcaggtgatccacccaccttggctcccaaagtgctcggattacaagtgtgagccaccacgcccagatatttttattttttttaaactggaaccggggtctcaattctgtaaccacaaattgaatgtgcagttgtgcca

SEQ ID NO: 682829 - DNA, 111 bp, Homo sapiens
caaaacgtagatcccaggccccactcagtgtgactctgatgcaggtagtcagaggctcaaacttcagcaattcttaacataagcagttcttaaattcatcggcaagtcgca

SEQ ID NO: 682830 - DNA, 128 bp, Homo sapiens
ataattagtgtaaacaatatggttggtgctgaacacctgatttctttgagaaagtctggaattttggtatgtggcaggcaaaatgtgactgcccctaataaaaatcctgacactgagtctctaatgag

SEQ ID NO: 682831 - DNA, 483 bp, Homo sapiens
tagttcctataaaacatgctcgtgagattcagtgtgcgtctttgtgtgcgtgtgtgtgaatgtgtgtgtgactgtatgcgtgtggctgtgtgtgaatgtgtgtgtgtatgtggatgtgtgtggactgtgtgtgtacatgtgagtgtgacctgagtctgtggactgtgtgtgcctgtgtgcctgtgtatgtgtgggtgtgacctgtgtgtgtacaggtgattgtgagtgtgtgactgcgtgtgtgacctgcgtgagtgtgtgacctgaatgtgtgacgtgataatgtgtgtgtgaatggatgtgtgtgtgaatgcgtatgtgtgcatgtgcatgcgtccgtcggaccatacaggctactttgggacagttggtactgcaagcattaccacttaaagaggacccagagcttctgaccaactgtcaaccttgaacaaattgtggactttggtcagtgaacagacccgggtaatgcgtccgtcggcg

SEQ ID NO: 682832 - DNA, 731 bp, Homo sapiens
agcgggttgccatggcgactatgtacacagccaggcagccccgcgtggggagtgcaggtggtttcggttgcggcagtcgcgtcccgtggagcgtcgcatgtgctggtgaacgctagaatgggtactaggaagaacaagttcatgcatttggtcccgtgtgaaacccaccgagtgactttgctcatgaaatgactcgacgatacgggagagtgatcaacaagagagcacttgactattcacctgtaagaaacagactattcggaggaggaggttgtgcaaataaccacacggacaggactggtcgtattaaggttggatggagttcttcacgatgcctcccaggactaggtttagtgagacaggttgcaagggatgtgcgtttctcaggccctcgatggctataattggcatccatcagtgtgttagtcgggcatgatctgggagctggcaagacgatatcaccgatgatgggggcaacatgagaattacaacgcgaccgggggactcctccctcgtgccctgcaggaggtttaaaggatgatcgaagaacgccccagagcatgccagtcacctgtgcgtgtttaccgtacttggaatatctactaatgagagcctggtatgatctcctgttcacttctggcctaatgattggaccctcagtcacaccaatgagcatcggtggaagaacctcaaggagtcttacattaagggcttgtcgagttcagctcaaa

SEQ ID NO: 682833 - DNA, 309 bp, Homo sapiens
gacccccattattgtgggtgttttgtttttcttaagcattattttaattttcggcagagatggggtttcaccatgttcaccaggctgatctcaaactcctgacctgtagtgatccaccctcctcagcctcccaaagtgctgggattacaggcatgagccactgcgcccggcctctatcctttgacaattaaaggaaacagggaaccttggagaaatggttgattctaggactgaagcaggaaatatacaagatgtacctgaagcatgttgtagtgccagaaagtaagataatgcttaagaaagtcgacg

SEQ ID NO: 682834 - DNA, 165 bp, Homo sapiens
tttttgggggcccccccccccccggggttttttttaaagggggccccccccccccccccccccccggttgggggggggggtggggtttttggggggggggcccccccccccccccccgggggggtttttccaaaaaaataataaagcggggccccctttttttta

SEQ ID NO: 682835 - DNA, 166 bp, Homo sapiens
gagcggccgttttcaaaggctaggatgtagcgattccctctttgtgggctttgtagaagtggtcgatgccctagccaaggccgaggatgagacatattaccgggctgtggctcatagtctttcaaatttacttcatactcgtcttcatttatgtactggtgtcgga

SEQ ID NO: 682836 - DNA, 171 bp, Homo sapiens
taaggtcatccttccccacaggggtggctttgggattggatgaaacagcttttgcttgtgtgtagtaaacctgtacatacttgtttcaggcagcctttgtttaatgttttcagttggtttgtattctgtagctcagtaactgctaataaagttaaagatcctgtaaaaaaa

SEQ ID NO: 682837 - DNA, 397 bp, Homo sapiens
tttgtgaccagatatatgccatagaaacttcactctgtttatatcaaatgtgcctgttgtgaactgggtttctattcattatttatacacttatattcactagtttatacatcgtttagcttaaagtcctagttgccaataacatattgatgattattagtgagaacttactgtcgttgattgtgatgactctctttcggtctactgcaacgtgttttacgtgctactatatttctctctaagcgtgggttgatctgcatccaataaattgtgatgttgtgttttcctcttcttttcaattaaaaatattttctaattccccacagcactttctctttgatacatggttagtaagaagtgtattgtttaatttccatatgtttgtgaattttccaga

SEQ ID NO: 682838 - DNA, 186 bp, Homo sapiens
tcattgagaaatcagcgcattaagtaacagccatcccggtgacagtccatttaggtaacagccatttaggtaacagccatataggtaagcagccatctaggtaagcagccatttaggtaacagccatttaggtaacagccatctaggtaacagccttttaggtaacagccatctaggtaacagcca

SEQ ID NO: 682839 - DNA, 759 bp, Homo sapiens
cccatcaggaattatggccatttggtgacttccagctcacatagtgccatctcagaatgagtgaacccggtgtgcactcagggagggagacatttgagttctccagacctacttaaggcaaatatgttccttatgaatgaggttcctctccttgttttacacttcctttactttgatctcttgcctctggtttttaatgagcaggagctttgtaggaaggtgaggagaatttttgtcatctatagcctgagcagaggggagttgaaggtgaatatgtgtgggcatatacacacacatgtatgtaagtatatgtgcatatatatgtgtgcatctgtgagcatgtggttgtatgtgcacactgaacagtttgctggtctaggcattaagggtattgtctagatgataataataataatatctaatctttatgaagtaacatgttcaggcagtgctctaagcatttaatgcctacaatatctatggcagcaggtactgaagatagtatcacattgggcagatgagggaaactgaggcacagaggtatcgaagacaatccacctgagcgtcacacaggctagaaaactgagaacagctcaggctaacagaccccaggatgggcgtgatccaaggctccgaactgaggccaatccaactgacaacgggaagccctatgggaggcaagaagaccacccacatgacccagatagagcgactctcgtctaaaccgcgcacaggccccaagaagggcagaagccacaa

SEQ ID NO: 682840 - DNA, 245 bp, Homo sapiens
aacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctataataaatctgcctttcttcaccctcaaaaa

SEQ ID NO: 682841 - DNA, 223 bp, Homo sapiens
atctgctggcgatcctacaggatccccccctactcgatttctgttccactgggaataacagactatcaacgtttttctataacggtaatccactagatgctgtctttacggacccaagcaaatgtcatgggaccagagaaaatcatcctagatagcttccttaaccatttccttattgtattttcttattgtaatatatatagtacggaagatcagggtaccg

SEQ ID NO: 682842 - DNA, 136 bp, Homo sapiens
  misc_feature (23)..(24): n is a, c, g, or t
gtccattttggggcttaaaaaanntggggaccaaaccaagtaaaggccttggtgctggttggggtggggcctgcaaagttttagttactgatttcattttcaaaaaatgtaggtttgttacatgagtttcccaata

SEQ ID NO: 682843 - DNA, 355 bp, Homo sapiens
atagtaaaaatcattaaggccattagttactgaccactccctcaacctcccataaaaacaagaaaacggccgggcgcggtggctcacgcctgtggtcccagcactttgggaggccgaggcgggtggatcatgaggtcaggagatcgagaccatcctggctaacaaggtgaaaccccgtctctactaaaaatacaaaaaattggccgggcgcggtggcgggcgcctgtagtcccagctactcgggaggctgaggcaggagaatggcgtgaacccgggaagcggagcttgcagtgagccgagattgcgccactgcagtccgcagcccggcctgggcgacagagcgagactccgtctc

SEQ ID NO: 682844 - DNA, 802 bp, Homo sapiens
  misc_feature (731)..(731): n is a, c, g, or t
aaggccgaggtaacttccaggatgcgcttcgtggtcttctccaagctgtagtctacgtcccgacctccctatcataccacactcttcagcgaccacgcagggcaactttcccgtgtccccagtataccatacttgaagaaaaatgatggacagagagtggaatagagacaacacaccgtgggactcctcaaaccaaatcctgcagggattggctgcttactgcttatgtcttctaccccctgttccattcagcggccaaccagttctttttcttctccaaatggtatcctccaatggagtccttcccaccactcagcatactctattcctcagacgccccttcctccttgtgaggccttcaggaacacattacctttttgttgcctcctcctgcagagttccttctggtccccacacgctttgtaacttctatgccacactcctgtaatctccatcaaaagtggttgcttgcatatcgggataattaccatccgtgtatcgctcaaatgtcacacaaccttacaaaggttctggaacaccaaaaaacgatccttttttaaccctgggcaccccccctttcggggtcccttccctaatattacagggaatgcttcatggtaagggctttcaagagtttattgacactttacacatggggggacacttgcttggggaacggagcatcctcccaagaacagccccctgtgatgcccaataactgtttcctgcancattcaagagaacagagagtattatgggcaacttcatatttaactcacacaagcccagcgtttggacatcg

SEQ ID NO: 682845 - DNA, 576 bp, Homo sapiens
ggacggtttctcttcatcagccttcgagcgtatttctctctcttccaaaaacaaatcagaagtgtcttcacctgcaaatacctttatttgagctaggaaatctcttacatgttccttgcacagcaggacatatcttgatttaacgctgaaaagccctgtcacacagagctttacttgagcatcttgtaggtgagggaaggccgacttaaggagattagccacatattcctgacgaaagatttggttgttaactggacttccaggactttaatgatgtacttatttttccttcttcaaccaaattaaacatatatgcaagaattgatgcatgcgtttgttaaaccagcagtatgtgaagtgtctgtcacaacagaacagatatgctggcgaatatcacaaaaataagttttgataaaaactctgagctggaggttcttcttgtgcaacattttgtaagacgtgtaaaagtatctgtaagcccgtatctgcgacatacctcatagtatgtttgaaagcccaactgatgggatccacaacaagttttaactgttgtaggtgagacaccgtcgaattcga

SEQ ID NO: 682846 - DNA, 122 bp, Homo sapiens
ctgtagaagatcaaggcctggttaagtctataatacacaggaggtacttactacagtgcgaggcacgtatctcaatccatgttaacatactctcttttagtcttcacagaaatctttacgag

SEQ ID NO: 682847 - DNA, 158 bp, Homo sapiens
caccacatataagtgagttctatgctcttaaggacactttgacaagcagaccagctcagggagctgtcaccactctaggcgaatgtcagcccaccaagaaagggctcgtagtgacagcatgctacgtgagcaccagccatcacgcgagttagctggag

SEQ ID NO: 682848 - DNA, 678 bp, Homo sapiens
ccacatcagtcatcatcaagttactttcagagcctcaccgagagctcaacctgcctccgaccagtccctctgaggcccacaggtctgtcatcccatagggcaccccacacccgagaaattctggctgagggtcacttgcttgctctgtgccccctgaggcacgcaccctgcccccgatggacggggctttgaggggtgtctcccggcacccaaggcccgaacacccggagagcctgtgaccctggcagccttgttttatgggcgcatatgtgcgtgtgtggctgagtctctgacagctgtgagtgtgtgtgagcacgggtaagggtacctgaggggtctgagaggagtgggtgcttgtccccccaacctgcatgagagccagaaccactcctggccacggccctgtcctccccacgtacccctgcatccccagcctcgacccacgggacattcacgggctcaacaacggagacacgggctcaggctgccggagctcccacccaactctgtcccacttcacgcacggactgtcctgggcaacaaggtgttcacctttccgagcctcggtttccttatctgttaagccaagcgacacccgcaacagcctgtgagccttgtgtatatagcagacatggaggtcctgcagccggaggtgctccataaacaccaagcgactga

SEQ ID NO: 682849 - DNA, 329 bp, Homo sapiens
ggccgcctttttttaaacttgggtcttttctgtgccaactttatgttggttttggttctggttttggttggagatggagtctcgctctgtggcccaggctggagtgcggtggcgcgatctcagctcaccccaacctccgcctcctgggttcaagcgattctcctgccccagcctcccgagtagctgggactacaggcgtgcaccaccacgccgggacaatttttttggtaattttagtagagatggggcctcaccatatgggtctgaaactcctgacctcgtgatccgcccgccctggcctcccaaagtgccggcattacaggcatgag

SEQ ID NO: 682850 - DNA, 1260 bp, Homo sapiens
  misc_feature (1260)..(1260): n is a, c, g, or t
ggctggagtcggtgcttatagtacagcacgctgtgacacctttactctcgtccggccagtgcgaaccctgattgtgagctctggtatcctagtgcacactgccttgcaagctgactggcgccatgagctctgacttccagcttccagcgtacgagttgaattggatctgcagcaagattaccattgctagctgggacagctgcaatttggttatctagcttacaacaagatttgattgtataaagcatcatcgcaacataacagcatatgcatcaacaccttccaccatccagcacaagcacaaccccaagcaaagtcacatgcattatatgacatggcaggcatccgggcagcataaagcttgtgtcacttgccagtatgtatgggcagtgtcccaaaacacagttccccattctttgtcgcattgtgggcatcacaacaaagacataaacggcaagcagacttggaggcacacatgtggtgcccatctgaatctatcgaaggcaaacacaagcaaaccttcacactggcaccacttatcgcatgctagccaagatccagcttgtcgtagaagttcacctgcattgggttctcaattcagcaatgcactaaccacctctggtctgattcaccctttcgctgcgatcctacactggtgcgcatatttgcacaacttgcaagcctatcacattgactggcactctggcctatgcttgcacaccattccttggtgtgcacaattaggtgtacacaaacacccacacaaccgaacgggcacaaccaagcactcaagtcacaccgtgccaatcaaacccggccacttgccagagggcacacagacaaatgcagaacaacacgatggcaccaacagacggcggggcagccacaacatcagacacacggcggcgccaacacgccacgcccccgcacactaacacggtacaccaagactgtgccactgctcggcaactgggcgtggctcaacgctacaaagagagagcacccacagagacatgagagcgagacagcaccagccacagcgcacgcgccacgcagggctgcccaagcggtgcaggcgcacgccccacaggacagccgccaagtgcgcaacagcacaacaagcacggccggacagccgagacgcgacacaagagacgcgcagcgacaggcacagcagcgcgcgcgcgacgacaagcacggcagcgacacgcgcagctcagaggagcgcaacaacgcagacactgacgcgcaccaacaggn

SEQ ID NO: 682851 - DNA, 367 bp, Homo sapiens
cgggtgatctagaggatcccacctcctaccccacgaggtgtccctcagattgaacgtcacttttgacattgctagtccaactggctatactcaatgtctctgctgtggacaacatttacgggaaaagagtacaagtattactatcactaatgacgagggccgttcgagcaaggaatacattgatcgtatgttccaggaagctgataggtacagagttcaagattagaagcagcatgagtgatcgaggtgtcgtccagaaatacacttagagatcctctgccttcaacatgaagggccacctgttgcacaatatagaaagtatcaaggcatagattaagcgatcaggacaaacagatggatcccggac

SEQ ID NO: 682852 - DNA, 916 bp, Homo sapiens
cactacggggccggggggcggcggcggcagtggttgcagcggcgtgcggggtgtggcgccgcagctggcccgggtggatgagttggaggggcggggtgctggcggtgtgtgctgggggtgtgccggcggctaggggcccggtgcggagccccgcgtggagtcgtgctgcttgctggcacgggtggctgcagctgtgtggcgtgtggccggtggtgggccggcggtggggatggcctggggtcctgcaggcccccggtacgacaagatccggactccggcccggactacgaggcgctgccggctggagccactgtcaccacgcacatggtggcaggcgccgtggcaggggatcctggaggcactgcgtgatgtaaccccattcgactgcgtcaagacccggatgcagagtctacagcctgacccagcttgcccgctatcgcaatgtgttggaggccctctggaggattataaggaaccggagggcctattggaggcccatgaggggcgctgaacgtcacagcaaacaggcgcaagggccttgcccacgccctttattttgcctgctacgaaaaagttaaaaaagacattgagtgatgtaatccacccttgggggcaataggccatatttgccaatggtgcggccggttttttggcaacattacttcattgattgcagccattgaacccttgcggacagttgctcaagcagaggaatgcagattttacaagtcaccaataccaccgggttgaccagacttgttgtaacgggccaaatgttggcaaaaattgaaggggggccggggcctttttaccgcgagttacaccaacccagtttgaccatagaagcgttcctgttccaaggccattcactttcattgacctattgaattcgtgcaaggagccactttaaacccca

SEQ ID NO: 682853 - DNA, 181 bp, Homo sapiens
cgtctgttacggaggcgctcgttacggaagcgctcgttacggacggggctgttaggaggcgctcgttaagaggcgctcgttacggaagcgctcgttacggaggcgctcgttacgggcgtgttaggaggcgctcgttatggaggcgctcgttacggatggctcgttaggcgctcgttacgga

SEQ ID NO: 682854 - DNA, 730 bp, Homo sapiens
cctcccagtaacttcaggtgtttaataaagatgtgttgactcaaaataaaaatataaaaaataagggacattctggtgaaaattatagcgagatcacatgagttaaaacatattgtgtgacattgtcttatttagggggaaaggggagtatctgcatgacagttattgccaaaatgtaaaacatgatgctctagcagcatatggttaaacactatctgttccaagggttgacatggttttcccagcttgtactcatcatgtctgtggtgtagcacaccttggcacataaaacatgattgtatacaccatgcatcccctgcgtccatgagttacatgtgtactcttaatgtccactttgtttctatgctcttcatggattactttctgtgctaaatacagtcacttatttccttcgaataatataatcttcttgtctctagtctaaccctctcaaacttctttaataatatgtctctcctttttctccgtctgctttattattccttagtctattcattcgttcccaattctacgttactttggctctttttccctatcttaagcttttttccctttacagcgcccctgttttacaactttctttacttttaccctgggtttatccaccttatatcgctttctataacattctcctttacctcggtttcttcaatatctatatatccctattatgtttctctttacctttttctcactctctcgtgttcct

SEQ ID NO: 682855 - DNA, 906 bp, Homo sapiens
agcggggctggcggagcagaggtgcagaagcaactgaggtccaagctcgtcgtgccggcttctagagtggacccagaagacgtccccagactcaggaacgattcagccgtatcactcatctcgctgctacagcatagtgatactgcctcgcggacacgtgcctctggttctggattatgatttcggcctcccgagggggttcactcggtggtgcctggcatgccctcgttccattctcggccttcgaaggcgacgtgcgtctccgtcccctggccgctttgacttcccggatgagctgcgggccgctgtggctgcatggtgtctggtagttctactagccccgtagccccagagaagctaccccccggtggctcttcaacgtcgcgcacgcctagtagtccacgagagctgtcctgggccgcagtcgcctccgtgggggatctgggcctgcgaaactgcagccctcctgagtcagcaaacgtgctgcacccgacgctgggcggcgaagtactagttccgtgggtacctggggcggtaccaagcagtacaccttctcagagcacagcgtcctggactactcgtacaacatccccaacatcgtggtgcccccagtatgtggtggcaagcacggaggtggaggtcagcatgcatggtgccggagcagtgtccagagactgcggcctgagctgagctgtctgggccactgaaggggctgtggggagccccctgtgccggggccggcttgcgggatgacgatggcaccttgggttgcatgttgtcacttgctgcacttgtcgtgcccatgacggaaaggcctacgggcctgaatcttgggactgccaggcctccttccgaaaacaagccttcagtccgaagggctagaccatgatggaagtcagtaccccg

SEQ ID NO: 682856 - DNA, 81 bp, Homo sapiens
  misc_feature (25)..(25): n is a, c, g, or t
  misc_feature (39)..(39): n is a, c, g, or t
ggtttctacaggaagagatgggatnttttacaatttggngatttaataaccagggctacccagaaaaagtgacttgataac

SEQ ID NO: 682857 - DNA, 385 bp, Homo sapiens
acgcaccgggtttagccaacgcaccgtgttgggccaacgcaccgtgttgggccaacgcaccgtgtggtggacggtgctgccgagacatggtggctgtggtggacggtgctgctgagacatggtggccgtggtggatggtgccgagacatggtggctgtggtgaacaatgctgctgcagacatggtggctgtggtgaacggtgccgagacatggtggctgtggtgaacggtgctgccgagacatggtggctgtggtggacggtgctgctaagacatggtggccgtggtggatggtgctgagacatggtggctgtggtgaacggtgctgccgagacatggtggctgtggtggacggtgctgctaagacatggtggctgtggtgaacg

SEQ ID NO: 682858 - DNA, 797 bp, Homo sapiens
tggaaatagggtttggctcggtcacccaggctggagtgcaggggtacaatctcagctcactgcaacctccgcctcccaggttcaagtgattctcctgactcagcctcccgagtagctgggattacaggcgtgtaccaccacacgtggctaatgtttggtattttaagtatagacagggtttcaccatgtgggtcaggctggttgtgaactcctgactgcaggtgatccacccgcctgggcctaccaaagtgctgggattacaggcgtgagccaccacagtctgcctctattttcttttatttagaggcaggtttcactctgtcatccaggctggagtacagtgtggcatgatcatagctcactgcaacttctaggctcaagcaatcctccagcctcaggcccaagtagctgggaccacaggcactcacggctacacacggctaaattttttttttttgggtaaaaacggggtctggtaatgtggccagggtgggtctccaactcctgagctcaaggtgatccttcagttacagcctcccaaagtgctaggatcacgggcaggagccacggtgcccagccaagatggatttcttactctccaaggcgtcagcttttggaagttccttttatgaaaagtgcgggcaaaatcgggtgaaactggtgtaacaaggcccatctgggtcagccctagtgggtgccggaaagtgcccaatgttcggcctggccaggacccagagaaggtcaaattaggcctggtcggggatcacggcagatcgagaaaaactttgaaagaattt

SEQ ID NO: 682859 - DNA, 126 bp, Homo sapiens
actcggaccccatgttggcgaggctgattttgaaatcctgacctcaaatgatccacctatcttggcctcccaaagtgctaggaatataggcatgagccactgcaccttttttcttttttttagata

SEQ ID NO: 682860 - DNA, 187 bp, Homo sapiens
ttagaccgcagagtgggatgtgacctggctctgtgcggtattgcaaattgatgaccatgctccctatgctccctacagaaccatccagtgtttggggcctctccagctggacaggcagctggtacctctaccagatcttaatatagtttgcaactcagatctccgttcatctctgacagatggccat

SEQ ID NO: 682861 - DNA, 389 bp, Homo sapiens
gaatggacgaacaaagtgtgaaaatcaccatgctaattcagtctcttttgtggttggaatatcttcctgaagagtatagcagagtctgctggggcccgagaccgaggcccactcccgagaattctccaggcggtccgggacctctggtgtccgaaaccacctccgggccagggagtccgcatcgcagcggtccgggggccaagaatgggcctttttttttaaagaggcttaatatttgggaattatttccaacttaccgaaaaattggcaaaataaaaatccataccaacacatatatattgcctatacaccttttatccagattcatctgttgttgatattttttttctttttttttttttttgggaaatgtccgtcccattgggggt

SEQ ID NO: 682862 - DNA, 1063 bp, Homo sapiens
gtcaggagaggagagtggaggaggagaatgcgagggagtgtgagcaggggcaggagccaggagaatgagcctccgccatgatgtcggatgccggatgcatggagcaaagcgtggcatgcaggatgcctggagcatggatgcctgcagcaagatgcaaggacaagatggaagagcaggaagagaaagcagaagaggagagccgcagtcgcagatcgcagcctgcagcaatgatgtgacgatggaagcagaaacgcgacggcagcaatgctgagacaagcttgtggcgggcaagcagcaacgaagaacgaagaaggaagacacatgacctgctcccagtccagatctcacatccctgctcctgtgtcaaagtgagcgggaacatgccaaagtctgaatccagccatgatgtggaaggtcagagagagagagtgagaatgctggcaccaatcaggagacccggatccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggacacatgtggaactaccgagaagtctttatgaacatgtaaggaagacgtaggaaaagtgattggagtagaagatgtactgctgtacatgttaaaatcacataatggtgtgtatataaattgataaatctaagtgttcttgtcaagtacaagccttcatgtgcacaagggctatcatggatcgagtgacaaccaaatctatctttgtaaaattcccttataaataatgaccaaaagatgaaattataaaaaagactttggtattaggggatggcatacataactggagagatagtagtggagggaataaagggatgtatagagaataggatagaatagtgggagaaaaaataataggttatgcatgaacaatagagagtaaaacaaggaagaggaataagagattgacaagtggtgaaatgaggagaagtt

SEQ ID NO: 682863 - DNA, 582 bp, Homo sapiens
  misc_feature (111)..(111): n is a, c, g, or t
  misc_feature (346)..(346): n is a, c, g, or t
  misc_feature (384)..(384): n is a, c, g, or t
  misc_feature (429)..(430): n is a, c, g, or t
  misc_feature (441)..(441): n is a, c, g, or t
  misc_feature (546)..(546): n is a, c, g, or t
  misc_feature (572)..(572): n is a, c, g, or t
cgaggacagtaccacagtaggcaagggacagagcacaacttcagtatcaagaaattagatcacaactctgatttaccacacatgaggactgtcgcgagtcagtgtaagttngccgacttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatcctttttggaggaatctggatgctaatggtcaattctctactagtaaaatgatcaagccttcaattaatttaagctttggtttttggaccnatttggtttccctgctggaaatgagaataatggttggnaaaggtcatatctggaattaatgaatctcttggaaaagcttttgnntaagtcttaanggttgccattgcagtagttgccatccccggtaaaggatacctagtgccaatacttgaagaagcttccttgtacctcaagactttaaggttaccaatcttatccanggagtctttgttcttgtctgcatgangagcctcttt

SEQ ID NO: 682864 - DNA, 1157 bp, Homo sapiens
gggtaacccacgatggggacgcggccgaggagggtcgctgaccaccctgggggcgtgggagtgaggtaccagattcagcccattttggccctgatgcctcatgtactcggaatccgggtgctgcggattgaggtcccggttcctaactggattgcaaggatggaggaagtgcgggaacctaaggagggcctgactcacagatggtaccatctcacttgagtcaaggtcaaggctgcctggggaccttgccacgctgtagtgagtgaaccattcgtcctccaggctattcgtgactgtaccctgaacgccctgtcccccgaacgatacctccgggacatagattgcagacgcgacagactcctgtcccctatcgtactatccacgatctccagtggggacttgctgccatgcatcaaaccatcatgacattctatggcttgcaccagggattgcttgtggcatcacgcctcaaccagtccattgaggcaggggccaatgccacatgcgtatcaccttgcattgtacccatgagaccctaagtatgctggcacaaatggtcagagctgccctcgattgggcttggaaagccccgggcaggcaaagagctttggccaattgttggggcccattgagcagccggtgggagaaagggagcgaccgggccagtggagagggcggaagggccaccaaggcgcaggcgcagcgaggggcacccggaggcccaaacgggccagagcggagcaagacggacaccaagggcacaagatgcacctcgggcgcggacatgacatccgcaaaccccgtgctgcccgacccatgggcagcctgtgggtgcgacacgagcaccgggcgccggccatgcgatgcgcgtccccggcaacccgggagcccccacactggcccggccatgcgcaacaaggtccgccggagcaccagcagagacgaaagcgatcgcgcgctcgcagagccacagatccaacacaagagtgggccgcacagcaagcgcaacgcgacgagagaaaagggcgcgagcgaggtggcccccacaagagcgcagggaccgagaccgacgccgtaggcaggagcaggacgcaaccccgcaggcaaagacgcggcgcagcggggactgacgaaccaacagaaagacaccagccagg

SEQ ID NO: 682865 - DNA, 302 bp, Homo sapiens
  misc_feature (222)..(223): n is a, c, g, or t
  misc_feature (232)..(232): n is a, c, g, or t
  misc_feature (262)..(262): n is a, c, g, or t
  misc_feature (281)..(281): n is a, c, g, or t
  misc_feature (302)..(302): n is a, c, g, or t
gggagaccggaaacaatataataaatggacattaaaaaccttgagccagaaaggggtccgatctttgactcaagggccattaaactaacatgggcaatcatgtttcaaacaaaaccaccggcaaacaagtccaacgagggaaaattagatgaacgcacctttggcaacccccaccaccccagatatcaaaactttcttttttggaatgtaatcaatgtttcnnctagggtcnaaaaaatgtgatcagaccagaaggttacangattatcaacaatagtgantgatagagtgttatcagtcan

SEQ ID NO: 682866 - DNA, 956 bp, Homo sapiens
tgctctcgtgtttcggtgccgcgatctttcacgatggtctcgcccaaccttatctaccttctgtcggcctgtctctctgctgccttcctactcgtgaggatactgccggcgctctgctacggtctgcccacccaacgcgaagacggtatcccgtgtgactttgactggagagaagtggagatcctgatgtttcgtctagtgccattgatgatgatgtaacaaccgttcagatcccatgttccttgatgaactgtgtcaaaatcccctcctctatatatgggtccctcgagatatatctaatgatacgttcaatggataaaaaccattagagtttgaggaacgtacaaacgcggcaccaagagggtcgacttgaattcgtggcaagttctttgccaattgatctaatgattgtcaaatcatttgccactatctatgtctgtaccatctccacttaaaactacaactgtactaggggctaaattttcgggaatggtaggactgtttggatcgctatactgatgttagtacgcggtacaaacgtgagcacatcaccctcatcaaggaaatccctaccctgatcctgttaccaaggtggaaagaggcaatgcggaggcacagattgacaagaaaggacgggctgtctcatggaccttctctgaggagaaatgtgatccgagaatttgggttctaatgtgctagacccgcggggccggaacttttcatagggtcggggaaccatatccctggaggagcaagcttgtggttctaacccccaccacggtccgttggggcgaacgcagggtgttcaagtcctccgttggggaggtgccccccgggagatccgggcttctataaccagcggggcgcgctctattatttcccgtgggtagggggagcgccctctttaaaggcaccgtggtggccccggcggtctgcggccggcaacaaggcggggt

SEQ ID NO: 682867 - DNA, 132 bp, Homo sapiens
catactgcactgttgttcaaacccccccccgagtgttacagccccccgatacagcgagcaggtatgaacaacagtgcaggtttgaacaacagtgcaggtatgaacaacagtgcaggtatgaacaacagtgca

SEQ ID NO: 682868 - DNA, 212 bp, Homo sapiens
  misc_feature (6)..(6): n is a, c, g, or t
ggttangactctgtctcaaaaaaaatttttttttaaataaataaagccacctttgaatcaccaaccttatcatccacacacacacacacacgcacacacacacaattatatctaccacttggtgaaagaagacagcatacacccatgacatcaaaattaactaacgtaaatacataagtcaggaatgagtagttagtacagtgatcgaccaa

SEQ ID NO: 682869 - DNA, 197 bp, Homo sapiens
gactgacgagtctggctgtctgtggagacggattacaccttcccacttgctgaaaaggtcaaggccttcttggctgatccatctgccttggtggctgctgcccctggtggctgctgccaccacagctgctcttgctgctgctgcagccccagctaaggttgaagccaaggaagagtcggaggagtcgtcagtccgtg

SEQ ID NO: 682870 - DNA, 378 bp, Homo sapiens
ggctcggtaccagcatcattcacgaatgaatgcattctggctgggcgcggggctcacgcctgtatcccagcattaactcaaaagtccacagtccaaatctcatctgagacaaggcaagtcccttctgcctatgaccctgtaaaatcaaaagcaggttagttacttcctagatacaatgggggtacaggcattgggtaaatacatctattccaagtgggagaaactggccaaaatgatggggttacaggccccatacaagtccaaaatcaagtggggcaatcaaatcttaaagctctagaattatctcttttgactccctaacatccaggtcacactgatgcaagagatgggttcccatggccttgggtagctataccc

SEQ ID NO: 682871 - DNA, 268 bp, Homo sapiens
  misc_feature (25)..(25): n is a, c, g, or t
  misc_feature (176)..(176): n is a, c, g, or t
  misc_feature (219)..(219): n is a, c, g, or t
ccttctacgtctcatcactgaaggntcacagcttaggttaagaaatgagaagggactaggtccatcttcagcagatgaagaaaccaggaggcactcttttccacacagaagccaaagacagcagccttaaaatgtcttgggccagtttgaagaagtatagggaaaagagcaatggntgtaaggaaagcagggcccttaattttgtttggaagttgcttnttataattgcagattccattgtcacctggcagtgatgagacgtagaagg

SEQ ID NO: 682872 - DNA, 451 bp, Homo sapiens
aaaatcgggaaacatttccgggccgaggtccacctttttccccccccgttggaggaattggcccttaacaaactggttacgcttacgtgcctggcacgcggttttagccccaaggaagtgttggttttttggctgcaggggttacaggaatttccccccgaaaagttcttttttttggcattccggcaggagcccaaccagggcccccccacttttttttttccaagcattttgggggtggcaaccaaggattggaaaaagggggacccctttttttgcatggtgggccccaaggcccttccgttggcttttacacaaaaaaccattgaccgctttgggggttaacccccccattttaatttttttttttttatgggggaggtggggggccccttttttttaaccgcccgccttttccccccctttaattaatttcatttttccccaaaca

SEQ ID NO: 682873 - DNA, 323 bp, Homo sapiens
  misc_feature (107)..(107): n is a, c, g, or t
gagatcctaggtctgggctccctgaggggtcacagctcttctctccttctctcttcccacaatatagagagcaaggggcatgtttcagccttctttgtattacagtnctttcagccttgccattctccaggtcccaagttcttgtcctgcaaccccgaagaatgaggtagtcagacaagtgaatggtgagccagactaagaggagctttactgagtgatagaacagctcagtctcccatagggcagctcctttctggagccagggtgtcctgtcgagtgttcagctcctagcagagagggtaactcctctctgcagctggtca

SEQ ID NO: 682874 - DNA, 1128 bp, Homo sapiens
ggaatgcaaagggcacaaaatgatggaactgttcatgggcaaggaagtacttcacttgtgcatgaagggcatggccatctttgtgcgccagtcctcagatccaggttatttcgaaggcatggaggtcacgatatctacttccgccaggagtgcacactgattacttgctgcgttcaaaagtcctcaaaagagagggaactgatacaagtgcaaacgactatcaagaacttggagggatggaccggcgccctaaagggctcagtgtgcgggacctggacgatgaaactagagatccctgacgacttgaatatcgggcacgaactatcgaaagcaaatgctacatagagcgtagggcatgaaacacagaaatcctagctggcagcaggtgccggacatggcaagagccaaatgcaggcagcagacaagagtccgaacctgactagacgtgatgcctccaggaggctgaggacagtgaagccaaggaggcgctggacgcgaaaggaacgctataatggaggagcatggctgatactggctgatgccattgaggatggccacgtgtggaccatgagatggctgaagaacgtgctgacttacccttgtaactacgcatggtggatggcacctgacagcgagacaggtgtaggactgagcaccctagttcgacttaagagatcctccaaggctgccacttgcacacgaagggcccaaatgtgagatgagatccagtatatccatccacatccgctcgcattggagcggaagccaacactgcgcagccctgcaaggatgccgcccgggctgatgggatgagcgaatacctgtcttcctaagaaaattggagcagcatgtcaacgtatcatcaagcctccgaaacaacacgaacccacatctggcatttggacgccactagtggttagacgcatgagaagcaacacgtaaaaactgaatcggaaaacccatccagtgttgtcccttcaggcgtaactccgtaacaatgagtgggcgatacgcgacgatggatatcttgaccaacaatgaccgtatcggtagtgacgaggccacttaggcgacgttcatgtgaataactcatatcgagtgacacaccactatgaacgatatttatgt

SEQ ID NO: 682875 - DNA, 716 bp, Homo sapiens
attagttaaccactcactcatcgacctccccaccccatccaacatctccgcatgatagaaacttcgggctcactccttgcgcgcctgccatgatcctccaaatcaccacaggactattgcctagccaggcactactcaccagacgccgtcaaccgccttatcatcaatcggcccacgatcactcggagacgtgaaagttatgggcgtgaactcatcccgctagccttcacgaccaagtgggcgccgtcgaatatgtctttagtctgcgctcttcctacgacatcgggacgaggcctatattacggatcatgtctctactcgagaaacctggaagacatcggcaattcatgcctacctgtccttgcacacgtatagcaacagtccttcatgaggctatgtcctcccgtgaggccaaattgatcattgctgaggggcgcacagtaattacaaatcgttactatccgccatcccatacagtggggacagaccgtagttcaactggaatctgaggaggctacgtcaggtagagcagtcccaccctcacaggatgcttgacctttcacttgcatcttgccctgcatggatggcagccctagcgagcactgccgactcctattcttgcgacgaaacgggatcaaaataacccgctaggaatcacctccccattccgatgaggatcatcttccacccttagtacgcaatcgaaagacgcctcg

SEQ ID NO: 682876 - DNA, 409 bp, Homo sapiens
gtggatgagaacagtcgagttgtatctgacagttatagttcagagagctttgctgagatgaacaggagctcgaaggagtggtagacggttgtgggcggtgccatgttcttcatcggtttcaccgggctcgttatcatgtgggagaagcactatgtgtacggacccctcccgtaaagcgtttgacaaagagtgggtggacaagcagagcatgaggatgctggccatgaagtgtgagaccccatccagggcttagatctccaagtgggactacgaataagaacgagtggaagacgtgagagatgctggcctgtgcttgcatctgcgcctggttctgtcagcgtcatgcaagtccatgcctatttactggaaacctgttatgcgaaatagttgtaccattgctaatgattgt

SEQ ID NO: 682877 - DNA, 180 bp, Homo sapiens
tgacgcacaaagcggcgcgtgttctggggctggatgaaggcaaagaagtgttggatattgctaaaagcgccgtgggtaggtattactcaggccgaggcggtcggcaaaaacgctgacaaccaattaccgggtattattagtcaatattgagcgcggccagaagcagtgcgaagtattaat

SEQ ID NO: 682878 - DNA, 420 bp, Homo sapiens
aggacatacatttgcatcgccggatatttgtagagatagcttaagggatggcagtttttatggcgcttcgtaataattactgtgaattacttagatatattacgcgacttagttagtaagaaattgtatctagtatgtagcatctggacttaagtcattccatcttagacttacgatgaatgctaaatgtgactgctcacagaccttagagatgatgagcactgttgctcatgagtaacaagttgcttatatgcagaacggatggttgatccttcttgctccgtatgatgcatgtaattgcatgtgaatgacttgttgactagctattaaggaactagagtagctaaatgagtacagtgcccttttgcaatctggatatgacttgaaagtaacgcatcataatggccttaaggtttttcc

SEQ ID NO: 682879 - DNA, 535 bp, Homo sapiens
  misc_feature (26)..(26): n is a, c, g, or t
  misc_feature (49)..(49): n is a, c, g, or t
  misc_feature (62)..(62): n is a, c, g, or t
  misc_feature (78)..(78): n is a, c, g, or t
  misc_feature (264)..(264): n is a, c, g, or t
  misc_feature (283)..(283): n is a, c, g, or t
aaaaaaaatcttcctaagttcccaanctggtctcgaaatccctgggctnaaataaacctccnaccttggcctcctgantaactgggatgaacaggcaaaagctaccaagcccggcttcccctgcttttgaaacaaaaatgtcctttactggttatcctgtgccctgccctcctaccactgccacactgggagtgtggagatgacctgtctctttagctcacaggtctgcagataggaaatgcacttaagggctggatgcgggtntcacgcctgtaatcccaanactttgggaggccaaggcaagtggatcacctgaggtcaggagttaaagacgagcctggccaacatggtgaaatcccgtctctgctaaagaaaattagctgggatggtggtgcatgcctgtggtcccagctacttgggatgctgaggcaggagaatcgcttgaacctgggaggcagagttttcagtgaggtgagatggtggtggctctgcacttcagcttgggagacagagcaagactccatttcaaaaaaaa

SEQ ID NO: 682880 - DNA, 562 bp, Homo sapiens
ccctcgccaagtacagtctcctcagcccagagatatggaagcccctcccaacagaggctctccccacaaggccagcagcccctgagcccccagtccggatttccacaacagcaaaggtcaccaggctttccgcagctattccgggcatccagtggcagctccccaaaccaggcctccaagccaggtgccaccctcgcctcacagccccggccccctgtgcagggccgtagtacctcccagcagggtgaagagtccaaaaagccagcaccaccccatccgcatttcaaaaaatttcagttcctgacttacaaccctcagcacaatcggacacctcccagggtgggaccccaagttaaaacgaggccaaggctgaaaccatccgcaacctgaggaagttttttgccagcctgttttttgactaaccccatccaggctgggaggggaaaagtggtttgctacacttgtccccctcctgcctcattttccttttcaaccttggttcctgatgggaacaaaaaggagggcctgagaacaaactttttaaatgcctttggccccggga

SEQ ID NO: 682881 - DNA, 84 bp, Homo sapiens
aacttgatatatatacatgctatagtttgaacattttgtgtacttccaaaattcacattaaaatctaatccacaaaacgagaaa

SEQ ID NO: 682882 - DNA, 372 bp, Homo sapiens
  misc_feature (197)..(197): n is a, c, g, or t
  misc_feature (200)..(200): n is a, c, g, or t
  misc_feature (203)..(203): n is a, c, g, or t
cctccccagcccaggaaaaattggaagccttcccccagcaaggcaaaagcttggaggagggttgtaaaagcatattgtccccctccttggtttatcagatttttttattgccccgcaaactgagaatttaggcccccccaacctttgttccccccccagtttttcttttggagggatccccccatttcaggggtaanaanagnaactcccccctcccattcccccccctcatacctacacccaaggttgtcagctttggattgctggggccaggccccatggagggtatactgaggggtttataggtttgtgattaaaataataaaagctaggggtgtttgatgcgcttttaactttggcaaaaaaaaaaaa

SEQ ID NO: 682883 - DNA, 1869 bp, Homo sapiens
  misc_feature (198)..(198): n is a, c, g, or t
  misc_feature (468)..(468): n is a, c, g, or t
  misc_feature (1083)..(1083): n is a, c, g, or t
  misc_feature (1182)..(1182): n is a, c, g, or t
  misc_feature (1215)..(1215): n is a, c, g, or t
  misc_feature (1371)..(1371): n is a, c, g, or t
  misc_feature (1406)..(1406): n is a, c, g, or t
  misc_feature (1665)..(1665): n is a, c, g, or t
tgtactgcctaaagctgggaggctggctccagcgaccactgtcagacacgaaacaagaggtaggacactgagctcgtgtagaatggtctcagcctctgcacacgaggcatctaggggagacgaggtggctgctaggtcctatgcttgggtttgatcacgtaggtcgaggcggcgtgaaacatcgcatcaaacacagtnaacgcgactcttggccacaagtcggaaaaggctgcgtgcgctggtatctgcacacgcggcggaccacacggcagatgcttggctcacgcaatgcgcggtgctcgcgactgcggatcgatgcgtagcgcgcgaatctagggtggaccggggaatagccaaccgaccatcgatagcgagtgcttcgtagcgctcgagccagggggtcatttcgaggaccctgttagtcgaagcgtgcagtgagtcggttgctagacgcagtaacgagcgaanggtccactgtgtcgtgctcgcgtgggaccgccactcatgtccctagtatcatcgttgtgtggggattctcgggacggtgagggcgcgggatagccaaagggttcgcccgccgggactgattcccccattgttcgatcggccgccaaccaatcttggtcgattgcacggggcactgggagatcgcggacgtgaaccggggcgttcgccgcaccatctttccattttcgcgttccctcatccgttgcgcccacaggttgtaaaatggtccccccctttcccggcgaccaacatagccccatatattcgaaagacctcgaggcgcaaactttaaaccaaaagcggtttacgaatatgccatgtctcgcacattaagcaatatcgtcgtatgaataggaggcgcctatgtccgcttcgaagcatatacacaaagttctggtgttgaacccccgggtgggaatacgcagggtatgcgtcctaaggtatagccccaccctgggttatcctccaggggtggacacacggcggcggtttctcttacgttagagactgggaacacactgtctggacaggtgcaaataatatagtgcctcctttcctagaaactgcgttgtccanacggataacataaccgggttaggacactacccggtatagacaggacgcaactacgcaaagatgacgatcacattagtctcctaccacaaaagaagaggncgtccggttattaccacagggtcggctcaaaangggcgatcagatacatcccaggatattaatatttgtatgtccacccgctgtgttggtccgccaacacacgcgtgccctcccgagcccggttattactgatatgtcgaaaggtctcccaataaccgtgggggacctataccattacaattcaaatgnccgctaaaagggggacatactgccccccggccaantggataaaccaatgtggagattaggtttttcgcgccgcggccagaacccaaattatggctcatagtcggaccccatacccatttgtcgtggcgacgttttttgtcacactttcggcctcgacacagcacacctggggaggcaacacaccgacgccgggggagaccacgagcaccacaagaagcatagtgcaccttcgaacgagggtgcccccgcggacggcttttgtgaacaggtttattgacacagcatacctttgantgctatgagagcagctggtgcgcgcccactaattaacagcggcacgtccgcgtgatacattgtgagatctattcgccgagagctgacgagcccgcttctgacaaagtgattatttatcagtgtgttgtgccacccttatgtattgcgtgcagacatcgatgtgcgtcaagcaacacacctataccctggtcggatggctgctca

SEQ ID NO: 682884 - DNA, 905 bp, Homo sapiens
gtgacctctaccacctcctcgtcgggctcctcctgtgacagtctgcacctgccatggacggagcccagcagctcctgaggctcccgccaagaatgtgggcatggctcccatgagcaatgccggcactctgcccacacagcataccaacaactccatgcacgctggctttgaacccgtagaaactgggtgccccctcatcctcctgcttcaatcatagcctgaggcactgcgtgcatcgggtcccttgcatcaaccaccacacgcctacagcctaaccctgcgtgcccctagcctggctggcgcgcgcagcactctgctgcgcacgaaccatgcaagcctgacaactggtcacggtttaccagtgcatgccccccttggaccgaagcctctgttctcgcttgtccactacgccctcttccattgtattgcccattgatgcaacccaacggggcctccaaatgcctgtctccaccattatagcccgcgcacgccctggaacctattctggctatctcattggccagatttgccattatacttttcctcttctggttgccttgctgcaacggcctacaatgcctaggatttggtcggccgaacctcaatgtcgcaatcgggtgaacctgattgtgccaatactgcgttcccctgcttgcctttggtgcccgtttacttcaagcgtcgcgtgacacttggtctcctccctagaggcccttggtcggacccctaatgggctgggttcccgaatgagtacccccttggtgaggaatatctgatccaatgatgggcacaaatctgggccatggtttttgtgctctgttttccgatcatgtgccgcaaccacgtattgggtgagaaaactcgagatgatgatggcccaaatcttggtctcttgtagactctgg

SEQ ID NO: 682885 - DNA, 320 bp, Homo sapiens
gcgaccacacggccggggcgctacgtttcgccttcagccaccatgggggaatgggatgaacaagatcctgccccgccctgtacatcggccaacttcaaagatgccagagacgcgggaccaattgagcaagaccaaggtgccacatattctgtctgtccacgttagtgccaggcctatgttggagggagttaaatacctgtgcatccagcagcggattcaccatctcaaaacctgacaagacatctcagagagagtattaaatacatacacgagttccgtctctgcggtgagagctgccttgtacactgtctggcccgggg

SEQ ID NO: 682886 - DNA, 887 bp, Homo sapiens
  misc_feature (238)..(238): n is a, c, g, or t
  misc_feature (243)..(243): n is a, c, g, or t
  misc_feature (249)..(249): n is a, c, g, or t
  misc_feature (260)..(260): n is a, c, g, or t
  misc_feature (271)..(271): n is a, c, g, or t
  misc_feature (273)..(273): n is a, c, g, or t
  misc_feature (279)..(279): n is a, c, g, or t
  misc_feature (289)..(289): n is a, c, g, or t
  misc_feature (291)..(291): n is a, c, g, or t
  misc_feature (300)..(300): n is a, c, g, or t
  misc_feature (306)..(307): n is a, c, g, or t
  misc_feature (314)..(314): n is a, c, g, or t
  misc_feature (321)..(321): n is a, c, g, or t
  misc_feature (329)..(329): n is a, c, g, or t
  misc_feature (342)..(342): n is a, c, g, or t
  misc_feature (346)..(346): n is a, c, g, or t
  misc_feature (353)..(353): n is a, c, g, or t
  misc_feature (360)..(360): n is a, c, g, or t
  misc_feature (365)..(366): n is a, c, g, or t
  misc_feature (387)..(388): n is a, c, g, or t
  misc_feature (395)..(397): n is a, c, g, or t
  misc_feature (399)..(399): n is a, c, g, or t
  misc_feature (404)..(404): n is a, c, g, or t
  misc_feature (408)..(408): n is a, c, g, or t
  misc_feature (410)..(410): n is a, c, g, or t
  misc_feature (426)..(426): n is a, c, g, or t
  misc_feature (432)..(432): n is a, c, g, or t
  misc_feature (438)..(438): n is a, c, g, or t
  misc_feature (447)..(447): n is a, c, g, or t
  misc_feature (453)..(453): n is a, c, g, or t
  misc_feature (457)..(457): n is a, c, g, or t
  misc_feature (460)..(460): n is a, c, g, or t
  misc_feature (466)..(466): n is a, c, g, or t
  misc_feature (476)..(476): n is a, c, g, or t
  misc_feature (493)..(493): n is a, c, g, or t
  misc_feature (499)..(499): n is a, c, g, or t
  misc_feature (502)..(504): n is a, c, g, or t
  misc_feature (507)..(507): n is a, c, g, or t
  misc_feature (512)..(512): n is a, c, g, or t
  misc_feature (514)..(514): n is a, c, g, or t
  misc_feature (516)..(516): n is a, c, g, or t
  misc_feature (519)..(519): n is a, c, g, or t
  misc_feature (530)..(530): n is a, c, g, or t
  misc_feature (533)..(534): n is a, c, g, or t
  misc_feature (538)..(538): n is a, c, g, or t
  misc_feature (778)..(778): n is a, c, g, or t
  misc_feature (885)..(885): n is a, c, g, or t
gcttgctttcgccgcgcactccgccgccatggagcagcgccgcgtcaccgacttcttcgcgcgccgccgccccgggcccccccgcatcgcgccgcccaagctggcctgccgcacccccagccccgccaggcccgcactccgcgccccgggcctccgcataccagtggcagccgcaagcgcgcccgcccgcccgccgcccccggacgcgaccaggccaggccaccggccgcaggagacngcgcngtcggnggacgaggttntcagccccagnanccccgnggccccaganancccagcctncccttnnccgggcnagaaganaaagaaanccaccccggcagnaggncagccgncccaccngacanncgcgcaggaccaggacaccanntctgagnnngngtcangccngnaacgggcccgggagcngggggnaagagnccgggcgcngaaggncagngcncaggangctggggagncctgcaccccagaggcngagggngcnnngangagcnangnggngagaaggcgcncgnntatnagcgttttcatgttctggtgcagctcggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgcnagagcgcagtgtccccaccttcaaggatggcacaggaggtcagattaccagctcaccatcgagccactgctggagcaggaggctgacggagcagccccacagctcangg

SEQ ID NO: 682887 - DNA, 362 bp, Homo sapiens
  misc_feature (204)..(204): n is a, c, g, or t
  misc_feature (304)..(304): n is a, c, g, or t
  misc_feature (310)..(310): n is a, c, g, or t
  misc_feature (319)..(319): n is a, c, g, or t
cacgagggagagtgtgcccttcgcccagcacagcagcctggattcccgcatcgagatgctgctgaaggagcagcgctccaagttttccttcttggcctctgacacagaggaggaagagaacagcagcatggtccttggggccagagatacagggagtgaggtgccttctgggtcagggcatgggccctgcacaccccctccggncccagctaattttgaggatgtggcacctacagggagcggggagccaggggctacccgggagtctcccaaggcaaatggacagaaccaggcttctccatgntcttcnggagacganatggagatctccgacgacgaccggggtggctcaccccctccgg

SEQ ID NO: 682888 - DNA, 366 bp, Homo sapiens
gaacgggtgatgcggttggaagggtgatgcggttgagaatgtatacatgtacgttatactgaccattagttcttctatagggtgatagattggtccaattgggtgtgaggagttgagttatatgttaggaatatttcaggtattgggtgttgaactggaacgcttgcttaataggtggctgcttttaggcctactatgggtgttaaattgtgtgactctctcgtaccagaggtttttacctagtgtccaaagagcggtccctcttgggcgtcacagttcaaatttcacaaggggcatagagagggtccggtgggcaaatttacagtcgcacctaagattctatctgggacaaccgaatcacccgta

SEQ ID NO: 682889 - DNA, 226 bp, Homo sapiens
aacatgtataagaaacgcgcgctgagacccccagcaggtcacccgtctgcccagcggctatgggctaggcataccgcctgacccctggggtgcacgagctgccggtgcagcacgccaggagaaacgcatacctgaaggtgtccatagaaagagctcaacaagaaaacccctctcctcaccgagggccaggacatctgattcaccatcctgggcgtgctcaccagcc

SEQ ID NO: 682890 - DNA, 262 bp, Homo sapiens
  misc_feature (120)..(120): n is a, c, g, or t
  misc_feature (125)..(125): n is a, c, g, or t
  misc_feature (187)..(187): n is a, c, g, or t
gtgccttctaggttttgaacttctatgcattagcgcagatgtggaatgcgtaaaggtgttcatagtttgactgtttctatgatgttttttcaaagaatcgtccttttttgaactataatnccccncggttattttaccatcacagtttaaatgtatatcttttacgtctctactcagaccatatttnaaaggggcgcctcattatggggcagagaaccttttaataagtctcattaagatctgaattttggttctaagcatt

SEQ ID NO: 682891 - DNA, 1064 bp, Homo sapiens
  misc_feature (230)..(230): n is a, c, g, or t
  misc_feature (334)..(334): n is a, c, g, or t
gcatcttcaggtctttagcaatctggacaaggtggcagggtattttaaaagctataactactgtagttttccagttttcatgctgctttagaaaccacgctgtcttacagtggtactttcttctggccactgcactgtagataattcatggaaacaagatttacccactacataaaaggttaaactccttcagtatgtggagtggtttctttttttttttccttctcttncttttttcctccaggtaatatcttctctaataccgtgcatgtggcgtttaaaattcaagaccacggtcaaacccctcttctaatcacattaatggttcccattncttttataccctgagtgagcacttttcactttccagctaggtctgttttccagctggcagacaagatggagaaatccttgaaaattgggtttgggttaaaattttgggtttaattatttgaaatccacactccctgtggaaactcttaagtgcattggtgcacttctgttggttggtctcaaagaaggggactgtaacaatctgagtaattcccagtgtcctcttccttatcctctagtgttgaagctgtgtagcattttacctttatatattttcacaatattttcatataaacagtatacattgtgaatcagtcatttgttacagaaacgtatattcatgaagatgaatttacttaacaaaaggccagagtctaatcctcccagggatgacacatttcccaattatctggtctttccctgtggtgcaaaaatgacttcatgggtccgagtgttaaaaaccatttgcgacacacatggcttcctccattaaacgtatgttgccagaagaaaaaacttcctgggggggaggttcccacagcaaattactagccaatgtagacctttggggtgttcgacggcatcttggcgccataaaggccgtggacattttgacgctgggtttttaacctctggccaaaaactctgtgttgggagagttttcaacaaaggtaccctcggggtgggtcacaacgtggggaggagccgcacagatattgtggcacaaccag

SEQ ID NO: 682892 - DNA, 383 bp, Homo sapiens
ccccagacggggtctccgggtctcttgttctgtcctgcgccccggctggagtgcagtggcgcgatctcggctcctagcaacatctgcctcccgggctcaagcgagtctcccgcctaagccctcccgagtagccggggcttaaaggcgcacacgccactccaggctttttttttttttttttttggcagaaacggggtgtcagcctggccaacatggcaaaaccatgtctctactaaaaggaaaaaatttagccatacgtggtagtgcacacctgtaaccccagctatttgtgagactgaagcaggagaactgcttgatcctgggaggtggaggttgcagtgagctgagatcgtgcctaggtgacagagcaagactccatctca

SEQ ID NO: 682893 - DNA, 778 bp, Homo sapiens
  misc_feature (45)..(45): n is a, c, g, or t
  misc_feature (70)..(70): n is a, c, g, or t
  misc_feature (76)..(83): n is a, c, g, or t
  misc_feature (92)..(92): n is a, c, g, or t
  misc_feature (112)..(112): n is a, c, g, or t
  misc_feature (148)..(148): n is a, c, g, or t
  misc_feature (189)..(190): n is a, c, g, or t
  misc_feature (270)..(271): n is a, c, g, or t
  misc_feature (285)..(286): n is a, c, g, or t
  misc_feature (295)..(295): n is a, c, g, or t
  misc_feature (337)..(337): n is a, c, g, or t
  misc_feature (339)..(339): n is a, c, g, or t
  misc_feature (344)..(344): n is a, c, g, or t
  misc_feature (347)..(348): n is a, c, g, or t
  misc_feature (376)..(376): n is a, c, g, or t
  misc_feature (576)..(576): n is a, c, g, or t
  misc_feature (591)..(591): n is a, c, g, or t
  misc_feature (615)..(615): n is a, c, g, or t
  misc_feature (669)..(669): n is a, c, g, or t
  misc_feature (675)..(675): n is a, c, g, or t
  misc_feature (690)..(690): n is a, c, g, or t
  misc_feature (758)..(758): n is a, c, g, or t
cacccctccctctgaggggcccaccaggtctgggcaagggaaggngggccctgggctgggtctctaaagngaagannnnnnnnggggagctngtgagttgaagaggctgggnagtcatccagggccccaccctcctcttccctctgtnccctactgcctctgctggcagacaggggcaggggtcccttnntcccctcaacaccagacacacaggcaggggctgcagccattaacggtcaggcctttggacacaaaatactttcgctttgnngtctcctgacgtcnnccccccccnggccgcgccctcccttgctgcggcgccccgtcctgggtgttngntgtgnggnnccggtagtcagtaagcaggcggccggtncgggcgtcccagaggcgcacgatgccatccaggctgcaggtatataccacggcagtgcctgcctcccacagcagctgcacgatgcccgactggtgctgacactgatgcctaagagtctgcgtaccagagtcatagatggccaaggtcccatccaggtagccaacagctgccaggggcatcacactgcagaagcccaaggnctccaccgagttggnctcactctcctccccttctcccangctgggctgggaggccacagtctcaggtctaaaaacacccaccaccttgccggngggggnactgaccagcttggnctggcagtccacagagccagttaggatcaagctgccatcctggttggcagcaacacaggtgagtgggncctggtgaccctcagtccct

SEQ ID NO: 682894 - DNA, 598 bp, Homo sapiens
  misc_feature (29)..(29): n is a, c, g, or t
  misc_feature (217)..(217): n is a, c, g, or t
  misc_feature (241)..(241): n is a, c, g, or t
  misc_feature (413)..(413): n is a, c, g, or t
  misc_feature (507)..(507): n is a, c, g, or t
  misc_feature (546)..(546): n is a, c, g, or t
gtgcaatgcctcgtcacagttcctgtgcngcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggangacggccggacgtgtgctgatgtngacgagtgcagcaccaccttcccctgcagccagcgctgcatcaacacccatggcagctataagtgtctgtgtgtggagggctatgcaccccgcggcggcacccccacagctgcaaggctgtgactgacgaggaaccgttctgatcttcgccaaccagtactacctgcgcaantcaacctggacgggtccaactacacgttacttaagcagggcctgaacaacgccgttgccttggattttgactaccgagagcagatgatctactngacagatgtgaccacccagggcagcatgatccgaagtgncaccttaacgggagcaatgtgcaggtcctacaccgtacaggcctcagcaacc

SEQ ID NO: 682895 - DNA, 434 bp, Homo sapiens
gttgaattttgtaactgtcctgaacatgtgatattcgaggaagtcacttcatctctgtgagcttcagattatctttcgctctagaataagataggcgcatatcttgatataccttactccatgagtacagggttgccagccaaccagagcatattgaactccaacctttactgagaatgtagcggtgactttgctgggtagggggctgggttgcattctagagacatgggaaaaacaatgacaaagcatctgatctacaagtacaatactttatcataagttggtctcggttatatttcatttttggtataaaaaaaaacatcatgcaaaaacttgctcatttccagtaagacatttacattcctgtccagagaaaaaacttggccatcactcagctaacataatgctttttcaaagtatgtacacttagagca

SEQ ID NO: 682896 - DNA, 620 bp, Homo sapiens
  misc_feature (239)..(239): n is a, c, g, or t
  misc_feature (263)..(263): n is a, c, g, or t
  misc_feature (435)..(435): n is a, c, g, or t
  misc_feature (529)..(529): n is a, c, g, or t
  misc_feature (568)..(568): n is a, c, g, or t
ccccgactagcccgacagcatcctttacataacggacatcgtgatcctcgaggatcacgatgtccgttgctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggangacggccggacgtgtgctgatgtngacgagtgcagcaccaccttcccctgcagccagcgctgcatcaacacccatggcagctataagtgtctgtgtgtggagggctatgcaccccgcggcggcacccccacagctgcaaggctgtgactgacgaggaaccgttctgatcttcgccaaccagtactacctgcgcaantcaacctggacgggtccaactacacgttacttaagcagggcctgaacaacgccgttgccttggattttgactaccgagagcagatgatctactngacagatgtgaccacccagggcagcatgatccgaagtgncaccttaacgggagcaatgtgcaggtcctacaccgtacaggcctcagcaacc

SEQ ID NO: 682897 - DNA, 106 bp, Homo sapiens
tacggctgcgaaagacgacagaagggcaggcatcgtgtgtgtgtgtgtggatgtgtgtgtgtgggttttgtaaagaattcttgaccaataaaagcaaaaactgcca

SEQ ID NO: 682898 - DNA, 1395 bp, Homo sapiens
  misc_feature (310)..(310): n is a, c, g, or t
ggccaacatgtactaccagccttcggatcaagttcagaggtgtcttaaagcgtacgccatgtgaccttgcgtcatagtagatcatctcttgatgtgcctccatacatcgtgactttctgatagattgctggaccaggatcctctcagcatgagtcattgttggtgagtatcacctcccgtgcgagcatttgagagtcgttggcagaaatcactggaagctgtgaggggattgatccggagagtagtatctggagttggcagcggcgcaagcgacgacgtgcgaagaatctcctgtgatctgccttggcancaggccattgtgccacgatgaagtagtgcaatggtcggtgtaggcggtgccatgtgctctgcggccagggcagtgccgctagcagggaacccgagacgatcacaccgcagtgctgttgcctgcaagggtcggtacttggactagtcaatcaacgccgccacgaacacgtcgtagagggcgtaacaggctccgtgccacctggtcaggtccgtcaggcaaggtgctaccatatcctgagcgtagcgtagccaccgtgaccgacgccggcggattctatggttcgcgccccttttgcatgaatggcatagggaactgcagcgaagtagctggacgcccaattgagcgtgcccagtacaaagtatccgcagaaccattgggctcggtaccggtgagctagcggtcgagttcgaaagcaatccacccaggttattcttcgccagttggaaagcctgtgcgtgccactgagggtccctggaatcatttgtcgagcactcggaaattgatcgtaagggagaaggatagtagagaaccaatgggccagagatacaataagggcccacgggaggttcccaggccatgggtggtccgccctttgtaagaggtctccaaagcgttgaaaccttaacgcaatggggcccccatggagctttggggcgccacagccgcccctgggggccccacgacaaaagaatagcggcccacagcgagaagcctcggagcatcagtgccccgaacaccaagggcgacgccagtggcctatgtccgaaagccaataagcggatgtgagcccgaaacccaaggcgggcccaagacctataccaccttggggtacccgtactgggagacacagtgcacacaccattatcggacagcaaggcggaggacacaaggggatcccttaacaccgggcgggttagcatcccaggaaagtcggccgcaaaaaagacaggccacagggacaggaaaaggagcgtacaatggcacagtgaggggatacccgcacatagtggcagaaaaaacaacacagaaccgcgaacccccggtgaacccccacacggttagatgtagtgagcagacacccgccc

SEQ ID NO: 682899 - DNA, 603 bp, Homo sapiens
  misc_feature (28)..(28): n is a, c, g, or t
ccagaggattagtggaaggagatatcgnggctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaaacaacgaaaagactgaaaaaaccctagaagaaaaaaaaggggggggggctcgtgccatatcccttcgaggcctggacagtcacggctacgcctacacaacctgatgacaactgtcccgattctaccatcggaagggaagatgaacgctaacatgctctgccttataacaatcctctaaactagtaattgttatacaaaaccgattacaggacccttga

SEQ ID NO: 682900 - DNA, 179 bp, Homo sapiens
ggaacaggaaaaaaacgaaaccccctggcatcatggcatcctgtgccattaaaaccccagccctcccagtgggcccattagcctgacattagggaaagtgactaatatgtgtccagtagctcccttagttgggccactcctggctccttaggaactccaactgcctttgctccctttta

SEQ ID NO: 682901 - DNA, 832 bp, Homo sapiens
cggtgcagcgggggggccgggggccctggtggccctgggatggggaacctgcggtggcttccgcggaggtattcggcagtggcatcctggggccggggtcgcgtgaacgatggacgggggccgagggcccgaggccgcggaagctcgacgcgaggcaactgccgaggataacggagtggatagcacagtcaccaagctcggagcacagcttggtcaacggcacatgaacgcatcaagtcaccataggaggcacattcttagtgtgcttcctccgcttgccctccatctccagggcagctcagcgcgcgctcccttgacaccttccctctccatgcgcgcgcgcctcgtcctccccgggcctgcaccggctcaccgggcgcgcgctctcctgccccaggtgtgcccactacacgctccggtcccccgtcttgcccttctccctctctcctccctctctcccggtggtcgcaccgtggtgtctgcgcctcggccgcggccctcccctccgcgcgcgcgctcctctcccacgcttgtcgccgcccccccctctcgcctacgttgtcccgctgcgcttctccgcgcttcgcgtcccagcctcgtcccttctttctcgggccccagcctccgccccccctccttcgccgcccggccggtgcccctcctcactcgtccgtccacgcggggtcccgcgccgcctgcactgccccctgctcttccccccgcccatcctccctctcgcgtctcggtctgcgccgctcggactgtgcgcgccttcgtcctcgtggctttcgtcgtgttgaccgcctcatcggctccgtctctgggttgcctc

SEQ ID NO: 682902 - DNA, 689 bp, Homo sapiens
  misc_feature (445)..(445): n is a, c, g, or t
cggacgcgtgggcgacccacgcgtccgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacaaaaaaaaaaaaaacacaaaaaaaaaaaaaaagggggggcccccccaaaaatcccccccggggggcccgccgagcttntgtcgccgatcctccccgcgcttttttgttgtgtgctaccaaagtgggggccccctctattatggaggcggcgccatttttaaatctccgacggggccgcggcgcccgcgctcgtttctaccacaccgctgcgtcacacgtgggaacaaaccgcgtcatcccgcggggcacctctgttggtgacaggaaccccctccactcctcggggggggtggaaccctatggtggcacccactccccttcg

SEQ ID NO: 682903 - DNA, 951 bp, Homo sapiens
gagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggcgccgccccctgcctctcggctctgctccctgccgcgtgcgcctgggccgtgcgccccggcaggccccagccatgtcagatgcatgccgctcgattatggcatttacgcagcgagcaagatggcgtgcagtgtgcgacggttactgcaagcataggcggaacacctgcgagctgcctgggccagcgttccctgtggtacactgcaccgacatgcgacccacctgcacacagaacgagagcgtactccaggccaaggccggtggtcgcctttccaccgacggcacacttccgtgagctctacaagatcctggagagccaccagttctcgcctcataacaccccaactgcagcaactgtggctgacaggcgcattaccgtggcaggcgagaagactgcgcggacgaacccctggtcaccgtgggcaacatatcgggctgcgccgaaaatttccactgcagagccaacatctgcgacgggaagcgacgaccaggacacctggccatcccgcgagcacgtcagagacggaggtcctgccgcggcccctgcgtcaacgacgccacacctccccctacaccccagtaggccgccgtgcagacacccgcggtaaagcctggcccccgaggccccccccggccacattacaccaccccccccaacagtacaacccacctgaatcacaaacgaacaccgcccggctccaacacacaaccgagaccacacacaggccacagggcacacgtcgcagccaaca

SEQ ID NO: 682904 - DNA, 250 bp, Homo sapiens
ctagaggatccgggtattgagtggcatgtgagagcagtacatgcgtctggcacggcttcctgctgctgtcgccattaatgaccggcagacttcaacaagctgggcaagctcttcacgcagattctgcgggtcaaggaccgcgacgacttccccgttgtgtcggccggcaacaaggcagatctggagtcacagcgccaggtcccccgagtcagaagcctctgccttcggcgcctcccatcacatggccact

SEQ ID NO: 682905 - DNA, 542 bp, Homo sapiens
gtcaatctagaggatctcctgtgaaacgagacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaacaaaaaataaaaaaaacaccaaccctaacacactactcacacttcaccacaccctagggaaattcactactcctcacacaatgccggcgcgaatttgggttcattggcccaattgcccctaaaggggggcgattaacaatcaactccccggggtttacaacgccgcctgt

SEQ ID NO: 682906 - DNA, 754 bp, Homo sapiens
  misc_feature (28)..(28): n is a, c, g, or t
  misc_feature (386)..(386): n is a, c, g, or t
  misc_feature (391)..(392): n is a, c, g, or t
  misc_feature (395)..(395): n is a, c, g, or t
  misc_feature (404)..(404): n is a, c, g, or t
ccagaggattagtggaaggagatatcgnggctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaancatcnnaanaaacacatntgggtgagaagagaaatcacacacacaaatgaaaaaaaaacacattgtgggccgcaccgggacccatgaaaaagtatttcagaaacccattgcgttggggcggcgccgcgggcccacataatggtcaaggtggccacagtggggtcacagagacgtgtgtccccgaggaaaatcgcgggcgcaaggaacaacggtgcgtggggattctcccacccaatttaaaacccgcccgggggggcaacaaccgcgacggtttcttggaacaaaattcccagagagggagcttgggagcgccccatgcagggtttctaaccaagggggcttccaaaagacgactcgaatatcaatag

SEQ ID NO: 682907 - DNA, 301 bp, Homo sapiens
gagtcccattgtgtctgctgtaggcttctcctctaactctctgtggaccatggagttatgaaacattcttatgccattgcagcattagaccgcgaggaagtgatctaactattgctgcagatgagatagtccagatacgttttctcttgttaagatcgctaactttgataactcaaaaactttctacctaggttgcctttacccagcaagtctgtcgactggacccactttggaggtaaagttgaactcttagctccaaatccagcccacagtggttcctgcttgcttgttgccctttcgt

SEQ ID NO: 682908 - DNA, 733 bp, Homo sapiens
tgagccccccccccccccccccccggcggattgcgggtataacgttcttaaagttataggggtccctcccaactagaaagattaccaaaataaatgcctcctccccaacatagttaccgaaaagacgatataccaagaaatacgcaaatatcgtagtcgtccaaccataagccgtatcgtccgacccagcattcacgtatctttaggcccggggattccaagagagggggataggagttcttttctatccctatagccggacagagaaggtaagaacgcgggcagagcaagaaagagaaaatagaagattcggtccgcgtatagtgttcgagagaactaaagtaaacctcgctcctcagcctctttagaagaaaggcccaagacgccaggaaggccggaaaacgaatgcgcgccgctagccgggaggtaaaggaaccgataaacgtcctcagccagaacactagtcaggaaaaggagggacatagagttcgattctacgtctcgaaaaggtaaggaatttagaatccgttctttccacttatccaagttttaattccgactactaagggtagtgtacgggcgacttcgcctttacgaggaccgcgcgctgtattcgaatataggatataatgcgggggaaataattccgttccttccgggctcgtcggttctagctgtttcttcaggccttttgaaacgttcccccttcctaaccctagcctcggattacgaa

SEQ ID NO: 682909 - DNA, 336 bp, Homo sapiens
ccaacacacctgacgcagtattcttgtttctattacatgtcttttaaaaatatttatctcgtcgagtatgttgctcatgcgtgtaatcccagcactttgaggggcaggcagatcacttgaggttatgtgttcgagaccagcctggccaacatggtgaaaccccatctctactaaaaatacaaaaattagccggatgtagtgaatgcatgtctgtggtcccagctactcgggaggctgagttgtgagagtcccttgaacctgggaagcagaggttgcagtgagccaagattgcatcactggactccagcctgggtgacagagtgagagcctgtctcc

SEQ ID NO: 682910 - DNA, 663 bp, Homo sapiens
  misc_feature (24)..(24): n is a, c, g, or t
  misc_feature (364)..(364): n is a, c, g, or t
  misc_feature (370)..(370): n is a, c, g, or t
gccgcaggatttaggcaaaagacnacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaangatttngtgccgtctgcgggggattttgtcctaataaagaaaaaaaattcttgttgcgcgccttgtcccattcggttttagccttgggcaagtttatcctcgcggccgaaatttgcgctcacttgtccatattcccctattgggaggggtattcacaatcacttgccctttgttttccaccgggcggtcttggaaaatcctctggggttcccaaattaaattccttttgatgaaattcccctttgggcaggtggggtttttgtaaaaaggcccccaaccatttgcactttcaaaaatta

SEQ ID NO: 682911 - DNA, 653 bp, Homo sapiens
  misc_feature (28)..(28): n is a, c, g, or t
ccagaggattagtggaaggagatatcgnggctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaaaaaacaaaaaaaaaaaaaaaaaaaaacagtggggggcgcgcccgggcccgcaaaaacctccaagaccagtcggggggggcccggggcccaaagaggcaacggaacggggccaaaggggacccacaagagaaaccggggcaaggcacaaggcaagaggattccaaccaaaagaaaaaagcgccgggggggcaaccacgaggggctccggaaaaaaatccagaagagggacgctccagaggcgccaaaagggagacctttctcgcgcggaggcccaaagaggccgaaaatcaaacaccgccggaggagcgcggggggcga

SEQ ID NO: 682912 - DNA, 547 bp, Homo sapiens
  misc_feature (42)..(42): n is a, c, g, or t
  misc_feature (49)..(49): n is a, c, g, or t
  misc_feature (55)..(55): n is a, c, g, or t
  misc_feature (58)..(58): n is a, c, g, or t
ctaccctgctttcgttgccatatccctccagtgcataaaggnggaagcncccctncanataatatagtggcatctgtatgagcccagagtcctatttggggtttcctcagcacagcccctttaccaggggctttccaaataggagcctcccatctccaggtgttttttgtgggtttgcccgtcccaaaccttacgatcctcctggaaaaaaaatggtagcagccaaagtaaagggtgagaaactggataagaagctgaaaaaaatggagcaaaacaagccagcagcccctaggttcccccaaaaaaaaagggcggagcaggaggctttttctggtgagtgcaaaaagctggaaaaaaaaaacgaggctttaaaaaaaaggggggattccctggccaaggagatccagtacctgaaaaattttataaaaaaggtccccaaggcaagggggaaaaaaagggtcccctagtttaggatagtcaggagggtcaatgtgcttgtacataaagtgctgtagctgtgtgttccaataaattattttgtagggga

SEQ ID NO: 682913 - DNA, 172 bp, Homo sapiens
tgggaagggaagccaccctcggtcggactcgtgacagagcatatacacaggacacaggataaggcagaagtactccagatataacagactgaccccagccccccgacacataaactactgcagcataaatactggaggctgagaggctgtgtcctcttacaccactcaagtg

SEQ ID NO: 682914 - DNA, 290 bp, Homo sapiens
cattcagctcggtacccactttccagagtggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcgaaagtgctactctggaagtggggtccgagcag
